United States Patent 7,868,149 (PLANT GENOME SEQUENCE AND USES THEREOF) - sequence listing, part 18

SEQ ID NO: 8645 - DNA, 12405 bp, Oryza sativa
  unsure (1)..(12405): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacctttctaccgaatagcaaggatctaaataatcagccatgttagggtttctatatgatattatgagagctaaagcatgtgggcatggtttaccagaaacttgccactctctacaggtgcatgtatggtttactagattgacagcatgtctaataatctgatgttcagcagtgatctcagtcacctcagcttggtctctatcaccttgaactaccttcaagtggcccagttctctagtcattgcattgagttgacaaaccacaatagatagcatcacaccatccaatttctcacctatcttcctcctcctagccaatagattcattgtctttgacctaataccatctgcaagctcaacaattggaagatgtttcatatctttaatccatttgttccatgactctgctaaattgttggtgatgaagtcacattttatctcttctgagaacttgcttctcatccaaagcaatttgtgataggtttctaagtatggcttcacatctgaatttgcctcataaattttattcatgtaatgataaaatctttctggcatataagacctagctgcagggtacatgttcccgaacactggaccttgaaacttctttatgaaattctgcatcaagtgccaaaagcattctctatgttctgccctttgaaaaacattcttcacagcattctctagccccttacaagcatctgagcttatagctaaggttggaagattgcctactgccttattaagttgttgcataaaccaagtccagttgtcagtggtctcactctgaaagaatccaaatgcaactggaaacatccagttgtgtccatctatagatgttgcagaagctagttgaccattccattttccattaagtgccgtggagtctatactcaagtaaggtcggcaacccattatgaaaccatcaatgcaaggtttgaatgaacaaaagaatctgtgaaaataaatcccatcaccatcttcctgtacatctatctccacaacatttcccggcattttcaactcaatctcagccttaaagttaaacaaaaatgcaaagctctcttcccacgtcccaaatatttgctctatagacttttgcatacctgcataaactgttgagtatcccactgtgactttgtgtgtggtttgcaactcatcttgtagctttgttgcacccatatttgggtccttctttagaaagggaatggccttttctgctacccacttgtaggatgacatcttggttttaactctcgcggttgatgtacaatgatggggaaatctgttcaaagtaacctacaacacaaaagaacacaatgcatgatcaaaatgtattattttataattatcactaagaaacaaaatattgaatatgtaacatagccatgctaagttagttgttagtaccctcacagattttccatcaggctgtaaccttgccacaatagcccatgggcatccctcagctgtgcaatagccccgaaacctctctgtgtcaatcttctctgtccctaactcaaattgcccctttatagcatgttgcctcacagctgacctaaactcaaccatacttatatataagcttccaacttccattggaggatcatccctatcatagaaaactccagcttcaccaggaaccacatcattaacatctatctctgcctcgttaaggtttaagtccccttgggcaacatctgcagctggattaggagcagaatccctttggttttcagcttgtagcctagcttgttcagctctctcatcctcagctctaagtccaacgaatgcatacatgtcatcttcccccatcaaaggcactgaagaacctacatcagcttctagaattggagctatctccaatccatcccaatcaatgacttggtgatgaacttgctcttgtggaatttgagctatttccaatccatcccaatcaatgtcaggcagattgtttgattcatcaccatgtctagctgtcacaacctcatccataaataactcatttacctctgaaacggatgaattagtaaccaactgatcatgcttgtcctccacatcagcatacagaaacaactttttatcacttttcctaacaaacaatgcatgcactacatccatattgtccttaaacggtgtttcctcacccgtggtcatgtcatatccactcatcacaacctgttggcacttgccccatgttacccttgctgcaaggtccttctccaagctctccaaagtgcattgctgatagtccacaacccattccaagcactttcgtggcacatgaacacaagttccatcaacaagtttagctgtaaattgaccaaactgaacgcacaccctaaacaccgcatcgggatcaatcctatcgaatagtaacaacaaaaacgagagaagtaaatcattagtttgcccgcttaatcgttgctgacctacacgctcttgagcttgcacctcgattctgcaataatagatagcaggggagcatgatcttaccccgaagaaagctcattatgtagcaatgaggccgtcgcctgcggcacgccctcttctcgagccgctgtctcccccctctccatctcctccttcaaaccctagatatttagggtttccattgctgggcgtggtggcatggcgcggggcgggggtgaagctgccggcgaggcgcggttgcacggtgcagagcgggggacggagctgccagcgaggtgtgggggcggggcgcggtcggggcggcggctcgtagcggcgttgcgtctgtcggccgggaggaaggaggaaggggatcgatatgtttcccttttttttgttgcgatagatcgatctgttccctaagaggaggaggctatctctctactctcctgacaggtgggcccatgggtaaatccgtccggtcaggtgagaaagatgaaggaaagtattagaaatctgagaaatttgggaaaatagagaaaaatggcatggaatgaaggaattcgtgcttccaatggcatattctgaaagtcatgcgaattaagtggcatatcctgaaaatggtgcgaattggatggcatatactgaaaaatctcgatcaaggctactcaaaagaatccaaacagaacgacgcgacgagcctcatttttcctccgtgcgtatggtgaacagtactctacgacgacagatcagaaaaatgggactacatgcgtgcacgagtgtcgttaagagcaaaacgacataaaaagcgactacacaaaaatttctgatgcactttatttctgagattcgacagagatctctaggtaaccacgtctatccaacacatccccttcagcccctgaaactgctaattaatcacagattgagacgtttttcttacatacaactgcctccggagtattaaggtttgagaagaaaaaaaaaagactatagcgacacttatttgaatagaagtgagatgatggttgaggtaaaatggaaggtgattgacaaggaaaaatagtattttaaaataatgattagtttaggataaattttgaatcctgaaatagtaactattttgaaatggagggagtacttcttttgttttagaactcaagatgtcttgattttaatataagtcaattattttcaagtttaaccatataagtttgtaaaaatgatataataatatctatatatagtatatatcttgatgttccctagaggggatgaataggcatttaaaactttcttgaaaaaaatacagaaacagaacttttcagatatttcctaatatttttggatatttttgaaatgttttccgatattccgaaaatctcagattacgagtaaactaactaagaataaagaatagcggcaattggggagaggattacacaaacaacaattaaactattagtgacaccaaataacaaagctagatgagtgagagagatcacaaggacttttataagacgatctgttcctaaagttcaaattcttgagggggttttctactctccattgagaaactcataatgagtcgagtcttttttaatatctcataattataattgcatcgacttttgttaattaaccttataatattctgatgagtagatactactatatgatcagtttatccgaacttctcaattcttatacgcgtggcgacgtcggccggcgaggcggcgaccggagaagtaaaagcgaagcaagctagcatgcgcatatatacgtatgtactacgccaccaccaacgacgacgacgtacggacggcagtcgtcttccggcagctaatagctatagcggccggtcgtctcgtcgacggcgacgtcgccggcttagtctctgcggcggtgccgccccactagccttgccggccactcgccgtccgccgcgcgtcgccaaaacgagccgcgtgtaaaatcgtcaaaacgcgcgatctcagcgcgtgtgcatatgcacgcgtggttaaaaagcgttcaacgggcgagtagctatagctagctagcttagctagatataggtcaaaggagtgagctaataagatactccctccgtcctaaaatacagcaaccttatactggataggacatatcttaatacaacgaatctggacatacctctatccagatttactgtactatgatgtgtcccatccagtatacaaggttactatattttgggacggacagagtagtgcttattgcacatattatagtgagctaagctacctcaagagcaagactaataatacagctaacttgttagctgtaagattatttgcagccttctctcagctcacccatataatagttactccatccgttccaaaatataaggcacaaccaccattaacccaaagaccaagaaacaattattatcatctcctagtttgaatcaccctaataaatataatgcatgcatccaatagaatttgagatcttgagggtggaggatttaaaaaaaagtaataatttaatggagaagaagtcctaataaattgtatacatgcatgcatgccttatgaacatcctaaaaaaatagttgtgcattatattatggaacggagagagtagctctttacaattaatacatgatcacttgtctctctcacagagtttcttggttcttatgtgtccaagccggctgtaagtttacagcccacttctcctctttctctctcttctctcctccacctcagtatttagtcggcttacaacctcctattatacttgctctaatgctgcaccatcgatcactagccactaaggctatatacatgcacatatatatattagtttactataccacagctattttagttaagttttttctattagatgacatgccaatcgatagcgagagaagtgtttataataattttgtgaatatataccaagacgtatgtgtcggctcagctagagatgtttatatatagcagagtaattatgtgtgaatgtcttacaatgatgaatgtatactcacatttacattaatgtttatgcctgttcagatttaaagtactagaatttatctcattttatactagattgctatattttaagacggagatagtagtgagcgagtaaagggaagtctttccattaagtttcattgattactattatataatattttgttttctgaaagctgatggtttctctttttttttcctttttctaaagcttgttatttctagttgcatatcaattctaggataatctagaagtcaaaaccctagctacgtctataccatgcagacagtctcgtagtattttcctgtctatatatcatgtttcaattagctacttagagctcttcgtgattaacaacccactctcgttaaagggattgaaatagtcttccacataattttgactcgatcaccatattagtgtccacatttcactttattttctaatgctaacaaagcttttatcttgattaaagtgttttttatggggagcactacaaaagcaaatgtataaacaaagaaaagtacaggaagaaggatcataaaaagtatagtggggtttagaatgtgcgtgaaaggacgtgttctttaattgatatcgacattcaacaaggacaagtttttgttttcttgtgcttcaaccttttgcctagggtccaatgaatctgttatgcaacacatacaaaactgtattctattaaggaatatcggcagccttgttgaaaaaatttaaaagtgaattacacgtatgtatataggtcatcacttattcttgcataccaagttttatcttaggttacttgacctaattttttcttccaatttggacaaacttttcttccctttagtttaactttgagccttttcattctcttctcctatatgtgatatattctgaatgaaggaaagtcattggcactgcccccccccctctggtggccttctctcttctgtacaatactacatacacgcctcctttcttcatatatcttcttgcattgcaccccatgtattttccgttgctttgactctttcatatcctatgaaccactacaatattgctagagcacaccgctagagagatgggcgtgagttgacctacaccatccatccctatgcacccttttcgcagtcaccatgttagtagaagtagaggatgggagcaacgaggtggcgtgtggtagtggcatcctccaaaggaggatgcattggactaatgggggagtattttgccattaggaaccccgtgagtgagtctcattttgttcttaatggacgttttacccatcaaggatcagggttcaggtccccattaccttatgcaggatgccttgatcgatgattagatcttggagctaactcaccatcagaggagagaggggacaacgagctagggaagtagcaacaacaacaacagctagggtccaaagcaaaccaaaagaatgaaaaatgattgaaagcgaaaccattagttaattaattgtggtgcaagaggaaacttcggggagaatatttggtcgatgctgttgagttgtgatcgaaattcatctgcacttaataaaggccagcttccgtagtggagcggaggcccgtctcccgtacggatcatcatcccttttagggttccaccatatatatatatctcttgtaagccgccatgcggcgatgtaacctcaccccagatatagtgaagatattttgctggctggcgcccgtggttttttctctcctattttgggagggtttttcacgttaaatctcgtgtcttctgtgattgatctattgttctttatcgtttgttcgcttatcgtttcctaacatatgcgatataatgtgcaattcactaaagtattgaattaatgtgtggtctgtgttagctacaaacaattaaaaggagaagaagaaaactcaaccgcgaacattgtgaattctaaaacacaataattgctcttgccttatcccattacaataaccatatatataatggatatatagttggatacatagccttggatgcattaatcgatcgtctccagcttcactcaatgaccatatattcttgacggttcgacaccacctaaggtaagatgtgttcttgtcggtcgagactggtaaggttacatttcttggcttttcaaaagtttaatattctccgtagttctcttggcggttagaccgctaatagaactttccctcacgattagcaaccaagaaattaatctggatttccttggctctctaaatttggtggttattatttggcaggtagtcgtaaaaatatattgccttggtgtttttgaccgcaaagaaaattctggattcttgtagtcaaatagcacgcatatataacacatcacgtgtatatataaatagaactatagatgccggggtacatagcgttcttactgaattgaaatgatgcggatcgtgcaacaaatgtttatattggttgttagtgcttgatggagaggaggatccatcatatcgatcgttttcggcctgtctatatatatgaccagtaacacgcattggatgcatggtctctattagtttcactttcacttgcaaattaaaccacatgatgaccagtacacaaatccattttcacttgcagatttgacaagaggtgcaaatgattcttacctccactacaaggatatggattaggcctgcccaaatgttgggctccacatgtatcctactactaatgttttgtgatctctccccctttacctgggtatgttgcttgctaattcaattatatatcttcaaaaaaaaccctctactcagcacaaaattatgattttgccatctaattacatatatgtaatatgcatggataagaatgagatcatatatatgcatgcctggcactaggaagaagcatttgttgtcataaatataagtgtcggtgtagtttacagtcgatttgctccattaattcaacggttatttaataacttctataccttttttatcttgtttattataaaaaaatatatactccctctatttttaacatataacgtcgttgtcttttggacatatatttgatcattctcttatcaaacaaatatgtaaatattatttgttttactgtggctagttttattattatagacacttcaagcatgacttttatatttttttaatattttttagtaagacaaattgttaaacatatatagaaaattcaacaacatcatagtacttaaaattaaggttatagtagactagaataagactgaaaagacaataatagtaaaatctagctgaaaatgcacatcaagtttattccgagatgtttgacgtgcgcaaccggcctcgaatttcacggaaccgccctgatgcaaatcagcatgcaacagtcaaggacgacaacaagatagagacaaaaaaaaaagaaatggctggtcgatttcactaattctcactttctcagtggctatatcttgcttttggtgaggcatgacatgaagtaagcaaagctcacttggctagtccaatggcacagagatgaagtatgctccaaagtttgtggctatcctcctaatacaattcctttaaataccacacataactcctcccctccaaccccctactctttcgccaagaaatactacaccacacacacatttctaacttgtgaattgtgatcgatcgatcattcggtcgtgctagctacctcgtaatttcatcatcccaaatctccttgcaaaactcgtcttcgtcgtcgtatcatcatggggaattgcatggtgattcaagataggaacagggagatcaagatcatgagcatggacgtcgacggcgagatcctgaagctgccgccgccgccgccacccctcaacggcgtctcctccgacgacgacgacgaggcactccggccggcgacggccgacatggctgacgacccacccggcggcgccgtcgtgagggtgaagctggtggtcagaaagcaggagctgaagaagatgctgctgcacaacgacgccgccgccatctccctgaacgacatggtgtctctcatgcaaaaacaagctgaagcagatgagctgctgcaccagcaggagagctgcggatcagtgtggcagcctaccctgcagagcatacctgaaggcagcgttttctagctgcatgcagaacaaagaatgatgcatgcatgaatttaccattttggatctcttgaataagtttatgtatgtattcatggacaacaagagcagtcctagcttatatatgtatattagagagagatagaggggtatataatagctagattgataaggaattttgaggcaaggattctctttgtcttttcttcttgattaaacatatgcatgtaagaaggggtaaagatggtcctggaaatcaagcaagatgatagttttatcatgccttcgttcatgcatgagagattatgactaaaaactcttcattgtatctactgtttgactcaatttcatgagaagctgagcacagttcttcggctccattaacagaactatcatatttcatttggaagctttagactccaaagaaatacatgatcttcgcttggctaagggcctgattggtaggttccaactcttagatttaacatcaagaactggatctggagtgaaattatggagcaaccaaacccagctccacctctctagttaatcattttgtgagagcactccagccagcttcactcccattggatggagttgaaactgtttgactggactccagctctcctgggagttggagctctaccaaacatgccctaattatacataacattagtacggacgtctgacagagattaacagttcgagaagttggccaaacaatacctactactcgcgttgccgacccaccttagaagcatccttccacctacttgtactactcgctttgccgacccaccttagaagcatccttccacctacttgtgtccagagtgcagatatatgaggagaatatggacatgatttccacctggacatcccaggagcaactcagcccataaatatggagcacaacctcgatagtatatgaatggtgggtggcactgctcacaggtcgaagcctatcagaaaaaggggggtgtgcactctcatcctacttacgacatggaaaatataggagagaaatcaatgaatgttccaacataagaaactctcgataatcaagctaatagcaaagatcaaggaagaggccaaaaccttagactttggcggaggaaaacatctcttcttgagcttatagcttagctatttcaccatataaagtttccctcttatatatgttctgatcgattttctcctgcgcatacaacaatccaagattttttggcagccaaaacaaagccgccaatattattcgttatcttgatgatcataactagttgataaggatacaactattttattgagggttacgtagaaccgccaagttatatccttggcggctgtagcggtcatgaataaggtatttccttgatacttcctttggtggttgtagcggccatgaataaggtattttcttgataatttccttggcggttcgataacatctaaagtaaagtatattattgtcaatccgaactgacaagtttttatttcttggcgctttcgaaagttggaaatgatcgtaattttcttgttggggagacaaaaaaaaaactctttccataacagttagccgccaataaaatggaattttccttggtctataaacttggcggttggccggcaaaacatgttaccttaacggttttgatgctatccttagtggtttgtgtctgtcaaaagaaaaatcctggattcttgtagtcatgctataatatttaaagaattggcacactcagtgttgcttcgttttctgtacgtgtgtcccgttgtcaattctgttcgttgcaactctgacgacaaaacaagatgtttacagagatagatttgttttttactgcaggaatgtatatatgggctgcaaaggcctataggctttctcgtccatccgcttcaggccttaactcgtactcggcgccggcgtcctcgtatctgcacggcggaaatcgacgccacgcggaggaagaaagcaggaaggtatagacctgaatgcgatccatatataatcctccggctttccctcttttaaatccggccggcagagctccggccacgaagctttttttttttttgaaaaatatactccctttatttctaaatatttaacctttttagcacatgtttaaccgttcatcttatttaaaaacttttgtgaaatatgtaaaactatatgtatacatataattatatttaacaataaatcaaataaaaggaacgatcaaatatattttaaaaaataagcggcgtcaaatatttattaacggtgtgagtatagtcctcggcgcggccgtttgggagcttaattaatttggcgtcagcttcagcagcaggcccagctcgccgccggcgactcgtcttggcacgacgacgtacggcagctgagcacaccatcgtggccacctcttgcatcgtccgaaacgattaggaggagagaaggaaatacatgggccggaaacgttaagctatataaagaaaagcccaactcgtacgcaactgttcaagaatgtttgcgaaagagaaaggggctgcaggaat

SEQ ID NO: 8646 - DNA, 1730 bp, Oryza sativa
agaaaggccaaggtgtgtacttttaagaatgactctggtccaaacaaagggtcagctaattaggccagataagaaaatgtccgatttaattatctcaaatacaggtcaaatctcattcgtaactctcaattgcaaaaccgttaaaacggctgtcccgcgcgagatcgtgcttggacactcgcctgcgaaagaaggtaacaacagggatgctggcgagccccctacaagcttgagctcgggtagcaccgtcatcatcgatcttcatccaaccctgaaaacggtatggaaatttccggctgccgtttctagtttacaccgaccgttttcagtcggtatcggtaaccaacagtggtggaaatggaaacggtaatatcttctggaaatggtagcggaaatgagatggaggtttttccgaccgttttgtcggtaaccgtatttgtatgataattttcgtcaaaattccgaaaaaattctggaagttctctagcggcttagcctgcctaacccatcagaagtccatgaatgaaggaagtctagtaggcttgcggcccataaaaaagggaaagtgaccagagaaaaatgttgttaattaaccctatgatgtggcatgtggattttgctgaactttagtcttctcaacttatcgatgttaagtattgttaaactttgtttatactgttcatcaaacttattatcatattattaatcatcatataacggtgttatgtggtgtgtgatgataaaagaataaagttaaaatgtcatttacatgtatagttaaatgtgtgctatgccacactctgctgattctgacatgaatttcgacttccaaccaatatcggtatatttcgttccgacagtcctgtttctgatataccaatattaccgatatcgttaccatttccagatctaccattctgatttcgtttacgagaaatatatatatgaaaaagaaaatggtatagggattttccaaccattttcatccctatcttcaaccggtcttcatttgaataattgcaatggtacaatgagcgtttggaaacttgacatcacaaagtcacagcaaagctcaacgcacgtatacaatcaagccaagagagggaggaggaattgcatgtcttggtttcaaccttcagaagacaaaagtgcaattgggtgttcaagtccttgtaactgatccaagggaacttgagaaaattcgttacataacaaaggagcgaattgagaaaattctgaagtgctctcaaagaaaaaagagagagagagagagagaggaggaagggagagaagagcgcacccgtgccccaaccgaacggtaggagagaagaggggaggagccgccgccgctcttccaggattcggcttgctgctactgtcgccctcctgccctctctgcttccagtataccctgctttctcaaagtgtgtaaggagctagagaacgaggcgaggatgagacatgggtcctactattttattttataatataatatagacgtaggatagagattagatcaacgtgcgccacgcagagcaaaactgtcatccaaaccatttgagaaggcccgcaaactaaccggtattgatgattgatggagtcattatacatagctttgctgttaagggatacatattagatccaacatatattttaagggatttaattaattaaacttttgtttctagctaataggttaaatatataagggcccatatatgagggtcgag

SEQ ID NO: 8647 - DNA, 6067 bp, Oryza sativa
gagagcattccatttttatatgattttaatttttgggtttgtacttttgtatttgattccatataatttttatatttacatttgagtccctataatcttgcaataagatacttgagatcgttttagttaaaaaaataataaaagggtgagaaaagcagaaaggtgcataaaaagaaaaagaaaagccgcataaaaaaaagaaaaacaacaacaacaaacgtagatccgaacggaaaagaaaaatctgattcctataaaagaaaaaaaagtggtggaaaaaaaagctagatccgattcctttaaaaagggaaaaaaagttttattcctataaaggcgaaaataaataaaaacatctaaaaaattcgtccgattccctaagaaagtggcgaaaaaatgcttcgtaaaaaataaaaagctggttcgtataaaataaaaaatgcacgcgagaaaaaaaaagaaaaaggcgaaacaaagtccgatttctaaccggtatatatctattctctatctctaatctaatctaactatttaaaaatagaaaatgcatgagaaaataaaaatggttcaaaaaacgtgtgagaaaaagtcagaaaaaagcgcaagaaaaaacacgctaataaggttttccatcttcctaaaaaaaattaaaaaatgggtgagaaaacttatttccattgtcggtaaaaatttttttaaaaaaaacatgcgaggaaaaagctgtcagaaaaaccgcgccatttttaaaaaaatggtttgaaaaaaccgtgcaagaaaaaaaaacaccatctattaaaaaacaaatcactctgaaagtactgtccaaaaaacgctaaattgatggacgcttgagtcggataggatccatcgatttttgccatctactacacggcttttatttcgccatatattctcctgtattggaaaaaagtaaaaaagaacattcgaaaaaaagcaaaaaatacgcgcgagaaaataattgtcagaaaaaacaggcaaaaaaacacacgagaaaagaaaagcaaaaaagggagaaaaatatggttttcatcgtcagtgaaaaaagaaaaaaaaacatgctagaaaaaaactgttagaaagaaatgcgccatttctggaaaatgattagagaaaatcgcgcaagaaaaaaaaaccatttataaagaaacaagtcgctcattaaaatacaaacattgtcattgacatgattatgcatgaaaaaagtatattatcattagaatttttttcactcgttgcaacgcacgagcatttttctagtctgtttaaaattaagataattttatcgtccttaagtaagtacctagagataccatatttagtgtaaaatttggtacatttaggtatcaagtaccttaagtatcaaaaaatttattgtaaaacaggaactgtaaatttcctcttaaaactatacttcagatatattctgctgatcagatgtttgtccgtgactgacatgtgaggccccggtcaacgtgtcactacgtgattggcctgcacattgtccagttcttttgtggtcgacgtgactaatataataatatattcggattaattttttaatagcgttagatgtgtttggcagtaatccgctaggggcatgcgaattagctaagggagttgatggagaaaattaacgtgcgaatttaattttttaattctaattatttcttttttgctgggtacattgctagagagaaataagagggtattcatgagagaattcatatcttctaagatatttgatgtgtgacttttgaggtggaaaattatattataagtcatgatgaacggtacggtgaggatgtatttatctttcacttaaaacacagttctcactcaattaccacccctccctagggatagattggtgggagttggatcgattaattccccatcccaatcttttctaagggtctctttgaatcataagaataaaaaaacagaggaatagaaaaaacataggattctgacatgaatgtaagtgtaaaacagaggattgcaaaacacaggaaaaatatagtaataaccgtttgattggaccacaggaaaaacacaggaatttgaggagagataaagactcaaaggatttcttctatgaggttctacctctcgttaaaattcctacaaaacttgtatgggaagagacattccataggaatttcataggattttatagggtttattccttttattcaaagggctttgtaggaaaaattcctataggaataaaatcctatgaatttcctttgaatcaaagggggcctaaattcataaatcctccgattaaagtgagattaaaatgctcagatttcttacactcccattccatctctcaaactcctctcaactataagccgtaacgccacgaaaataattagagaaaagaaaaggagcaaaatgaaaagagcaaagctagctagcagcccagtagctagccggcccagcagcaaaaggcagcccacagcagcatagcagcgcagtgcaagcagcagcagaagagcgagcagagcagcagcagcgctggtactgtagcaaaaataatcccacctcaccaattcaactcgagggagaccttttctccaacgaaagttggataaaattttagatactcgtggaacgcttttcaaactgctaaacggagaatttcgtgtgaaaactttctatataaaagttgttctagaatatcagattaatctattttttaagtttgtaataattaaaaatcaattaatcacacgttattaccacctcgttttacgtgaaacacttaatctttatattcatcttcatcttctggagattcaaacaccacctagataggagaagagcccccggtgagtgtaacagcatctccaacagcctctccaaatcgaactctccaaacacccataagccaactctccgtctgatttagctagtcaaactagatactcactccaacagactctctattaatcctctccaaaataaaatcggactcacatgtcaacatctatcccctcttcttcatctttctctcccccttcttctttctctttccttcttttcccccttccttccttcccgtcgaggcggtcgacgcatggtgcggtggtgcggcgacgcggggaggtgggaggcggcgacggcgacaacggtttaggggcgcagcagcggagctcggggaggggatggcgatggcggcggcggctcgcgacgacgacctcgacgacgaccctgacgacaacctcgacgatgacctcgtgaggagtacagttgctgcgggccaccgttggcgaggcgttttggctggccaaatctagccagccaaccagcgattttggccagctggatggctgccagtctgttggacctcctttttatggttgaatggccaaaatttggcttggagagtctgatggagtggttgttggagatgttctaactccgattctggaattttttattaaagtgaggacgaaaaagtagtgagttgtagtgttaggtgtggtcaaactggatgagatggatccaatactgtttttgggccttgggcgtcacaaaagccgtttaagtttttttttattaggtgtctctccttttatcccgtatatatacttttgtaagctacatggaaaacattttcattgttatttacctatgtttttaactaactccttgtcagggttatggataccacatacctattagtagttgactaaatctcggcaggactcaccacataccatgtcttatgcggaaacaaccttcggatatagtaggagttccacataaggaaggatgaatagagttctacatggaaacgacaaggactactcgggttgtatccatattggttttcctagttctacttggacaaggtgatacttatgggtataaatacaagaccccctaggagaagaggggatacggaacaacagaagccacaacatacaagccaacatatgccaagacaaaacgccggatatcgacttcagagataggcatggctagtcccctacggtacctacggataccgtcaggagagatatagcgatgtctcttatctcgccgaatgcggattcgaagaggaaagctaccctgttgtcgactacgagtcaaaccttcagaccgtcatgtcgataacagttagataggctaccccaaatattgtaatggtgtgattatgatgaataagagcaacgaccggcttcggccaacgggatgtagggttattacctgacaattcagaggcctgaacctgtataaaaatccctgtctccatctcttttacctcaatctcgtatataccctggtaccaacgatccccatactatgcaaataccggaatcgcgacatcaaacgtcaacactcctcaatagtgatcatttccagtcgactctcatggtattttttgtaagtgttattcacataaatatttgtacctacatatctattatattattaaaatagttttgaaagaaggcacttcgtttcttgtggaggctaaaaaatcccacattaatcaaagaaaaagaaaataaaagtccaagtagacgtacaattaaaaaatatctgaaatactaaaaataagcaatattgaaagaagagtccatataagaacccaatacaagataattaaaattcggaattaaaaataaaataaattctgaaattagaaaaaataaaaagagttcatgtaggaatataatttagaaataactgaaatttggaactaaaaataactaatatctgataagagtccttatacaactgaatacgagataattaagttcggaataaaaaaaactaaatttcaaaaatagaaaaatgattataaaagtttaagtaggaatacaatttataaatataaaatattataataaaaatatggaattttcaaaaaaaaaaagataacctagaactcaacgatgacaaataacaataaagagagagaggacaagtaataggccctaaaatagtaaggtggtgaacagttgatgggacatctaaaaattataaacaagaccacaaatagaaccccagcaacaattaagaggtggaataacagacaggacgctaagcagcatagccacgacggttggcgtgacttttacaatgtaaaaaatgaattgcaataacaatcatgttttattttaaaaatcttcaatgataataaatgggcaggtcatataggagtatagtggtggagccgacagcggttggcgaggcttctagaaattaaaaaaataaacccttaaaatttgaaataaaaaaattgacaatgggaaaataattctatgagttcacaaataaaaaaatcggaatgaaaaatatggaattttcaaaaaaatagtccatctgaaactcaacgatgatatataatagtaaagatgagagaaacattaggcctgtaaagcagtaagttggtagcaattcatgcgacatctaaaagctataaacaataccataaatagaatcccaataatgattaagaggaggggcgatagacaagccgttaagcagcacaatcacgacggttggagggacttctagaaactaaaaggtaaatcgcaatgacaatcatgttcgatttttaaaatctcaatgataacaaaaatacatgagcatagtggcgaagtcggcggcacggtggttgggcggatttctagaaagtaaaagatgaacctcaacgatagttatgtccaatttttaaaatcccaacaacaataaatatggaagacaataggtggatcatagagaaatacaatattgatgtttgacaacactcctaaaaattaaaataatggaacctgatgagacaatggactctaaaaacttggactctagaaactaggaggtgcaatttttaaaggtttaaaggaagataaataaaagcagtgatagatcgtacaaataaaagggtgataaaagagtaatgggtaatgactggtgtgacttttaaataaaaactataaaaatttaaggatgataaggttcgatctttgaaggttataagacaacgcaatggcaatttaacaaattttaagtaacgggctgcaggaattcg

SEQ ID NO: 8648 - DNA, 28014 bp, Oryza sativa
  unsure (1)..(28014): unsure at all n locations
gggatatcaaacacacagcccatatatagaaccgtacctaagcaagatggctaaactctaaaaaaccaaacctataaaacccatattgctaacggtgaactaattatttaacttaacaatccatgttcaccgaatacttcaaaaccaaattgggtagtcgatcgtgtgcccatgcatcgatcgaagcacaaacagatgaatttccatttatattttctagcccgggccacatatgtatattcgatcagcagcaagcccacaaaaacaggtggcctggatgatagcaacgagaacaaacaaatgtgccagcaataatgtgtcttacatttgccctcggtcaagtaattcaccgatccacagctagcggggaaaaagttcttaactcgagtaatagaggagatcagtctatattcgggaaacaggtcgaactcgatccattgttttattgagagttaatatttcccgatctggtgtgcttcttacttttccgacgaaacctgcaattaattaatcaaagtacatcagaaatagccattcactgctgtttaatgcacgtcataattaaaaatcttccaatctagctagctagtgttctagaacacagttcaaattatgaataatggatcatctgaaggctaagggaataagtatatatgtacaaacccttcacaacagttagctgattaatcaattaccagctggtagtagacttgtacgaacttatgaagggccatgctcaggtgggaaagttccaccaccctacatatatggaaacaaagaaaaagaaaacactcatttgagatatctctttgagtttatctccatttccatggcactgtgttgaaatgcaaaataggcgcgaaacatgaatgaactaacacatctataattatcagtgggataatgaaacaatagtacgtactcctatatgggaagcaaaggtgacagaactgagataaattatatgaactaacacacacatgtttaatactagtattacattaattacattattactccttggtgtgatgagagacagtacaatgtggatctagcagatttgtacatagcagatacatttgcatgccacatgtggaaaggtagctaatttgtggagtagtactagtaaattagactgagatgcaaaatcgtaccgcttggaagtgaatgagcgtagtggtgatgcttgccagcggctgctgccgtatcgaacgcaagcaggcaatctttgcacttgacggtggccttagaatgatgtctagacatgtgtctcccgaactgtaacagtttagtggatcagaattcagagattcaaattaaatcatctatcaatcgatcaactgtagtagtagtagtaagttatgcagctgctggaaattaagacaattatattgcacatgtacacatgctctgcatttctgtaccttgtgctttggaatgtagcgtgggtcatcgcactgcgaggcctccatgcagatcaaacacgacaggaaatcatctggacagaatagcatagctatcccgtatcggcggtagaagagcacctcctcgtccgtctcggggtgtaactgcctcacaagcgctaacgcctcgaggaatctaccagtcgcgtcaccgctgatccttcgcctttgttggttttttttcccatttctggtggcgttgcaggctgcatgcagtttcagagagcacggcgtcaatacgattattgcccggtgaaacattacacgatgatgccccatattgccacgcgatcgcaatcgatggtgctcgtctcgagcggttggatcggaggaatgtctcggctggcccgtcgagaagagatcggagaaaggaggtcgagggtttaatttggaagagacctcgtcggtggaagggcttcggtgcggatgctgtggtcggagtcggaggtgtgtcgtcgtcggtgcagtcgaacgcgatgacgaagtacggcggtgggcggtggcgttcggaaactgcagcgacggccggcgtcagcaagtcaatcgcgcgcgatggcgctagggctaggcgctagctagctccgaaccggagagggaagctgggttttggactaattttggtcagaaaacgaacgggatagagagacggcactgccagtactggtttggtttactcccgccggtggacaaatcgccgccggagaagttgacgacggcgaggaatcgatcgaaacggggagaaaacggcaagggaggagatgatgcgggagaaatggttagaaaattgggggagaaaggcggagatcagaatgagttaataccttcccttcgtgtgctcggtgcggtggacggcgcggaggaggtggcgtggggcacggtgcggtcccggagctcgcagccggaggggtcgacgacggcgacggcggcggcttcaaccctcggaaactgcagcgtgagaaattacggcgtcagagagtacaacgatgctacgcgccatggcgctccagtctagaaaattccagaaaactccagaccagttagctagggtttggatcgcgagtggatgagatggggagaacgaggagcgcggatgcaggaacaggatgctaagttgctaaccttaagctgcgtgctcgtcgagatgcggagatggacgaaggcggtggctcgtcgaggtggacgaacgcggcgtggtggtgggtgcactcgccggagcccgcggccggagaggtagaagacgacggcgcgcgcggcggccgcgctctctctctctctccgtcgcagcaaaggagctcgcctcggctccgcgagatcggggggtcctggtctttatagccgagacagaaggcaaaagcttttttttctccctttttttctttgttttttttaaacatttcttatttccttattacttcctctcgaagaatggaagacttcgcacgaaatacaagcccaacacaacacggcccatctcctctgtcgccatcgcactgagataaactctctcttccgtagcccaagcagtggacagttactgagtgagtttagcatttgcttgtcagcaaatggaattactggtacacaatgcccataacaaaagctacacaattactggtacaacaacaattactggcacacaacagctaccaattactggtagtccgtaaactactacagtataccagcatctcaaccagataaacatcgcacagcgacgacgtagtacatatcagatgatgaattatccaaacaatatgagcattgttacatatctgacaagccaatgcatgtgccaggtgcatatgcaaaattgtcacttatacaagcattaatcatttcaacgaatcattgttgacttttaccaatagaaaccctatatactgttgtccaaatctcagtcccagatgttctcaacatgatcaagggattcctattacacctcatcaaaagagaagatcaatggagaactgtttcttcatgaacatgagaccaaggaaaaaaatttacaaaaaatagaaggcaacatagaaggaatgtactatctgtctggaaagaacccaacttctttactcaagagaatgttccccaagctccatcttccttgctgattgaagacgaaaacaaaaatatgctgcctgagcacagctaaataatgaacaattgtacagaaatatgcatatatgagatgttcttacagggatttccactaaaaaagtacacatggcacaaaacaacattctccaagtattgaattgcattttttgactggtcttcatcaaatccttaaacaaggcattatgtgcaatcaataatctggatgaatatcattctgatgcatttcagaatacagccttatagaccctggcaccctgcccagttaccttctttacagttctcatctatcagcaaagtgtgagtgtatttgtttggcaccaatccccttgcatcaaagtgtacagttgagaagaattagtgctcatgcaaaatgataaggattttacatggaaaaaagaggggaaagaacgccaggtctaaaattttatgtgcatggaacattatggcaaggaattaagtcaggtagagaacctggaagcagaggtgttgcgtggcaatggcaacagtccgtctcctcaccgaccagaatttcatcacagcttcatctccatatccaaagtgggtgattctgaatttccatcaacaacaaggacgttcgaagcaacaacttacatctgccgagtagaaacagggatttgactcaacataaaccatgtcgaggtaacagtttatgtagcttacagccggagatcacgggctcaagaaaagatctcgaataaataaagaaggaaagaaagtggcatgaaggggtccatataatgatgggaacagactgccaacagaataaagaacatccaacattgcaggatttcccctccacaggacctgtaagacagcttcttcacaattggcaccccttgcctgaaagcaagccaggatcagggagaaatggttccaaggattggcctgctggttgtgctggttggattggccttccaggcaattctccatccaccacctcaaaaattgtgtggctcaccaggtggacctcctgtgacatctcccaggatcaagctcagtgatagaaggcacgcctacaaagagggtggagttcaaaaagacaaggccaagtagataatcgcagtgcatgcatttgatgaaaccaaggacttacccttgcctgtttctaaggtaaaggcaaacaacaaatacagtaagattggaaattcctctttttgtgtggatcaaatctacatagaattgcaacattgattttttttctttagttcacacttttcttaacacattactttgtctgtcaaaattcaggaacttgtggatgaactgggaatttaccttcttgctttcgacagagcagggtatggggaaaattatccaaatcccaagaggaatgtaaggagtgaggcattggatattgaggagctcactgaccagctcaagcttggacagaagttctgtgttgggaatgtcgatgggaggatacccaatttggggtgccttcagtatataccaaacaggtaaagaccgaaactgcaatactgtaccatcaatggtatatgtgacccttcactctccagaaatgtaaagatacaactactgtgtgcaggcttgcaggagcagcgttagttctgcccattatcaactactggtggccttcttcccccgctgagctatccaggcaagccttcatgggtctcatcatgccagagcagaggacactctggattgcacacaacataaacttccttgctctacctctggatgacccagaagtggctcccttcttctgcggcagccatgcatcatcctgcaatatttagcaagcatgatatggaggtccttcagcacatgatagcgatgcctgtcattgaggtaaatcagagattatttcacccacatgaagtgctatttaatagaacattagaactacagataaacaaatgcatcggccacatccttcaaagcttgcttgatttatactactgtggtcaagagaatgataactttacattaaaaaatagtaagagaaaagctttcaaaattaatatttatatcaaaaccaacctaaagaaaaatgtcccaaaccataaatactacttgttcaggatggcatatcatcgctttctcttcatttttcagaataaatcaacgcagcaaggcaaggatatggaaattgggaggttgatccaatgaatattaccattcaccaatccatttcctcaaaatgagggttatgtacacatctggcaaggatacaaagatagttggtgctggttgagctgcaacggtaatttcaaagaagctttccttggatccattatcatgaagtcccagaaggaggacacatgttcatgctggcagatggatggactgacaaaatactcagggcattcttggttggagaataactctcggagctgtgagcctgtggctctcactgaagatgctatattgctatgtagtccttttttccaagtttatttccgataatatcaaatttggccccattcaatagatgacagaccatactgtcacattaagctatttgttaacagtgaattgggtaatgacaattgaaaacacgaagccttggtgcgtctctagcttcactttggttgtttatgagctgtcacaatgcctgcttcagctttcaagtacagaaggcaggtaaagaaataatgctaagataaatttaagtaggtcaatgggtattttaaaaaagaataatcaaatgcaatacaatcctataaaacagtacctgaatggtactaacatagtaataaaactcatggaaaccacttgtttcttgaaatgagtaagagtttgggcgactgcagaaatatagtacctgttaagattttttttcctctgtctggtaaaatcaagtttcatatattccaaatttgtgacagactgggcattcctgtcattcctgatacacctaacagaattagtccatagtattttcaagtgtagtaataaaatgttttcaataccagtgaccagactaccagacagcatgagccatatgacttaaatcagtccaagaanatagttcatgatgagagtgaatacatttataagcaacaaaaatgcaatcatcacaaaaagatcagtctagattctaccaaatcaatgaaataatgaagccctcatagacaatagaatccacaaatgtaacacttagttgctttctttatataacacagctaaaagcatattcggaaacggaatgacggtttaactacttcagagtgcacttctggaaagagcgaaaaccaaatcgaagaaaggcaggtgtctacaacctgaccatattgcattaatcaacagagtagaaggtactaggcaatactaaagtaatcacattagtaaacataatactaagcattacttgatctaggttctggcatcatgaatgtcatcaactcactcgcatacaatgttacatctttttcactgctattaggtataccactacccacaaagtacataaatttgcaaaagatcaagaatgaatgtcagaatgaagtcactactttgaaatttgaatgttgcatatggtaataccaacattctgcaacaagttatggtccattttgtcaaaatgatacaacttacaaccttcaaaattaagaaatgaaaccaagataatgtatctgtttacaatatacggttaaaatgtcaagtagacacagttacacaatcacaaatccttaaaagtactgtaactcaaccagataaacttttggcattggagaatcaaacacctgagtacctgatccacaagaactgattaaaatgcaatagagaatagaattcagagatgcatggattgatcatgttgtatacatgtgttttggatggatctgatcggatacaaaagtacaaatgagaaattcctgagagcaaaataaaatatactccctccattttttaatagatgacgccgttgactttttctcatatgtttgaccattcgtcttattcaaaaattttatgcaaatgtataagatataaatcacacttaaagtactatgagtgataaaacaactcataacaaaataaattataattacgtaaattttttgaataagacgaatggtcaaacatgtgagaaaaaatcaacggtgtcatctattaaaaaacggaggtagtatttatcagtagcacttcagaataaacagaagagaagaaaaatgcatgagcagatgcttcagatatcaggatttcaagtacagcggattaacttccaaaccaaacggcttacctaggtttacagacacaattactattatgacttcttggaatgtttcaagcggcaataattcaatggaatctgaccactagtgaatgaaaaacatactgcagatttgtactacacaaccaacctctagcaagctgtgcaatgatttgagaacacagattaagtggaatagtaaacacttgtgtgtgtcagcaaattaaagggcctctctgctgttgtagtctcataagcagaccatgtcttgctcatctccttatcagtagacatagaattttcacccaagatagtttaacattaaaaatcaataaaatgtatccaaacaatatgagcattgttatatctgagaggccaatgcatatgccagatgcctatggcaaaattgtcagtgttacaaggattattcattattcatttcacaaaatcattgttggcttttaccaataggaaccctatatactattttcgaaatctcggtcccaaatgttcactaccattcaactttttttttttgagatagtaggtatatgggagacatagtcaagagatttctattacacctcatcaaaagagaagaacagtggagaacatctgtatctccatgaagcatgaacatgtgaataaggaaaaaaattgacaaaatttatccaacatagaaggaaatgtttgtatcaactatctatctggaaagcacccaacttcttttctcagagaatgttccccaagctccatcttccttgctctgattgaagacaaaaacaaaaatatgctgactgagcagagctagataatgaacaattgttgcaaagaaatatgcatttatgggatgtccttacagggatttccaccaaacaagttcacacggtacatctttcttaaggacctgtctatgcacccaaaacaacattctccatgtactgaattgcatgttttgactggccttcatcaaatcccttaaacaaggcattatgtgtgcagtgatctggatggataccatgctgatgcatttcagaatacagccttatagcctcttcccagttaccttctttacagttcccatcaatcagcaaagtgtacgtgtatttgtttggcgacaatcctctttccagcatctcatgaaaatgctgataagctaagttagttctccccatcctgcaaagtgcatgtatgagcacattatatgttacttcattaggtcgcactccttcctccagcatcttttgaaaccaaccatatgctgagtaaagatttcctcttctacagtatgcatgaatgaaaacagtataggtcacagccgaaggtggcaacccacttacaagcattccatcaaaaatatcccttgcttctctcagacgccccctttcacaatgtgcgtgaatcaagcatgtgtacgtgatgcagtcaggctgtaaaccgtcactgaccatcttcatccacaacacataggcatctttcaagttaccagatttgcacaatccatcaaggaaaatattgtatgttactgtatcagaagaaattcctcttgaaatcatcacctctgtcagctgaaatgcctcagaagtagaacctagaatcagctctgcagaaatccttgtattataggcaaagcaatctggctgcaaacctttgctcaacatttcatcaaagaactctcttaccatcgcaagattcctcaccttacgagacccattcatgagaatcgtgtatgtagaaacatcaggctgacagccctgctctaccatttcctgcttgaatctcctagcttcctctaaatcacctaatctacaataaccatctaaaagaatgttatatgtcaaaactgatggggctaaccccgcacgcttcaaatcaccaaataaccaaagtgcctccttcaaattccctgccttacaatacccatttattaaagaattgtatgtaatcaaatctggaagtaatcccattgctctcatttccacaaacttcatccgagctgcctccacattaccacttctaaacattccatgaataattgtgttatatgtcaccaccgtgggtacaatgccctcattctccatctccaactgcaatgctccagccttttcaacagaaccccttgcaaaatacccagtaataagtggattaaacgtgaaagctgacgccttcttggacatccgcattctgtcaaccagctgagctgccttctccagctcacctttcctggccaacccattaatcaccacattgtatgtgacatcactcggcaagcatccaccaggccgggcctccatctctctgagcaacttggcagcctgatccaccctaccctccctgaagaaagaatccaacaacgtgttgtatgtgacaatgctcggctcgattccaagctgaagcatctctgcatacaccgagcgcatgtcatcccacctggcttcatcacgcagcgcacggagcacgaggttgcattccttgatgaaagggggaactccgtggtgcgccatctcacggaaagcggcaaggcatagcgtcgaacaggtggagggcgcagggttgcgagctcgggtattgaacttggtggacaggcgcaggaggaggttgaggaggtagtggagggagacggtggtaggaaaggagaggaggagggagacaagggggaggagaaggccgaggtggatggcgcggacggagacggggtgggcggcgtggaggtgcttggcctcggcgagcgggacgaggacggcggcgtacgcggaggcgcagcgcgggaagccgcgcggggtggcctccgcccaccggaacagctggcgcgcgaggcccgggaggccgcggagcgcggcgtggacgtcgccagcggcgagcacctctcggagcgcctcgggtggtgggggatcagacgcgagcagcgacgcgaacgggctctcctctgtccgaggcgggggaatcagcgccgtcgacgacgacgacgacgacgaggagacgaagcggaggccggagatggcggcggcggcggcggatgcggcaggagcttgggatttgcaggggtggatggagaagagcatgggttaatgttcgagtcctccccggcggcgcctcgccatgaatggctgcggcggcgggcggaggcggcgccggcggcggggaggaggaggggagaggagggagttcgatgcggtttgtaagatggtcgcgtggccttctccttcgcacacgacttaacccagaaaattttcttgtaataattcacttctctttgggcttttctgtaaatggcgcaaacgcacgttactctttagctgctccctttgtaatacttggttctttttcactttgtttttacttcaatcatctgtttttttaatggagttttatggctatatttaggatgcaggactttaggaaactttacgaacttgtatttctctttttttagggaaataggacaagtggccaaagttgaagaataaacacttcgtttcaaaatataaagaattttgttagtacaagcttaaaatctcttttatattgcttatatattgggatggttgtagaagtactctagggtcaagtagctagtttttttttttcgtagatacgttagcgttggtagacgaatggataggatagtatcccagtggatgtattgtaagctcaagttgtgtttattgattggaagttgctaagataccttgaactacaataatatgcgggcacattacacgctgaactgtactccaaaatcgatatagacatcaggatttgagccgtagtttccagctttcaatcgcaatctggcatggaccaagactaaaaccacgaacccacaaagccatgtaatgtatgcatatccttgtgatttcgacaggttcaagcgaattataggaaattacagacagcatccatcaggtgatggcctcccagtcccaatgtgattcctctactactgtaggaaccaatggtgatgataacgggccatattgagctgaatctcccggatctggcccgattttaaatgcatcctacgtaaagcataatatacggatgcattttgaggacaaatgtaccacgttttttgttcactacaaccgaaaaatcagcacaatgggcttgcagaaaggaactcaaagcccgggttttcataagaatcagtagctgtcttcatctgtctcgggcctccggagataataacgcaagcaattcacgagcacctatatgatggcatgttaagagatatataagtatgatgttgctgagatgaccaaagattttaacagaaagtagtaatcaaggcattgcaatacctgagataatgagctgttcaattttgcacctctgtaactcacatggaatttgtcctttgcaaccaagccctgaataaaacatcacatatgaagtaaggaagggagttgacagaacaaggggatttcataacaaagaaataggaacatggcatacttcagtatctatctcagctgattccacatcaacgttcacgtcagtgatgatcttcactatttccagaagtagaccaggccgatcagctgtctctatgtacagcatgctgcacatgtttaactaatatcaatgaggaagacggatgatgaacatcatatggagcaaacagagaagtaaggcacatgttatatcagatgtgatattgagaaacaatacatgcattactaataatatgtagacatgtatcaagcatgaactattaaatgatgtgcatagaaattcaatgatttacagactcaaattaccatgaaaaaaattatacctgtataaaactagggagggttggggtcacagtgttatataatgcaaaacttcaaacatcttataatagattcaatgtctttgcacaaatcttggtggactttggattgataggataggcatgaacatacatgtatatgtagttgtgtttctcaagttacttctaccggttgcattcgtaaagtatgctatcaggtccttgttttgtggagaaatcagtaacgataatatgaatcaagagtccttgtgtgcctttttttcctctaacacataggagagctgcgcatcattctattaagaagagagggagtctaggaagactcgtacaagcccttaaggaccagggttaaacacaacaaacaaaaactagaagaaaatgtgtgcctatttttaaggtaactatctagccgtgcacttgtaatgccccataagtgttcaattatacaatctgtggacatgtcacatcccactcctaagcaaggcatactgaaataaggaatcacgctaaaattgtatataatcattatggcttagttggatcaaaccttcttttaggtccatcatcttcaacaattacatgtgttacaacatcaacatcaacctgagagtttaaagaacaaataaatcacgttcatgctaaagttaatggaatacaaaattaacagcataacaaaacactcaggaacctaacttttttactgtgttaaaattgaggaaaacacacaactttaaaattgagaagatgcttgataacagagcatgggtggtgaacaagcagaatgagaacatccaatgaactcaccttcttctcaggagcttttattccaaaaaattcacccatggctaaattctcacttgattcctacatgcatatcaaccagacaaatgagttagtttgatactttgattcataaaaacaagaacggatccaaaattactaacggtagaagttctaaacacaagtaaaaggatgtgacgctcggaacatacaggatgatactgcagaaggttgttaataactgttagccgtatcttttccaatgtgtcagggtcctcaactttgcgccccctagatacagacagaagagggggaaaaagataatattagacatgaaattatccaaatcaccaaaacaatataagaagcatgatagttgctaaatgttttaatctcgtattgtgtttagtgcacatgtaaactattagtatggtactttgataaatatgtggattcaatgagaaaatacaccctctacttcaaatataaactaaacagcatgacaaaatgcagcacacagaaagtggcgtgcacccacgatcgcatgatgtggaactttgtttgtgtgacagctgattcagttgacacacttcctttcgtcacatcaaggcccaggtccttgagtgccttcatctgcaaacagtgaataccaggacaaaataatttactgatacaacaaaaattactaattacgaaatatatcttaaacaagatcagatcaaatagagcacccatagcataggaaaattataccgtgtcaagtagtgcccccagacggtctccaaaactcagctgcactatggttgcatcacggtctgagtcttgatctatcagaacaactggctgtggaattgcatcatcagatgtctgcaatatttttggggggagaaaaggtacatggtagaaaaatatcattagctaaatatgttctaaaatattttaatggtagtaagcaattaaaaatagcatacacgaagcaaaaaaaaagtaatgtcaaaacaaaaaaaataataatcggactaaatggaaacaatataagttctcatgcagatattgaaatgtgaagcaactcttcccgcggaccatgtctacaactgaactgacttcacacatgtcctcagatgaataattgcactgtggacctaatttgcaggctgggttgttactccagatctccactgtttaggaagacaactctatccttcatcacttgatttttttttaagtggaacaacaaagctgaaggacgtgtcgctgtgaaatgtgtgtttccatatggtgacatgaatggaaaatcaatatgtacataccgttgaagaagcacccaagacatcagccgagttgatagattggcaaaaaatcctacagtgatggcattgagaaaaatgatttagaggagggaatgagcttagttcaggacactgatgtactacaaataaccgcagaattaaatagcaacactagaaatagaatcacgttatgcatttcaaagttagcactcagccactcagtagccattggactgacatacatgaacaaaagtaacaaagggaaaataaggattgcacagttgactgcaactaagtactgattctgtccctttactgatgcaccagcattcaacagaaaatccttagatggctcctaattataaagcacacagatttctttaaaacgatcatatagtgtttacagacggacacgttgaatagaaaatatagttttagaaagctttatgccacaattccagtgctaaagcccacagaatccaacacatgtaacaataggccttcacgagttagtaaatgaaaagcccatcgtgtagcaaatcggtcttctcatgttgtttattcatttatgacttgtgagaaatgagaatcaaagtgtaggtagagttgtaacttgtgtcaatatggccttgaaacaaatccgcacaccgtggcacgagctctctatgtaaagtttctttcgagtgaactaaggatttgaagcatgaaagtaatttttttttcttgttcattccattcattttccaactcctattagtactccaatcaactgatagagaccttctccaacattcatgttcacctaaacatgaacctcactaccttagtgaaactgagactaacatggatatttccacaccgggtgaaactgcacctaagtaacgcaagatatacaagtgagataataataaaacgattgcatctcaagatactagaatttaggataatcgttcttgccagctgacaattacaacgttttaggcaaaaaaaaaacgtaaatagtgtaatccgtgtacaaacaaccgcaggacaatatctgtactaggtaaggaatctatcaagatactattagtacaaccgcgatttctccaagccaatccaaaacaatatcaactaattcagtctaccgacacgacactccaatagtccaatcctaccgcacatctcccgacacggcgaaccacccctccctcgtcatcgattcgaatcaaacagccagacgcaacgcggagatgcctagatcgctcacctcggggccgcggtggcggccaggccgacggatcgggggaagtcgtggaggcggaggaaccccggcgacacgcgagccgagtagtacggcgacacggcggcgggcgcgacgaggtggtgggcggcggcggcggcggcgagagccatggctggttggtggtgacactcgctgcgcgcactgcggcgaggcgaggtgaggtgaggcggtttctctctgtgtgtgtcttttctgtcgcttgctctggtcggggcggttgggcgaggaagtggatcttttttgcttatttttatttttttaatctgccacttggctgcattattggattggatgtgccctttttcttttcttttttcatttttttcccctgctgttgtgttgttcgtcagctaggattttttggacagtggttgttgcagttgtcaaaattttcattgaaatagttttattttaattattggttgccttgtctggcatgagagtatgaagtgtctcttttttttctctctctttctaggtgacgccagatgagggtgatgattcattcactcattcgttgattcccaagagttgcaaacgaaattggcatgcttactgccagtaataaagttgaagacgtgtcgatgaaacggaagtggctcgttctctgtttgtttaggaagatgggccgggctgaatcacacgttagttggaggcccgtcggggcatgtagtccatgtactccctcctactcagaactactcagaataagtttatttgctccttccgtttatctcaaaataagtttacttttaaaaaagtattacatcctagcttataaaagaaaagaataaatgcatttcttatgtatttactgaagtttggtaaaaaaactaaatgtatgtaaatatttggtaactttataaaaaaaagtatggtttaaaatgacatcaatccgaacagcccatgaattttaaggaactgtctatgtaacatccagctgaaatttttttgtcttttcagctggatttctagccgtcggatagacctcttgccagcatcccaacctcgccttgcgctccctgcctgcgcggccgcgcctcgagcgcttctcatttttatgtcttgttggattgggtacgggcttcaagcacgtctgtgttttgtctattataaaaggtccaacaaacaaacgggcttgaaaaacactggcccaatcactgtccacgtaacagaacatatcaggctttgcaacgaaagctctgtttaatagctaacattctctgaacatacgtcgggctatgaaaaacatgtaatctactgtgttcaaattttggttctctgaaccaaaacccttgaaaagaaagcaaagcactagagccacctaattactagtgcctaactagattgaccattatctccactggaagatcagccagaaaacatcacaagattgactttatctgttagcttcctagtcatccatagcgcaatattagaccctgcaaaaatttgtacattttacttagttacttcgtaccaagatgcagatatttctattccaatctgtgacagaaggaaaatcttgtacatcttcatgttgaattttgtagtcccaaaattcagaatgagtattagcttagaaaattatggatagaattttaccccaaaatcaaaatgagtactcattttaccccaacatgagtactagattgaatcattcctgcactttaagaaattcaacagtaattataccccaaaaaaaaagcatttgtggcatatactagcaccataaaaggagaacattaattaaggatggagaagtggatagcaggatgtcatcgaacagatgtaaactgtggaaaagaagttctcataacaaatactcatttctcaatatcaaaaccacactgtccaaacagcacagatcaggtaactaaagatgcaaaccgtggggtttaccgtggctgcctcactgataaccgttttgggatgccatgaccgacacactaacaaccgctggagaggtataggccatttcacccagcgccaataggatacacaatacaatggatgccttgctgacctccgaggaagacgttgtagccatctcgccaaccttgtctcgcgaacaaaaacacggcgcatatccttggccacgggctccgtcgtgacccggcggaacggacgccgacatcatcgcggatgctgctgccgcttcgccgcctcctcccccatcgacgacttctctctctcgctgacaacttgtcgggttgctctctctttcatcccgtgcgtggaggagagaccggcgaggtgggcgcgtgtgtggctgaagagaggacacgacgacgcaacggggtcgcatctccctgatttgggctggccttgtgcacgaatcttgaacaaaaaatcaatggccacaaattcagctgacaaagacaaataaatcagcaggcagccagttatcaattcccttctgggagtactaaaaaaattagtgacaaataaaaaaatatatacggtgaatggccaagatgcctttcttcctcctccatcgattcctcccttggcaaatgaatggcacaccactcttcacgcacctctgctcccctctgttggtttccatcagaaagaaggaaacaagtttctctgcgtctccgatctgcagtgcgagccacgaaggttggcgtcgtctcctcctccctctcctcctcgcgcgcggctgccgtcgagaagacgctcggcctcccttgtgcggcctcacctcctcgcgctgaatcccctactccccgtgttaggtccgctcctgcttgcctgatgctgcccgttgctggttcttgatccgtcatgtttgttacatgttccagttttatggatgggtttttttggttggctgattcgttgttggtgccttcaattaatcagtactactacattgtcatgccctggtagtgatgcgaaatggcattttttttctgttttcaattttgcgtaataacatgattgatgctagctagaacattttatctaggggtgaaaacggagcggatattacccgatccactctgtatccgtccgaaataaagatatgataagggtttttagatatccggcggatgcggattttaacatgtggatgcggagccgtatgtgatatcaacaatatccgacagatgtggattatccaatattttaatcggattatttggcggataatccgcatttctcatgccatagcccattttatatgggcagcccatgtagcccatctaccgttaacctaatccaatccccaacatgcctgacggcgcgtcgtcttcctaggtgcgccaccacttctcctcctagcgcgccgctgcagcctgctgcttctagcgccgccgccgcatccaaccaaaagcagcctttctactatttctagcaccgcctctgcccttgccgacgccgtcgcctgccgtcccccattccccgcgtcagcgcctcctccagtggagtccccgtccaccgttggcccgtcgcggagtcgccagcgcccagcgcctccaccgtcaggtactattgttttcttgtgatgatgaataatgactgaatgagaagtgaagtctggatccttgcatgttggcgtgtgcagtgtgttgtatggaactagttcatattagttcgtatttgcaacttactaaattgcaagagtaatggtagtactgtatggaacggaactttgttaatgtactgaagacttatatttttaagcaacgccgcaatgaactgaagacttgtattatgtatttgctggatgtattttggattattcaagctcttaagcacttgacaatctgctgtatgtgttatattatcaattatgcaagctgcactttactagttaagcaaaattatattattgatgtgttttgcctggtttttcctagagagctgagatcataaatcatgttcagatgttttgtcatcgtattgctgccctcttgttgtatggattgaatacaaacttaatatccgacaattttattccattttcgaaccgagtccgcaccaactccgtaccgaatccgacgtccgaaataatctgcatccgcacgtcatccgcacccgcttcgcatccactttaaaaatatggattaggatatggtatagaaactatccgtccgaatccgctccgtttccacccctaattttatatgttcttgtctttttaagcattggcacttgcctcattgcctgcattggtcaagcttacaccacttatgtaactgttaattgatgctcgctgctaaattggttgtgaattttgctttataatccatatcaactgttacgaattttcctaaactatccatgtctgaattagatgtaattcaggagtccgtacatgccaaaagtaccttttgtttttcgcccttatgttgcaagaatctgctgatgcaaatcttgatacagatttgaccttcataatccaaaagaagaggttttagttcaagcgaacgataatggggatatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggttagtaacgacctatctctcttcatatattccaccttttttaaacgttgacacaaggactgtagttctataatctagttttgtacataattgcagctgctaattacttttgaatattgtgtgtgcacgcttatgttttgtgcatgactgcatcaggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgtgagtcgattgttctcagatgtacttctgtcatgttgaaagaatgctcaaaacacattaagagttgtattgtttaacatcttaacattcttaattagtaaaattgctgttttgacaatcaaacgcttatggcaatcgtttgttgaacatgaaatccaaccatcattaacttctttgatatgcttgctagtcatatgccttaaagccttttatgctaccaacttctgtaaaggtgtggtcttagacaactgctattagaaatttagaattttagcatgcttttaaaggttgctacttcatccccctctcctactagttcaactgttgcaacatactgattgcagcagaataaccaaaagtacttcagacccaacaacaatgtgtgcaatgtcagactttagatgagttgctagatctggaaaagacttcatttctaggtagtttggacctctctttttctgggcgtcagattcacttctattctattagatagcttttaaattcaatccaagatgttctggcactggaagtgtagattctgttccaacttttagctactcattaactttagaactgtaaaatcaacccttttatcaatcgaaggcactcttttcgaaatgaagggcttcacgggaaacataatttgccactaaatcacataaataagtagtatttcagcaacaaaatctagctaacccctttttgttgtcactgggcaggacattaaatcatttgacatctcaggcaaattaccatgtgagttctatgcaatctgggttctgagaaatcttcctagttctggagcttgcattgtttcccagctcatatcagtgtttcccacacgtgtcagattacttccaaaatttgttcccagttttgcttacttctgctcctatctgaaggttagtcttcaaagtccttgtaaatcagaaagctgaaaattggctttcagatggttgtgctgctatgcttagctctccacagttgccttcatctgccaccaatatcctacaggcaaataaggctccagctataaatatatgatggatgcgtccagataaatagcactacagctgctgtcctattattcttttagacttttatagaatttagttagttggctgaaagcctgaaatagttgaaacatgcatagaaagggacaaaatccatatctagcccttattttgtacaccttcacatcattgtattttatcataatcttttttaggataagggactaccactagtttattggtgtaatgaccttcaaaattatgataaaataaagtgcatgcagtatgcatgatgtgcaaaaaaaagtttgctagcttttgactacctccagtaggaggctggtccattccatgctgatttaatagggtgcattccttatatttttttgtctagtaaataatggttcagttatatgtacttcgaactttccaatcagagattaaaccttcaacaactacaggtaggaggcttatcataaaataaagaaaggaaaagaattaattgcaggtaggactagagcatggtgcttactctcggggacgagaagcccagagggagctgagggcacggaggcgattatggtactcgccaattgccaagaaacatcgagctgcctgcctaattgtcagaattctgtgcatctgatgaagagtctgttgcctcaagttatcagcctggaaatccaatttgacagttgcagttttagtacatgatgaaaggatctcactcttggcactagaaaattgaaaactagagcagatactggtagtaagtttgttttactatgccatactatagttaatcagataagctccaaagtccaaaataaggataatgtcacatgtttaggtgaccattcttttctttgtatgatgtagagataacatctctacatgttgatgccatagcatattactgtaggaaaatttgttccttttcactctttattaattaacatgttggcatgtcgcattattaaaaggataaaaatgactgtttttttgctcgactgtcaagtgattggattgctcatctagacatccacaaagttgagtcaaacagggagagaaggatcagaactggaaaaagggcaggcaacaaggacttcacctgtatgacaaagccttcaaggttggacagcttgcccagggcaagggccatgtaacccatgaagctcccaaggctggcttcgttgaccacggagccgccattggcgacggtctcagctagtgactgatgcagctgctccaggccctgggagagagcttcctctgcctgctgcgatgattgctgaggctgcagatgccaaccacttgctgttcagtcagaggtctagctggggtgccactgtctgcatcaacatcaagagtttgtaatgaaattagaaaaaccatacttgtacttagaagatgaggtcagatttagcatggttaaaacttgatttggcaaattgttttgcacattgtgaactgtgaagtgagcttcatgtttgatgtcagattgtcaggtgcattttcttatgaaaactagcctagctttaacttatcatgttcagatgtgaggttatgactacataccatgagcatgtttaagcatgatatagtaaaagttttgctttatcatgaactgtgaagtatgctccatgtctgatgttactccagattttcaggtgcattttgtgacgaaaaaacttagctctttttatgatgaaagctttcttttattgtattgtttagaccacttattttaagctattcgttcaatttatttatcaaaatatttaatttatcctataattaaggagataatctgcagcagtaatcggctaaataatctgtttcaataattaaatagcttcgtgtccagaaaggggtttagaaatgaggaggatcatgtctaacttacttaaacttctaattactgacatgtgagcccgttgagtagaagatccacatgtcagtgactcatgtcagacaaaagtaagttagaggataggatctcgagtatgtatataccttgagcagatcggacggttggaaaccgcccatccagaggaagcagcgctcggcgggggtggcccacgtgccagtgatgaggtggaacacgtcggccttggcggcggctgccctcaggcggaagagctcgtcgtagtgggccagggcgtcgtcgacgatcgccctcaggtcgccgtccggcaggtgcgcgtgtagcccgccgtgcagctccgccatccgccgcccgccgtcctccagccaccgcccgtactcggcgtcgaacatcgccgctcctgccacgaccaaatggacagtaaagtaaaacatatatactgaattattactgatctgatgcaaatcctatatgacaatcaaactgaatttcacatttcagatcagtagataaaagctactaaacatgagagattgatcaagtgaaggcaatgcattacctgcgctggtgtttccacctggtgatcctcccagcaagaggccctgaaccaagaaattcagattttactgcattcatgatcctacctataatgtttagtaattagttcagaatgcagaaaaaaattactacctgggaacgagctctctcgagatcctgctccatctgagccagcctcaacttgctgctctcaagctgctggatgtaagcctgcaaattggtatttttgacagattatgctgtcagaaacttattgggaagaagaaattcagttctgaacaactcattttctttctatgcaggtactgaaattctcatggatctagctaggctcaccttctttcgcagccggctcttgcgtgctgcctctcggttctgggctaaccttctcattatctgattacaccaacactagagagtaagtaattgtctcaaactcatgtttcaaacagtctttaattagcttgcactgaatggttctgtacatacatataattgcatgagcacgcataatcatcatcatcatgctatctaattaagcatcaactgggagtatgagagagctaggagagtaggattaacctttggatcaagtgtctttgtcatcctgtggtcactgtgagtggaacttgctgccatcttctgcatgccatgtggacatgaacaagttattgttaattacaagatgcactttaattactacagttttgtgcagttagaaactatacaagataaatagaaaaatagtgatgatatacatgcttatgtgcctatggtgcaaataaaatatactagtatgatctttggatgcacgttacatcaaccagatataaaaaaacagcaatgtatatgggtggaagccacccactctaacaacagacaaaaatattgttctgcttttttgtttatgttgctgtcacgccctaatatgcaaagttctctttcagttaagcgtgagttagatataaacattgggtaataattgttcatccaatgtgatcttggcagttcatcaattggccagaaggaacctaaagcacccctgatggccaaattgccattgttcaggtatcagttggtgcaatttttttgggaccatactttgtgcaagctagagacaattaacatactataagaatgcatacttgtcgcctaatacagcacataagctagcatgcacaagtctaacatatcctttcctagacttatctgctcctcttcttttttccaaagaatgaaaaagatagaaatttgtagtggcaagtaaggctaaatgtcaaagaaaatgcatgggtaattactaaagtgatcatattctgcatctgattcttcagaaaaacgctggtcccttggatgaagcatcaggggaacaagttggaactttctaatgtagagccaaataatacacctaacttgttgggattggtgatcttgggagcagcaagatcttaaatgaccctgaactcttctagtactactccatgagcatcttgagttgtgggctagctactgacatgacaccagactagggaacaacgcattgcatctgcaccactgcatggctttattttcttctcgcgatgtaggtatatgcatgatcaggaatcaggagatccatgcagaagcaaagacaagatgaacacctccaagaacaagcgtttacaacaccaaaacgcatcaagaaactcaagaccaagaattacaccaaaacgcacatcaagaaactccagtgattgatgagaatgcaaaccttgtgctgcttctgctgctgctgtgggatctgatcaaactggctcgccatgtcggctgctgctgcaccctgatcgccgttgttcttgctgctgctctcggagtccgttgtgtctgccgttacatttgaacatccatcctacagaacacagctgtaactttgcctttgctttgcaaaaatgaaaaatgcagtagggatcatgctcaagtatttaccttcggtgttggaagagagctcctcctcataggccaggatgggaagatgtccagtgtagcaggaggcctagctgttgctgttgctgtagctgcagcagcagcagtggagaaggctgcaagaagatatcataggggaggaggagatcaagaaatgcatccaatcctgcaactgcaacatcagaaagctactaccagctgaagcactgcactgggatcacaaggggcaagtggggcccatgtggcagtgaaaggtggactggaatttattccctttgaggagctaggagtactgcacagactgtgtgctttgctttgctgccatggcagggagctagccagagctggtactatagtactttggagaattgttgcactctagagagagagagagagagagatggtgatgatgatgaggagagtcacaaggcagtcacaccactacacacaaggtgacaagaagcacaactgccactcctgctatctgtagctcttgctttgcattgcatgtggtttggctagctacaaagtttttgctgttctttttttttttccaaatggatttgcatggttgcttttgactacactgccctaacctcttgggaaagttggctcactaggttgtgtgcttttgttcttggtcagagaaagagagagagagatgatgttgtgagtacgtacgagtggtgtgtccatggtgagaggtggtggtggttgcagtttgttgagccctcctcctgagtgtggcaacctgatgaacaagagcttcttctagctctccaaaataggcagcgccacctcctcctcctcctccttgctcgctgtcagtgtcaggccaatgcaaattaagaagggaaattaaaacatgtaacatgagatcaacaacttgttgggaataaatttgttgaccagaatgatctgaagaaatattcatgaagaacagtaatgagaaagcaatatgaaaagaacaagctgagaagagtgctgattcagcaaccgatgcatatagcactcttcccctgaacgtgaaagagaagctcatggttcagaacttcagatcatgtttatgttgcacagtttgcacttcgcaatcaccagagagagagagagagagagagagagagagagagagatattgggagagaaggagacagaaagatgaaaacgagatgttgggagagaaggagagagaggatgatgatgaactgatcttacaagaggtttgcagaagccatggagttgggcaaggtggtgccatggaagccatagccaagaacatgatgaggattctgccctctcctagcctctcccatcctacgagccacaaaaccacagctcgatctctcaggggctgcaggaatta

SEQ ID NO: 8649 - DNA, 4753 bp, Oryza sativa
cctgcagcccggtataggtcttgtctctacttgaaggtgttttgtcatggagtctgccacaggaatccctggctctgcactgcttatcatcttgaaactgacttctctttctctctgtgtgactggtcccagatgcactgcagatgcaagtctaatttcttctggttcatgcatgtgtaaaccttattttgccccagataatgaatgggatgttgaatttgggttcaagttgtattgatcagtaccactattttttttcaattgttaatggctgttgacaaaacttgcaagttactatgcactggtgtaggaagtacatgatcctgtttgcaaagaaaaaatgattgagattaaccatgttgctactggattgttcaatattacaagctatgtatgttattcagacttcaacggtgcatgcatttcatctgattattccatactctcttcgattcaagattgactaatttacaccgacatatagtttattatatgcaaaaccatagctttcggatagcatttagaaatgttaaccattctgaccacacaataatcctacgttgataaacgcttctctcaccagtctcatgatttgtatgtacgatcttatctagttatagctctctagcaacttgattgcaactttgaataatctatttctcatttcaaatcgaagataaaataattgaactatcgaatcattaacatcaatagtaccgtacaagataaaactgaaaagaggaatagaaaaccaaacctttaaagaaatctttaggttctaaaaaaaataagtatagaactctctatattctccattattaatatatatcctgcatttaatttgcttggcaatattctcctctgttaatgcgtcaacatccgtgccttgtcaaaatatcacctagctaaacccatacctgaccaatcatatccatttcacaatacgaagatcggctaacttaatcaatttggaagttgattgtcacgtctaatatatcaatgacgctagtttaattgatttcctaatacgctcacctatatatatactttttaagtttttgttacgatatgtataattaagagcaactccaatagaatggccaagtaactacccaagctaaattttagcaaatatagggggaaaataccattcaacagtctctccatccggatggccaaatcgcacccctcattgaccaaacttggagagtctctctgcctggctattcgtgggctccacactcccctcccaccccatctctctctctgccctggctagagcaagaaggcggcaacgatgccgcttgtgaacggcgatggctaggaaccgcacaacggcgacggcacggaggagagatgcgccggagccagctgcgaccgccgccgtcgtccgcgtcgtcccatgcagcgactgtcgccgtcgtccacgccgtccctagtcgcgaccgccaccgccgtccgcgccatccctagccgcgaccgccgcccccgcgtggatttgaccgggcggcgtggattcgggggctgttgccatggtcgtcgtcgtcacgagccgccgccgctgccaccctttgctcaatcgccgttgcctcggggagtgctaagagaagaggaagagggagaaaaagaggaataaggggagaaagatgagaaagaatgggtatagagagatggatggagaggctgttggagtaaagaacgaatttgacttgacaaataaaatggagagttgaccaaatagacatttagagagtcgaatttagagaaactattggagatgctctaagctagctttattaatagtacgtttcataatgattacctctttaattggaccgaggctcctgtgattgatgtaccagctgtgactaccacagctgcatgcttatgcgtgtaagtgatgcactccctccgttccataatataaaggattttggtgggatgagacatatcctattactaatttgggcagagatacaacgaatatgattatagagtgtatttattgcactaggatgtgatgtattctagtaagcgaggttagtttttttgatggaggaattagctacatgctgcctatgaattttaaattttgattttgagaataattttaggcaacgacagcggcagaggaaaacctaaaacttaaaatcaaatcctataatgacgcagtgctaagtactccgtacacccttattcaaggttgactgcctactgttatttgactatttgttattaattgttactacaaattttgggtgaaaatatacaagaaagtagatatattttgttttcttgacaatgcatatgtatatatcaaattatacatcaccaactttatcacaatttattatcattactattgcatatttactacaattcacacatatatctagatctatcgtaatactctaccaattattttcatcatatcaaatttcatctaaaattacttctatatattttcgtagcaacacgcgtggtatcttcttgtatttttaatggtgagtaggagctagttgggatgagtgcaatgtccctttcattttgcacttggaggaaaaaatcaattaagtaaattaactacttcatgctccgcctagccgccaatcaaacagatttatttctcctcttcacccactatatttttcctaacaatgattggcacaataaaatgcgccaaaaacacatgacaagatcgagaacctactaatagctaggagtaagataactgaataattcattcttatttttcttttttgatctgctaattgacacacatcttatagctagtcatcaagtggcaacttcgggggcatgcctaataagacaaaaatagaaatagtagttgaactcctatataaactttggtttttatttatgagaaaattgattttggtggttagtgtctagctagcttctatggattgtataattagctgtggtcttatattagactagtggtttaattaattatggcacatgcatttggggctgaaaatttattgaacaggtagagtgcacgcatcatgcatgcatgcgcgtgacaaaatgattatgtcattcattctgctagctaagctagctggaaacctcaaacacatactcggtcagtcccaaatctcaatatacttattgttgtaggttatttaaatatagattaagatttgtttgaaaaagactataccgtttattattaaatgatgtatatatggtcgaaagtgagagggttgttaggggtagaatggcaggaggtgattgatttagtaaattatattttagagtaacaactattttaagataaattttaaatcttgaaagtgcatctaggcaactaattatgttggtgattaataacaatgtgattagagatgactaacaacttatttgagtatgagtgaatgaatgttagcatcggtgaaaaacgatgttaaaggcaaaacctctaggcctcaatgaccttgcaaatctcgaaatacaactattatgtcgcggagatagtattctactaatataagattatatatatgaaatttttttcaagaaatacattgacaaacattcaatttcaagaaatatcatcgataagtacgacttttataaaatgccactgtacaagcgactttgtctcggaaataccatcatcgttagggtttcgttagtagtcctccgttaagtattataggataaacggtgcatttaacaatggggatggacggaaccttaacagcaatgatatttatagaacaaaatcgcttgcactcgtcgatgatggctttgattgtttgttaatggtatttctggatgttctctatatgtatgggctcattgataacggcactatatgagtgacaatgagaaacagcgtgagcgaatctgtatgagatgacgtacgcgatattcatatacaggcattgatacaaacttctacacagtagctagtgttgctgaatatagcttggtcgtgtactccctccgtcccaaattaagtacaataaattttggttagatggaacataactataaatctaaacatattttttcagactcatattactagaatgtgtccaatcaaaatcttatatattttagtacgaagggagtagaccgtatgttgcgtccactgtatgttacatgtcgcccactgaattaaatatgaaactctgaaatattcaaagacgtcatcgggaagtgtgttgtaagtcagaaattattttgagctggggaatattagtttaatttcatttgcctctgatataatttgtaaggtgttttcaattttgttcaacgttatacttctctactttcatattagtgggccgggtgctttagcttaaactgtcacggagatataaaagcctatcttaatttttttttgacgagaaaaaacagcaagagaggctactactgtgattttaataagagaaagggaataattacagagagtatgtacatgagggggaaggaaagaacaacaaaactaaactaatcaagctaaacaagaaactgaatccatgattcccacgaaggtttatcatcctgttttactctatgcaaatgtagagtaaagtcctccttgaaatctgatttccacttgctgaaattgattgaaagattgttgaagataaagtcatttctcctgctctagatattccagcaacaaatagcaatgacctccatgaagaaagggataaggaaagtggtcctttgcttctgagatcgtgttcataacatccagatgaaaatttcagtt

SEQ ID NO: 8650 - DNA, 3271 bp, Oryza sativa
acatgtgtggattaaaatttctttcataaatcttatactactaattactctctccgtcccaaaaaataagtacttttggaccttgacatagtctccaagatgctactttgatcaataatatagatattttaaataaaaagagttgtatattataatattttgtttaataataaatctagtaacatcaattttacattattgaacttttttattattttgctattaatagtcaaattaaaaatatttgatttgtcactatgctaaaaatgtttatattttgggacggagggagtagattttataaactcgtcctaacaaaaaagtgtgatcaacgtcgcaccgtacagacccaaaaaaactgatattcgcaactcttcactatatatactgtgtacctatgtgcaggcttgcaggagctgccatggttgtgccaattatcaactactggtggccttcattcccagctgagctatccaggcaagccttcaagaggctcatcgtgccagagcagaggacactctggattgcacacaacatgccatctttgctctaccagtggatgacccaaaagtggctcccttcttctgcggcagccatgcgccaccctgaaatattcagcaagcatgatttggaggttcttcagaagatgatggcaatgcctctcattgaggtaaaatcagattgtttaacccttatgaaccaccacttatgcgtttttaagaatggttttgaatgaattttgcattattatagtagatttcaaaaaatcgcttgatttacactaatgtggtccagtttgggtacatgaaaaaaaaaatcaagaagagaaaataaactgaaaagtggaacatgttatatgcaaattaacctaaaataatactatcgcaaaccataaataccactatcggtttagatttgtttttttaaagagcaattgtttggaatgttgacatatatatatcactgattgcttcttgatttttcagaataaatctaggcagcaaggcatttatgaatcaacacatcgtgatttgcttgttgcttttggaaagtgggagtttgatccaatgaatattaccaatccatttcctcaaaatgagggttctgtacacatctggcaaggttatgaagacaggttggtgctggttgagctgcaacggtacattgcccagaggcttccttggatccagtatcatgaattccctgaaggaggacacatgttcatgctggtagatggatggactgacaaaatcatcagagcgctcttggttggagaacagctctgaagtctcatcaaatcattctgtgcttgtagcttatcatcgatagccaaaagttaaaatttcaaacttattaattctagagttgattttacattttctatatgatactcgctctgtttcattttcatcttaacttttttcttattcaaacttttttaagtttgatcaaatttataaaaaaaattaacaatatttacaacatcaaattaatttcattaaatgaaacattgaatatattttgataaatatgtttattttgaattaaaattgttgctgcatttttatataaatttggtcaaacttaaaaggtttgagaaaaagagtcaaagcgacttataatatgaaacggagggagtagtgtattttgtagaattggtttttaagtcgtaaataagttttacctataaattatttttactactttatttatttttttttatagatcgtcagccatcgctcaaacgattcgacactcgagggtaaaatttacttaaaaaaatgtacacaaagggtaacattacacgcatttatatagtcaactatattttgcagttttagtaaaacttggagtaatccaaactggagctagtggccaattcagccacggctgaggatactccacatcgatcgcagtgtcattcgtataatcataaactccaacgtcccgacgaagatgtttacggtgaaccaagtacccgtagtcatcgtcgaaatatatgtgatttggcatcaagtgtggataatccttcactggcaagcacatcgagtaactagtgccaataaacaatgcattgttacctatgtcatcgacgtcatcaagatcttgcttcttgtagtcaaccttgtacaccccgatttcagttgttcgtacgtccttatgctcgctaccttcatcttcttccgtgactcgcaagacctgcaggatgtcaccttccgtggtacgtacaatgtagagggtgcccaattcacccatggtcggcttgagaatcagtctatgggtgaaggaggaagaagcactgacgacatcaatggcgtggatggcgccgtgaacggtctgggcgtagaacacgccgtcgtggtagatgcaatcttcgaaccactcacactcattgttccccatcttgatccatgtccacttcttgtcgccggatctcgcgaaggagagctgaagatatgggtgatggatgagcatcaccgtgtagtcgtcgccgcgcgatgggtcggaggagatgacggctttgagatacaagaactccctgaacgtctccggcgggtgcgtcaccgtgtgcatgtcatcgtcgttgctccggtgactgttgccgccgccgtcgtagtagaccaacttgtagttgttgaggttcccggcgtcgtcgtagagtggccttacgtgttcgatggtggcgacgggtgggaggtcgagctgctcgcctgtggccgggttgaggaggtggagctcggagcggtggtcggcggtgacgagccagccgtgggatgacccgacgatgtggcgctccgcgatgggcgggtccgggagggggaccgtgtaggacgtcgtcttgtcggcgaggctgtagagcacggcggcgcgcgggccggcggcggcggtggtgtagaggaggcagggcgtctgcgcgcgggagtagaggccgaggcggcgtatgtcgcgggcggtggcgcgccagagcttgcagacggcggcggagcggaacaggtcggggaactcgagctcgaggaggacgaggccgagcacgtcggccggaagctccgaccagtcggcggccgccggagtgtccatggaaacagatcgattaagcgtcgatgaaggcgtacgtacgtgccgcgtgccgccagatcatccgctaaaataaagcagcgcaactgatcgacgcggatcagatcggagtagaaaccgaacaggtttcagaaatctctatctctatctcttccctatctctactctctatctctatctcctctccactacctaa

SEQ ID NO: 8651 - DNA, 9250 bp, Oryza sativa
  unsure (1)..(9250): unsure at all n locations
aagaagctacgtgagacttacccagacaaacaaggctgctaacgacaaacatttgggggttgataggcttccacgcagacagtgtagagtgcatctgcctcatagataacaaaagaaggtcattgaaaacagtaggataagaatctcagcaagccaagcctttatgtttcgtagtgtaacatcaaatctagcaatcaagaatgaatttgtattttactccttccgtcccaaaaagaatcaacttagtataacctatcctaggacaatgaatctggacaagtgtttgtccagattcattgattcttgttgggacagagggagtaggtgaacggcatcactccagaaggattatagtccctttccttttctttttttttctcattttatccacaattgcatacctcctaaaagtgggaaattttatctacatgtttcttttcggtaaggtatttgtggctatttgcagctccatccccaaaacccatctgtcaatttattggccaaaaaactaaaaaataaatttgtataatagctcatctgtttttctttagaaaagtatagaaattacatgacaatttgatagtgtgcaaaaattctgcagactgcattgtcatgcaggccttacatatagggtcatgagccccttttcccaccactataacataaattcagcaacataatcttcagagatctccttgcctgaagtgtcttatgtttcataaagaaataacataggtagtgatctatgatactccctctgtttttctttaatgataatttagaatgattgcaatctatcctagtaagatttagattatgctacaataaaaaaagggtaattggatttgtcatgtaaaatggtattaataggactgataattaaaaacctgtcatatcaatatattactaacatatagtgagataaattaatggtcaagtttgtgtccagagttgatatccaaaataacaagaaaaataaaattactttaaaaacatttaatttcaatcaaataaaaaagtaagtgttttcttaatcttcaggacatgcatataaaattataaataatcaaaagaaggcctggaatagaggaatatgtataaataagatcaaacaaatatgcacattcatacatatcttatgattctggtggaaaattctatcatatatccctacaagtctacaacttgaaagaagacagcatgcttcttgccactataaatagaggctcatcactctacaatgcccaataagcaaccaagggcacattgaagtgcactaggttttgtcatttacaactagccagagcactaatttcggaaaatataattacctgtccctccaaggctccaaccatgtctaggtctgtggagcctcttgttgttgggcgggtgatcggagaagttattgattcattcaacccatgtacgaagatgatagtaacctacaattcaaacaagcttgtctttaatggccatgagttctacccatcagcagttgtatctaaaccaagagtcgaggtccaagggggtgatatgcgttctttcttcacattggtacggactggtctaactctatcctgggagttccatagttagctttcagtgcatttcatactctcccccccccccccctattaaccataactcggaatgcttcaggttatgacagacccagatgtgccaggaccaagtgatccatatctaagggaacacctacattggtaaccttcaacacttcttatccaaaatctatacatttgtgtccaattggtgattattgattcactataaaatttatgtttctgatggagatggcactagtagtctaataccacatatttttcttgttttcatacaaaacatcatatttctaataagaaaaatatttcttccaaaaaacaatatatttctgaacagataatgaccatggtgtggccaaatcattaaattttacccttaatatttatgcaggattgtaactgatatacctggaacaacggatgcctcttttggtaggtcctctccctaacctgcattagatcattccatgcttgcatgtatttgttcttaatatgcatctttctggcatttgaattgcaggacgggaaatcataagctatgagagcccaaagcccagcattggtatccacaggttcgtttttgtgctcttcaagcagaagcgtaggcaggctgtagttgtgccatcctctagggatcatttcaatacacgccagtttgctgaggagaacgaacttggccttcctgtcgctgctgtctacttcaatgctcagagagagactgctgccaggagacgctaaaaaattccagctgtcattatccccgctgtgataaataaaaaccatccaatagtttctcctgtcgtctacattatctgccacatcactagattgtggatcaaggcttcatcattacgtcatttgcctcaagaaaatctacaataaaccaaatgcatttgacagattgtatcagtgtcagattgtttcccgtatcaaaaattaagtaatggattgtttttgtaagaagattgagagtcatgataaataccagtgcattcacatgcaaatattagcaatctataactgatacaggggctagctggcaaaaaaagctttatccaccaaatgcactttctggctccacaagatgtgcacttttgttgacacgcgatctgctggacatgaagtttgttagatcttgttgtgtcaccttgtagaaggacaaacaaagaccctcctgaccctctaactgtattgcaccagcgccgctagcctgctaccacattcctaaaaacatgacataaaagggatgtacccattgtatccagaggaacacccatatgaaattgtcggtgatccagaggaacatccaaacggccggcaataatccattctgtagcatgtacacattcttgcaaaaaatctgactatcaggctatgagctctcctccactatttccccttttcccattgaatcacaacatttccctctaagaacttgattctagatgaatatcatttcataaatctcaacctccctagaaatcggattggattcggatctaatcccaatttacacaaacaagtgtacccccattgctaatcaggctgtaccccattagcacaacatgatgagaaatttgaagcatactcgtgtaatctgctggaaatcccaaatctcctgcgcagaaacagtcggaccagcagcagagtagcagagagcgcaggtgcagcaaacagaatgatgcggtaacaatgaactgtaaaatcagatggggatgggttggccgaggccgaggccgagagaatcctcacccgcttcacctggctcgccgtggaagtcgtcccgggccggcggagacgatcaccgtgtggtcatctacaggggatatcccgccgccgcgggcggcggcgtgctcgccgaggagaggggccgtggccgcgacggcgaggtggccgtacaccgtacttattcaacaagcggagcgtatgtctaccagtagtaggcttgggccgcacattgtaaaagtaaatttgcaattgaggcctcatttggttcggccctcaaatgtatatgggccaaaatttcggcctatacagagaaggcctaagtgggcttcttttgtgggcatccgattcaactggccacatatggaccagtcaaccaccgcacattctcttctcttgacctgaatggtcaatcacgctctaaactggcggttaccacaaaaagatactaacttaaattaagtttaattttaaatttacatttagaataattttgtacaattgccgggcaaagcttgaagtaacagacataaattttgtccagtaaaatcacaaatgcccttaattccaaacaactgaaaattttgcacaatttgataagattggtaccatatctaagctgggatggattctaatagctcgagtggaagtacacctgtttattgcatgtcaactaaatggctacgaaaaattttcaaaaaaattggtaagatagatcaatatgtaatatatcactccacaaacatgcaagttaaaattcaatttctacaagttgtaacaaaaataacaaatttaactgtaaatatacatatagtaatttgagttttgtttgttatttttgttacaatctgtagaagttgaattttaaattgtatgtttgtggattgatacattacatattgatctatcttattcatatttttttaattttttttataaccatttagatgacatgcaataaacgggtggacatccactcgagctgttaaaatagtttccctatctaagctagctagtacaaaatttcaatcccagaaactcaatctgtacatcggctatatatacacgtcaaatttcatctctctttcttgcccctttgaatcagtagaacatattcgttcatcagtatcgctgaaaatttgccaagctttggaatcttgagaaggagaacctcgcagagttattgctgttgtggcggccaatacgcgtcctgccaccgccgccggacgtgaagaagaacctcctccacctccagctagcgtcgtcgtcgtcgtcgtcgccgcacccaccgccgccgtggtagcggcggccaacgggatacgacgagacgacgacgaagctgctgctcgccgtcaccggcaccgccctgctgaccgagctcaccggcagcaggcagttggctaggagcgcgtcaccgccgtcttcttcgtcgtcgtcgtcggcggcggcggctgcggcggcgacagcgacgcaacagctgctcgtcacgaggcgcttggtgtagtactcttcgccgtcacggtggtcgatgagggcgatgtcgagctcgaacagctcgtcgtcttcgtcttcgtcatcgtcgtcagtcacgatcatcccaatattcttgtcgtcctcgccgccggcgttgagctgctgccgctctccggcggtgacggcggcggccgtggtgatttcatggtgggtcgttgcggcgtttgcttctacggctgccattgcgaaatgtgaaatggtaatcttggtggtgcgatttcgatcggttgggtacgtgcaatgcagtgcagtgcagtgtaggtgtatatatgctttgcggtttgcacgcgtatagacgtggtagagagagtcggggacttgatggtggttgggttgatatgtctgtctcgatgtcttctttttctttttcttctttttttgttagattttgttggtgcagattgttgggaaatgacgtaggggacatggtaggttgcccagtaggctgcctacttagtaaacgtgatactatcttttatcaattcagagtttcagacctttcagaaaaacaaattcagagtttcagaccatctaataagtcgtattactagtagaaacagcacagttagctggaaatttcgcagctcattggaaatttgtttagatctattatttaattacaaaggaaaaacagagaccaccacgactcactttgaaatactacctccgtttcaggttataagactttctagcattgtccacattcatatagatattaataaatctagacacattaatatctatgtaaatatgggcaattctaggaagtcttataatataaaacggaggaagtagtagagattgtccgttaagtagaaggattatgtaggatcaaaacacaagaactaagacaaccagagggggggtgaatggttggtatacctaaaaaccgaaaacttttagcggaaataaaagttaccctcgaaatcgacggaagtcggtctgaccgagattgatcgtcagtctgaccgtgtggatgccgccggtctgaccgccgatgtcacctgccgcgcctgtcgccgccgccggtctgatcgcccgtatgccgccggtctgaccgccggtatatcgccggttggactgccgaaactcggtgaaacacaaatcgaagaactcttaaagtggatgacgactttattgattatctctgtatttacaaagtgcaccaacagcactccttacaaaaatttcgactaaactcgaaaccctaactcaaaactcaactcaattgctctcaaaagcgataccgggaagcctcacgctccccctctatttatacatgaggtaggcagcctacagccacgaaccaaactcatactaggagtcttaaacaccttagaaaaccctctagtacaagacacaaactttacataaccaatcgtaccaaatttggactccttccaaattcgactccgcatcccatacgcacacaatacctccattgtatgccatatggaatctccaccaaccacgtgcatcaactctagcctaagtatctcgcatgatctctgaccaccacggacgtcgtcttatccccaagccgactcccggtccatcaccgtaaatactctcccgaggcatcgagtcacctacacatgaaataaacaaagtaaccatattctgagaccaagctatctccaacttgactcattagtagcaaaccacagtattacatacgtatagttcccatttagaggccataatcataaaatattcacagatatccaaataaccaacccgaaaccgaaacggacatagcgtcggccggtcagaccgcgggctggccagtccgaccgcttgatcaccgccggtttgaccggcatacacagcccggtctgaccggtcacataaaataacgaacntacgattcacctgtaaatccaatcatctccaaaaccacttcgtaaataaatttccaaataacaaaaccaataatctccaatgcccaattgttcatcacagaataataatcaaaaacacatttgattttacaatctcccccttgatgaacacattggcaaatccatcaaaaatgttttggtgtttgaaaaataaaaacaaaattggtaaaaagcacacttcgtacaaaagtacacatcgtgctcgaaaatccagaagaaaacttctccccctttttaaaagaaagaaattccctcatgaacccaaaaaaaaacatgctcttctcaacaactcgtcaaaaattcaccttgcttctccaaaaatccaaaaattttcacattacttctcctccttttgacaatgatttcatcaagcataggaattatgtttattaatattcaagggcttagcatacatatatatcaagtcatgtgttgcaataaaaagaagataaatccatctataatataacaagcatgcattaaagtataaccatgaaccaaagattttacaattaagcttgaatcaacaatcaaaattcatgatttcatacgatttataatgcaacatcttaacaagcacataggttgaagaataaacactaaactcatacacctattgcatttatcactctttctcaaataacctttagcacaaaataaccaagagaattttttttaacttttctttttcttgagcctttttgctcatatttttctcttttattccaggtacgtccctgtcgtcaagactgtttctagagattcggcacccattatttttctcacatcgaatacatccctgtcgtcaagactgtttccaaggattcggtattcatttttttcatatttttattctctttttcacaatgagcaattaaagctatttgaggaataacaagtcaataaagcatatatatatagagcatttacaaatcaaaccatatgctagcatcaacattgcatatttacttaattcaagtatagaatttaagtgtcatgcatcatctcccttaaaagtaaaatctaaatctcatgaaaagattagaatacagacaagctatgctagagacaaataaaccttcatagtattgctagcatgcacaagaaaataccatatgtataaacaaagctctcttttctcaatttttcattgtcatattattacttgataaaaccatgaggtacaaactccccctcaaaccatgccaaaaggatgaattatgcccaattcaccacaaagaaaagcaaaacgattagaatccaaaggtttagtgaaaatatcagcaatttgcaactttgtgtctaaaaactgcaattcaacatctcccttctcaacatgatccctcaaaaagtgaaaatgaatatcaatgtgctttgtgcgtgaaagttgaacatgattcttagcaatattgataacactagtattatcacaaaagagaggtactttatcaaaagtaagaccataatctttcaaagtagataaaagccaaagaatctgagaacaacaactagcagcagcaacatattcagattcagcagttgattgggcaacactagattgtttcctagaagaccatgcaatcaatgatgtaccaagaaaatgacatgttccactagtacttttcctatcaattctacaacccccaaaatcagcatcagaatatccacttaagcatatagaacatgaagtggaataccaaattccaaactcaagtgtatgattcaaataccacattattcgcttgactgcttgacgatgtgaagcacgaggagaagcttgaaagcgtgcacacaaacacacaacaaattgtatgtctggcctagaagcagttagatacaacaaagatccaatcatacttctatattcctgttgatcaacagcttctccatcttcatcaggatccaacacagctgtagaaccaattggtgttgaaattggcttgtaattctccatcttgaaccgtctcaaaatatccttcgtatacttcgtttgatgcacaaaaataccttgaggtgtttgcttaatttgcaatcccaaaaagtacaataactcacccatcatgctcatctcaaattccctgtgcatagtctcaacaaaatctacaaccaaagcgtgagtcgaacaaccaaagatgatatcatccacataaatctgaacgaaaagttgattatcagcatgcttaagaacaaaaagcgttttgtcaacctttcccattgaaaaacctttcgcaagcaaaaagttcttaagcctatcataccatgccctaggagcttgtttcaaaccatacaaagctttagataatttataaacatggttgggaaaatcaggattttcaaaacctggtggttgtttgacataaacttcctcctatataaaaccatttagaaaagaacttttcacatccatttgatacaatttaaaaccttttgaagcagcaaaagccaacaaaagtctaattgtctcaattctagcaaaaggagcaaaagtttcatcaaaatccaaaccctcaa

SEQ ID NO: 8652 - DNA, 30175 bp, Oryza sativa
  unsure (1)..(30175): unsure at all n locations
ttaccaatgatttgttccggcggatgtcgtctttaaatgtgcaaaggagcagtgacttctgaagttgatccatgttctgtatcagtactggtcgaagttgtaatctctagaggaccatctcaaacagcatcaacagaaccctcagccgacgaccctggccggtctgaccgcacctcctatgccggtctaaccggaggtgtgccggcggtctgaccggcctggcgcccggtctaaccggccgagccgaccttgtcgttgtcgttgtcgttgctctcgtcttcaaaaatacaatcatcctccccctgaacctgtgacagtgtacctgcaatatcgggtctagtacctggactagcctcatcaaaagaaactttgcaagtctcaacaattttgttagtctccaaaataagtacatgatagccacgagtatgtgcggggtaaccaagaaacaatccatcggtagaatgtgcctcaaacttatccaaatttccagatttcaagacaaagcacttgcaaccaaaaaacacgcaaatgtgaaactttgggttgatgtccaaatcgaagttcataagaagtttttccagtttttattttaaaaaaactgatttgaaattttaccaaccagtgttattcgcttaagcccaaaattttttagaagtttattttcattcaacatcgttctagccattttaaccaaaacacgatttttcctttcaacacccccgttctgttgaggaacacgaggagaagaaaattcatgttcaagacctctttcgttgcaaaattgttcaaaagaagcatttttaaactcaccaccattatcacttcgaattcttttcaaagaaccaggaaattcaagatcaatcgaagaaacaaaccacgaaaggttgaaaagcttcgtccttagttgccataaagaaaatccaagaatatcgagaaaaatcatcaataataatcaacatataccactttcctccaacggattgcactctagctggaccaacaatgtccatatgtaatagttgtcccggtgcatccatcatcacagaaacaataggagtatgtgaagaagcaaccatcttagcatgacgacacggtttcaaaccaaatcaagatctttcttaagtttaggcaaaccaggaacaagatccaaaccacttaacctagtgagatgatcaaaaccaacatgtccatgtctacatgccaaaacatcacatatttatcaaacttagcaaccaaacatgttatcacaggtgaaacaggattttcaaaatcagctttaaacactcttccatagcgagaaatattcaacacagaatcaccacaagaatcaaaaactttacttccagttttcttaaagtgaacctcaaaattttcatcaacaatttgtgaaaccgaaagcaaattgtactttaagtcctcaaccaaagctacattcttcaattcaaattttttatttaccttaaccaaacctgtagcgagaacgacacttgtagaagcatcaccaaagataatcgattcagtcttggatgccttcttgagtgaggagaaccaatttttatcaccggtcatgtgccgcgaacaaccggaatccactatccacacgttctccttccttgccaccaaagcctacacataagcagaagtcgaagcctcagtactggggttagatgataataaaaatttaggaatccagtactgagacacacgatcagagatccaataggcatataaccacatgcaaaatcaattttagaattttcagaaaaattcctctgaggccggtttgaccgactcccggtcagaccggccactgtgccgccggtctgactggtgcctggtctgaccgacgctcagtagccggtctgaccggtcgctggtctgactgcgggacccactgcggtctgactggtttcctcgaaggaaaatccgatttttgccaccttgattttgcaaaagcaatctctctctcctttttctgtttatgagctaatatgaaacaaaaaccaacaatatgtccatctttcccacaaaaagaacaagtatatttttcatgatgattagacacattggtagcattagaagatttagcaacacaagcaacaacaggagatttggcatgcacaacattggattttgaagaagatgcacccatagtagacatgataccagcagatttaaacacaattttattagtatcaggtttaacaaaaatctcaccacttctagcatcaacacctaacacaataggagatgtctagaattatgagcataaggattaaaacctaaaccacggttatgtgtgctaacctttgattgatccaaaatcatgttgaagttctttttaccacagaaaatcttaacaaggaatttttcaaataagaaacctccttttccaaattagcacaattttcacaatctaccataacacatttgcttttacgacatttagggcaagaaagcacttcattgtttttcacaacatcttccatgaactcaacacgacctaaaacatctttcaatttcaacttattcaaattacatgttgagcaatccaaaacatcatgaggttgttttaactttttagcagaaatcatgttaaacatcaaactaacatgaaaagcaatttgatatttttgcaacaactttttagttaaaaacaactcatccaaagtgcgtgtgtgcaaagcaaaactgcaagcaagagaagatctatttttcaaatcatgtgcagcattaacatctctaatttttgaaatctcattcattaaaacctcacaatttgagcaataatcatcattaggaataagagattttaatctagcaatttcagatttaagagattcaatgataaattcctgttttctatacatcttctcacacttcttttttttcactcaaaatattaatagcttcttcaaaagcacttacctcattatcttcatactctgtgtcagattcaccacgtgccatgaagcaaacatcggagatgttctttcccttatcatcatctccacttccaccatctacatcacttagtggctcaaaggcggcacaaacttgttgaaaagccttcctaagattctccagcatcctcccttgggatgaacccttcggcttgttgttgttggtcttctcaccatctttgtcttatcttttgcctctcccaagcttaggacaatgcgaacgaagatgatcaattgaaccacattcaaagcaacgatttggaccacctcttttcctgttcctggcattattcatagctcaagcaactctgttagcaaccaaagccaaatcctcctcctcgatctgttcgagttgatcatcggatgtggcattaaaaacagcaagaaaagaaggcttagatgaagaagcatcaatatccaaagaagaagaatacgaagaaatcaaagcacttgacttagaatcaacttatcgagaaagaacattcatctcatgtgttttcaattttgtgtaaagtgaatccaaagtcaaagtagtcatagactcctgaatagacgtaactttcatctcccaaatagacatgtcaagaccattcaaaaagtgacaagaaatctcagattgtggataattagtatcataagaagaatcaatagatctaagatcactcaaaattttattaaacctagagagatatcatccaaagcttctccaggtttcatctcaaatttaatgtactcctttttgaaaatatcacgacgaagttctttaatgttatttgttccttgatgaaagttactcaaagcattccaaattttatgagcagttcgaaagtgcgcaacacgatcataatcagaacgagaaatagcactcaaaagaatgttgcgtgctttgcaattttgttcaaaagcagttttttcagccgcagtattaatagcttcaggaatcacataaggatgagaaacttttctctaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaagaaaacaaggctctgataccacttgtaggatcgaaaaacaagaactaagccaaccaaagggggggtgaatggttggtatacccaaaaaaccgaaaacttttagcggaaataaaagttaccctcgaaatcgacaaaagtcggtctgaccgagattgatctaacggtttgaccgtgtggatgtcgccggtctgaccggtatagatcacccggtctgaccgccgatgtcacctgccgcgcctatcgcgggccgccggtctgaccgcccgtatgcctccggtctgaccgccgcttgctgtcggtctgaccgccggtatatcaccggttggactgccgaaactcggtgaaacacaaatcgaagaactcttaaagtggatgacgactttattgattatctctgtatttacaaagtgcaccaacagcactccttacaaaaatttcgactaaactcgaaaccctaactcaaaactaaactcaattgctctcaaaagcgataccgggaagcctcacgctccccctctatttatacatgaggtaggcagcctacaaccacgaaccaaactcatactaggagtcctaaacaccttagaaaaccctctagtacaagacacaaactttacataaccaatcgtaccaaatttggactccttccaaattcgactccgcatcccatacgcacacaatacctccatcgtatgccatatggaatctccaccaaccacgtgcatcaactctagcctaagtatctcgcatgatctctgaccaccacagacgtcgtcttatccccaagccgactcccggtccatcaccgcaaatactctcccgaggcatcgagtcacctacacatgaaataaacaaagaaaccatattccgagaccaagctatctccaacttgactcattagtagcaaacaacagtattatatatgtatagtatccatctagaagccataatcatgaattaatcacagatatccaaataaacaacccgaaaccgaaaccgacacagcgtcggccggttagatcgcgggctggccggtctgaccgctcgatcaccgccggtctgaccggcatacacagcccggtctgaccggtcacataaaataacgaacctacgattcacctgtaaatccaatcatctccaaaaccacttcataaataaattccaaataacaaaaccaataatctccaatgcccaattgtttatcacagaataataatcaaaaacacctttaattttacagattatacaataaaatgttttgtagaaacatcattgaccaatatagaaatggtgggttcgctcaagaaatagaaattatttgtatattgaacaggattctgtgtgtgtgtatgtatgtatgtatatatatatatatatatatatatatatatatatatatatatatatatatatatatatatatatatatatatatatatactccctccgtttcgaaatgtttgacaccgttgactttttagcacatatttgaccgttcttcttatttaaaaacttttgtgagatatgtagggcctgttcactgtgctgccattttcaaccttaccaaattttggtaaagttgccaaaaaaaaagtggctatatttagtttgctaccaaattttggtaactatataagaaatcaggtcaaagtgaacaggccctttatatagagctagctagattgtactccctccgtttcgaaatgtttcgacgccgttgacttaaaatcattccgattattttctcgtaagctgcggcatatttttttttataggagtagaatgcatggttggctctaggttataaaggctctaatcgatttgagcaagaattatcagccgtagaaaaaaagaaaaattatttgcgaataaagctttttatattagatgtgttatttacctatttacttatggtttcaacgttaaaaatttaagactgaaaaatacgcgctgaaaaaaaaagcataaaattgactccaaaacactttttaattttaaattttgtccacggcacattcgtaatcgattatgtgatctggtcgacgggacggggatggaccagccgtccgagagctcataagtccatcctcaatcacgggaaatcggtatagtcgtttactctgatttggaaacatcattggtatgaacaaacttttatcacacatacttcatcccattttgacttatggatttttatatccaacgtcttatttgatttttttttataattaatatttttttattataagatgataaaatatgaatagcattttatgcatgactttttttaaaaaaagaaattcataaatctttaaattagacgaacgatcaaattgataaggaaaatgaaacccacagctacactaaaaatagacggtgggagtattatccaggacaacttatggaaaacggtactggtacgaattaatatatgctgttagtagctaggagcacaaattaagctttgattgagtgttactactcctacatcacactgctaattaagtctgacccaaaatgccgccagctgtccgcactccacactggtcatgagcgtctgatcagtgatcagtccgtaccaagttgtactaaaaacaaaaggtgtactgctgctaatcaagccaaaacacggtgcaagctaaatactctactcctatgcgtcatctggttaagctacttcaccaacttgctgctactaacttagagtaattacagaaactaatcattaattaattaagcatgaactccttgcactaatgcatgcagcatgcatgcaatgcatcactttggctgctgcttgccgggcttgagggtggacgacgcgccggcgccggccgcggaggcggcggtgggtggccggtgctgggtcgtcgtcgacgtcgaggaggcggcggcgtggttggtgttgagcttggcgaggagggccttgttctcctggttgagtgcctgcgccttcctccgcagccgctcgttctcctccattatgtacacgttctccaggtacagcttcaggttcaccctctccatgccagtcgatctcgatctcctgcactcaaaaatgcccaatcaattaattcctagtcaactaattactagcatttgctgcatgctaagacatgactcaaacggtagctaactaagccatgcattcttgcatcgtcgtactaacagttacaaatgacgcaggatcatgcaaccaagaaatgtgcaagttgctgatgagaagatgatccatggaaaatggagcagtttcaactcgagacagataagaaacaccaagtagtccctcacctttgatctgaagatgctgctgagctagctagagagaaggaagaaggaagatagtactgggatagcaggtttggcagaggaagaagaggagattgttcttgagctgtgcagagcagtggtgttcgcgtagacggccgtctactgtatttatagccctcgtggagtatagtggctgtatgtactgtgtactgtatatctgctctgctctgcgggtcaatcacggcctgcagttcagagttgagaatgaaatcgcgatgaattgatgacgcacttctgcttcgctcaaagatacgcaatcattcctcttccaagttccaaagttgaaatggtactccagcttcttcttccttcccagtagagtctctctcgtgaatcatgatgtggtttgaactgtaatgacaaatcgttcaaatcaatttgacttcatttgactaaaatcaaatgatggaaatgcagagtactctgtccaaaaaagaagggagcagcagcagccagccagccagcagagaagcagtggcaaggcaactccaggatgtaaattgaggtgatgctagtgtaaaaaatataatataattaaaacaagtaaaggtatatcaactaaactattttccaatgaaaatgaaatgctcatatgatcaaaagaactttttctattttgatttgtggctatattaaaatgttcataagtatctgtgaatatattgttttgtatactcggaataaattatgttttatcaatttgggtagtagaatcagtgaggcagcttgcatccttgctatctaggaaatttcttcactaataacgccgtgtttattccaaagtaattcttcaaacttctaactttttcatcacatcaaaactttcctacacacacaaacttctaactttttcgtcacatcgttctaatttaaccaaacttccaattttggtatgaactaaacacccccaacttccaactttccatcatatcacatcacattcaaaacatccatacacacataaactcctaactttttttccaaactaccaacttttcccaaactttaaattttttttaggaactaaacacatccaactaattagacttgttaatgactataactaggaacagggattacacaccaaccagcctcaacagtggatccgccactgccgagaagtcgagaaggaacatttactcttgcactcgattatggcctactcgtagtagcagtgtggtgaagtcaagtctttgctctcatcatctgatctcgcaacggcagatctcttctcttgctgttccaaggcagcagctaatgatgatcagcattcaacctccacgtcttctcttcttccttccatcacttctgcttccaagcttcaattgctctctcgatgagcattattgcaagagctagcagagcagctatcatggcggcatggcgcatcacttcatacagatcacaccacgattcgatgtgaacaatgcatcatgcatgtcttatgagcacaccgattagtgcgagtacaaatcttgaattgtcggtgtgtagagagattttgggtcccggagaattgaatatgactagtagtagattctacagacattttaacatctgcactgagtgacatttgagaatttagcaattcccataaaacaatatgcatagcatacagaaatttgttcaaactactcaagatatggttccaatgaccgagcttttttgttggtttacatgaatcttgtagacttgtactccgtactgtactatactacttcatctgaatttctgatctgatggatgggcaagggatggatgcagcaggtcctactaccggcagaataatcttggattcgagatttggattcttggtctgatctgacatgttgaccttgtagcagcattgaactccatctgtatgactggatgtgtgtgtccgtcttgcattgcaatgtgcagcacagagatcatcatcatgacagagccaactgaagctggcgtcaggagttgcattttcgtaaagggagatctcatggcgcctatagatacgagcaccccatttctgtgagttgtgatcaagacttcctgctggtagttgatgattctgcatctcctctgacaacaacacaaatgcatcctttgcatgcattacttgagagtagttaagggtgtgtttagttcacgctaaaattagaagtttgattgaaattgaaatgatgtggcggaaaagttggaagtttgtgtatgtagaaaagttttgatgtggtggaaaagttggaagtttgaagaaaaagtttggaactaaaatcggcataaatagggcaattgaaatggatggattgattgatggtagcactcctattgagttttaattattaccaacttaaaaaatacatttgtaattattaccattagcaatttaaaaatcatgttaatgaaaaccgagataaaatctgtatcttaatcagaaaagagcatgatctaactaaatacaagaaggtaataccaaggataggtgcaattcccagtgaacaaaaacacattagctagtgatatacttttacgagcacgagcaagatcaacttgggataatggcaccgcatgtgtaaacttgtcagtactgaagaagaaacattgtgttacttaaacaatcttcagcagttagcagtctgatgattataaatcaagttgcagcagcagcagcagcagcagcttgtaaaggactggcaattttatctgaaagaaaaagggagaaaaggaatgggcaattggcaattggactagctgtttcttcctggattattgaccattttattagctttcggtcatctactagtactatactacaaccagaatattcccctagaagagattagcaaatcgacaacagaagcagataggagaccgcccaccaacccgaatatttactctcctttacttaaggaagaattaaacaaagacgtaatagttattagtagcatcagctactgatcattttcatacctaagcaagatctatcaccaccaaaaaaaaaatcattaacaagttcacaatcaataagcgcttccatgatcaacaagttcactgcaatggttcgaataaattcacaacaaaattgagctacatttctccttacaaagctcccaaatctgacacacatcttgtgtccgtatctcctcccattccccctgatttacaaattacaatgggattctacgtatcgaatatgaaatcagtttcaattttacaacaaaattcagcagcagctacacatacacccacgtcggggtcaccgtcaccagtgcaacctcaccggcggcacggtgaagccgtgggcgtcgtcgaggaagggcaccgccgccggccgcgcctggaggtcgccgtagaagtcgtactccgcctcgtagtcgtgcaggtccagctccttcttctggttggtgtggtaatggtgcttggcgccgggcgacttgccgaagccgaagaggctcacctcgtcgcagacgccgagcgccatcaccaccgcctgcatccccgacgagtagtggaagtacctctcgtcgtgcctccgcgtccagttcgccgccggctcgccggtggcggagacgaaccgcctcagcgagtagtacttggcgatgcgcgcgcacagcgcgtcgaggcgcgcgtcggtgacgaggagcgggaacggggaggacggcgtggcggtggcgttgcagatgagcgcgtcgaggaggtgggcgggctggcagacgtacatcgccatgggcacctcgccgccgtacgggtggcagccgcaggcggcgcgggtgatggcgttgcgggcggcgcagatgtggaggatgttggagttgacgaaggagagggaggtcttgacgccgacgtccgcggcgaacccggcgacgcgcgcgttgttgaggcggatgacgaggtcgtgcgcgtcgatctgcgggcctcggccggatccgagtagacgccgctgttcccgaccgcggcgcaggtccggtaccgtcggccgaggacccctgcgaggtcgcgcatcaagccggcctcatttccccctgcggccgcggcggcggcggccggcgaggaacgacccgagcgatgccctgaacgaggcgaggagcttcccgtcgggggggagcgcgtcgaccgggacgcggaggcgggcgacggtcttgggccgcggcggggcgcgcggggagaaggcgtacggcatgcggaggtagagcagccggtggtggttgccgaggctggggaacgtcgagatcgacgcgttggcgaacagcgcggcggcctcggcgaggatctggctggatccggcgccatcgtcggccgcgaggcggcggaggagggggtcaccgacggggtggcgggacgacgacgacgacgacggggggccctgcagcacgaggaggcggcggcggaaggagagggagaggattgagaggaggaggaggacgaggacgggcgggaggtggcggcgcttcatccccggcggcggtgaggtcgccgtcgtcggtgatggtggcgagatctagtggcggctgccatttagagctcgagtggtggtggtcgccgacgcggcgagtgagtggggttggggagaaattaatcagagccagggagagagagagatgtggtgggacccaccccgacccaagtgggtgatttgggtggatgacatgtggggccagggatgaggtggggtcggtgtgtggttgggctgcaacggtggggcccaggggccgggttcgttcggtgagtggttgctgttgtgagaaacggttggttgcgacgcacgctcacaacgaattcccagaagtagaccgacgaaaatatggtttgcactttgtgtgagtgagaggcaaaggttagggaggtgaactgatacagcgatattctgtcgtaatctcaaagaatcactggtagttcattacgtaagtttgatagtaatatgaatctaatttttttttctcgttaagatataaattttacctcattttttattaccatggttttaagtaggtacattctatgagaaaattttatatataaaagttgatttaaaatatgaaataaaattttcaaatttataatacttaaaaattaattaactatgcgttaatggttttcttattttttttagaaacgaacactgccatatgtggataatattttattgtggcaattgcatctgtaccccaatttcgaagccaattgctgttttacccccacttttttagagtttgcagttttacccctactttttgaatctgaagcagccatgtgcccctgcttctaacagccggttttatctgtgttacttgtagaggaaaaggacaattatgctctcagtggttattgcaattttgctccaattttttcagcttcgtgtgattttgcacgccgaattctctcttcacgacgaattctctcttcacggcagtaatctcaaattaattgtggattacgtttatcatgaatcagattaacgagagatttaacagacgtttggaatttgcggcaacacgaaacggctcagggtttctacttctgcggcgattgcgcgcgttggtggagatggaaccaatcccgtgaaaccaaccaaatcaaaccgaacgaagagcgcacacacgcgaaggatcaaaccgaaccaaaccaaaccatacgtgccgccacgattaaccgcgcggcgagagcgtggtttgttttcgaggggttgcgggcgagcaaaatcacctggtggcggtacttgtagtagccgttggagccggcgatgaggacggcccatctggtgtcctcggcggcgtcgtcctccgccaccgcgtcatccgccacgccgcgctcagacggcaggcggaggttgctctcctcctcccctcatggttcctccatccgcggccgcgtgcccgcgccaccgcgacggcgaggagcgcgaagaggagcagcaccgcgagcggtggcaggacgaggcggaggcggaggcgagtgcgcgccgccagggcttcccgtcctgtcgcggcgcggcgaggcactgttccgtgcggaggaagaagaggcgggctgtctacctcctgggagcgggcgccggcgcggccgcacgccctcggccaccgccgcctccccgccgcgcgctctcgctgtcgcctccgcgccgccccgcgctagggattcgacctgcttttcccgtacgcacgggtggaagactcactcaaccctatccactctcaggggtacaaaggtaatttcataattaccctttttttattttcctttgtatttctttaacgcacaatgtgggacccatcaaacggctgtcacaagtgagggtagacggttgcttcagattaaaaagtgggggtaaaaatgcaaaccctgaaaaataagggtaaaacagcaattggcttttaaagtaggggtacatatgtaattatccctattttatttgtcatgttactacgagttacgagtattgaatggttgaagaagaggaagatcaaaaatgctggaattcttcgtatcttcgccacactgatggcgaaggcacttcagtccagcttcacgtgatccatcatgcctgaacttctattctactcctatcatgttgcttaagctgtttgcgagtactttttgggatcttccatgttcatcaaatccttcaaaaccaagtgacacatagtttagttaaccagggtctcacataaaagaatacgctaatccaggatgttatagccgagggtacaggaaacagtactggatcttccgacctccgcgtcgccctctcgcgcgggcgacacggagggcaaaccctagcccccgccgcctcctcccttcctctcccacccctcgccgccgccggagttccgcgcgaccaaccgtgagggcggcggcgaggcctttccccggcgacgcgacgactcagcgcgaggacgacgacgcggcgcgcgatgggcgggcgacggcaacggcgcggcatgaagcttcggatccggcggtgccaccaccggatctggcacccccgtggctggatccggcgccctgccgctggacctggccggaggcgagcgtcactaccatccgcacggaggaggcggagcggcggcgcttgtgctggcggtcggcggggtggaggccggagtgggcggggtggaggccagagtgggcgcggcggagctggccctcccgcggtctgactggaagggggcggcggggagcgctggacccggtgcccggtggcggctagcggcgcatgctacagcgacggcgggccggcacgacctcgtcggcgccacccccccccctctccccactcgtcggtgatggctaggcttggcgcgccgatccgggaccctagcggtcggatctggggttgtcgcctcgtcgcgcggcgcggtggacggcagtggcaggagcggcgccgcgtcgaagcggccccggcgctgagggcgggttccggccggcatgtgcctcgggcggcgtgcaccgcgacaacggcaatggtggtcggtgccccggccctcggtcgatgctcaggggcctacgtgcctccggagatgctgcggctagtgatggcacgacttggcggtgcgtcctgcgggtgccgtcgccaccgcaccttcgtcgtcccttgcaacagaacctcttccgcttcccctccccctagtatcctcgtttgtgtgccctctaccccctagttccaaacatcgctgatgattttgcccttcaacttcttctcaatctggcgtgcttgtttggaaattgtgctcctctatcagctcggattgctacggttctatgccctcctccaaaagttgtcgttgatgtttttcctctgtgagaatccccttagccatttccccttctgtctagccccgtgctcgtcttcaccctctttctccagatgtccaggaccgcaaggatcagtgtttctccctcctttgaggcttccttcccttgaagggcgttggagaaagttgatctaacaagcaatttgataaagcctgattgaagaaaacttaatgcgggtggcctcgagccgcaaccttcagtggccctccctcctttagggcttccttcccccaaagggcgttggcgagctctgatccaaacaacaacaagatcaagtcagcttcttgatggcttcatgctggtggctttggacttcaacagcattcccttgcctctctttttttcgacatgcttgtggctgtgtgaggaattggatgttgcttagttggggtttagcagtaggttttggaatttggcaagataattttgcaggtgtcgttcatcaattgtaatcttttaggagtttttctttctctattctctcttcgttgtatttctccgtgtattctgtttttctatcctccagggccccaggccccctgcgcttgcgtaggtaaagcttgctctgtgtaagatcatttggctcaatatatttaggtggggattctcttcccccggtgatttagtcaaaaaaaaaaggatgctatagcccatcacatgacggcattggagtgttaggagtcatagtacctgcccaaaacatgttgacgatacccatagtaacggatccaggatttgagcaaagggtattcaaagttgaaaaaaaaaatcatacagaactcaaaaaattggactgggaaaatcatacaggagtggtaatgacatgtttaaagccttaaaggtacaaacagtagcacaatagtcaagatgtctatctccaaatgcacacttggggacatatcactatcatgggcattgggtgcttcaagtagtagctgaataggactagaaggggcattttctgggatctgaacttcactctcattggttaatggttttggatcagaggtggaagctactttctgagacttggttgacctttcccacaaagacttcaattcttcttcatttttcaaatttcaagacctacagttcaaatttctgactgactaatttaacttctaagcaatagcaattaagcaatggccaatcgattggggaatttgacaagaggatttattttaccagtgtcagtccactgtccagccgtctagggaccaaggggacgcgccgacgcgggggtgtgtcgccgcaactggctgccgccgtgcgccgcaacgccgccgccatccgtgcgaacctcagctgctcagcgtcacccgtccccaaggaggcggcggtgtcgtcgcaggccgcgccacctccgcagcagcaggcccagggaccagggtccagggagatgaggctggtggcgattctggcgacgcgccgagccggcggccggcgccgccgagcgtcatgctctcgatgccccgtcgcccgtcggtggggatgagtggaggcgtggcggattggggctgggacgacaagaggggtggggactggctgactgggggataggaactagggatttgttcgtttttgggccagtgggcctattcgttgggccaagatggggaggaatgtatggtctgttgcgaataaatgggcttcttttcatttggactatacatgctgcacttccttctaatttctcatgtatatatgcataacatacctatatatagttttttttttaaaattctatgggtattcaggtgaatacccatgaatcacatgggatccgcccctgaccaatagtacatgtattatatatcctcgtattattttctccctttttacatacgcacgcttcccaaactaataaacggtgtatttttaaaacttttaatagaaaaaatacttaaaaaacatattaatctatttttcaaatttaaaacaattaataatcaattaaaggtctatttagtagggctccaactcctaaatttagctccaagggctcggtctggagtagagttgtggagcagtctaaatccagctccacatctctagttcattttgtgaaaaaactccagctaattctagtcacattttggatggaactgaaactatttttctggactctggcttcaggataagtggagccaaagctctgccaaacatgccctaattatgggtctcaattttgtctcttgatcttctcatctcttctcaaacacaccatgggtcaattggattcatgccattacaaatgtgcatgttttaaaaaatatcatcacaattcacctaattagaaggataccattacaatttttcatatatcttaaatatgccatattctacgtcccaaaggctattggacccatgaatagaccaatgtattttcgtatagtctaaaatacccccatatacaccccgctgacatgtggaccctgtcgtccatatcttcacggccacagagagcaaggcatcgagtcacgacgccgctggccagctgcacgcaccgtcatccctcacccgcgcacgtgactacctgtcggctgctcgccaacgcccccgcccaagccacccgtgccattaaccctctcctcgagcttggcgctagctccgccatcacctacccgagctcgcatgctgctttcatcctttcggtgcgatggatgatgtggcatagagggcagatccggcgcccggctccatcactgtcttggggagtagggatggcaacgggacggggcggggccgggttaggctggaacgccaccgtccccgacccccgacttcaccccccgcccctggccctgactgttgatacggggccaaatcaacccccgtccctgatctctctggggccccgcaacctgaccggggccccacattggatagcatctccatccaatcaggaaaaaaaaacaagacattcatcaaattggcaaaaacaaaaattgcacatacttgacacaccataaaaaataggatgaatcgtcggccaccgtgaatcgccggctgccgccgcacctatcccctcgccggccgccgccgcacctatcccctcgccggccgtcgcgcctttgccgcaacctcactggccgccgcgctcttgccacaacctcgccggccgccgcgccttaccatgtgatcgggtctatgcgccatcccgtgcgtcgtttgcactgccggagggagaggtggaggtggactcttgagggagaagtgaaggggacgggatgggaggctggaggggagaggagaggaggggaagggagagggcgaccggcgacgacgagatccagaggtgcgccgtgcaccctgcgccgcgccaccgtcgtgcgccctatgccgcccaaccgccgtgcgtggtgtggacgggagggagatggggatggggggactagtgagaggataaggttagggtttagtaattttgtttatatatctccgtttttttctgggttggactgttttggaccttttatgggctatattttgagagttcatatacactccccggccagcgggtcacccgtgggtgaaatgtctcccccgtctcctccccgcccaaatgtgggtccccggccccgactcccccgtaggggacccagtcctgcgggggaaattgccatctctattggggagtttgtcgacaacatcaagcttcgtcgctgcctctgatacggggaaatgtagcaggatcagcaaggagaggagaggaggcgcgagaagagccagagcaaggtggcaccggggagacgccaacgcaccgccggtggagcaggtatgggtgcgacggagggaaggttgtttgcgacgaggctagactccatgacggcggcggcggcgtctcctgaactaactgtcggtgaaagatttacccacaatttatgccaaatgacatctacttgaatgatgatgatgaagtcatgaagagtactttttcacctaaaccctttctgaattagccacacttcctatttggattacccagagttttactaaaattttaaaatacgtatagactatagtataaatgcatacaccttgtcacatatagtgtatattttagttgtcaatcaacattaaaattcaagaagctttattgcttctttggtacagtacaaagtatatacatttataaaccgctttacaaagtagtacgaagtatttacaaagctttatgaggtgtgtgtttctttgtacgaatgcacttctagtccaatcaatttataaattagttttgctaataaaaatatggtttcatatcataacttacaaattaaccatatactatataatttatgtgagagagatttatcaagtagtataatcatcaagagaatcacactacctatcgtcatcctagtttctcacacatcaatacaagctgatggaatacttcttgttgcaagccgggttggatgcgaggctggtgatccacacctcgtcggcgaccaccgcctcgtcgtcgtcgttccgccgccacgtccacagcgcgtgcgtggcgttcaccacctccagcctgccgtgcccgaagctcgcctccctgaacgccgacgccgccggctgcgggtcgacgtacctcgtggcgagcccctcccggttgccgccgtcgccgacggtcacgtgcaccggcccgcacgcgtcctcgccgccgccgtacacccgcgcgaacctctcgtacgcgtggacgtggccggcgaacaccgcgtcgacgcgggcgccgtagaggagctcctccatggcggcgcgcatggcgtcgccctcgccgcggtgcgccctgttgctgttgtaccacggcgcgtgcaccagcgccaccacgaacgccgtcttggcgcggtcgacccccgcgaggtcgcgccgcagccaccggtgctgcgccgagccggcggcgtagccggcgtaggaccccagcatgacgacgtgcacggcgccgccggcgacgtcgaaggagtagtagaggttggaccccgacggcgacgcgccggcgtcgtgcggcatgcgccaccgcgcgtcgtacgccgtgaacggccgcgggtggatgaccgggatcctctccacctcgtggttgccctccgtcaccatccatggccgcgcgctcgccagcggctcgacgaggcggccgaacgtgtcccaccgcggctggtagaagtcggcgtacgacaggtcgccggggaggagcagcatgtcgtagacgtcggcggcgacgtgccgcagcgtcgacgccgtccaccccgtctggccgaggtcgccgacgacgacgaacttgaacgggaggctcgccggcggcgtacggaaggagagctcgcgcgacgtgtcgttgctgcagcggtagaagtaggtggtgctgggtttgagtgggccgatgacgacgtcgtggatgttgccggagtggtagaggacgtaggagtaggtggtggtgtttccggccgccgagaatgggtactcgccggagaccgtgccgtactccacggtggccggcgcgtcgtcgtcggtgatccacgtcaccctcatcttgtcagagcctacagctgatatatgcacctgaagtttcagcaaaatgtgtcaagctcactagcaaatgaagtttagctacagttaattgccaagtcatttgtcaactattgcaaaagggtaattttaatttttatcattcttgagaagatacacttcattgttgcaaaaactgtagtaatctgatagacaaactgtaatcttattcagagcagcgattgagttctctgaacacagattcaggaagaaactgggttcttgattttctctgaggtttttctttggaaatcagtttaatttcctctcagattctatgatattgatcaccttcactggcatgactttgcaatcttctaagctgtacatgaacatcaatttcaggctaaatatatagcaatccacaattcattaacatatttctttaattatttcactttctttctcagaaatttcatgggctatctttctactggcaaataatacgccaatgctattgcttattttgttagctaacttgatgattcagaagaaagacagcaacataattgtagtttatgtttttttaactctattacatatataccgagccatacatgtatactagctagcagggacaacaatggtaataaatgattgtgcttattaaaaaaatttgggcatgggtgcagtgcccacaagtttcagttgctaatccactcatgttaaaattgacctgaatagattgaagcacatatttgcaattgacttttgttccaactcaacatgtggtaggaaattttggtccaactttgtttctcatatttttcaagtagtaccagggctaccatgcatgaaaatgacaaaattaatatgtataaaaccgagtacttgcttcctgattcatgcaaactgtctaatagaaccgtctagactctagacccctcaccacttcttctgaaattacttgaaatataaacttcattcttcagaaagagagattaagcatcatgcagtacaaaatataaatcattttccggttatgatcattgacaattctgacaacatgaataacatataatcttttcaacacagattatgttgaaacttaatgtatgcagataattgagatatttcttttcagaacctccaacagaaaaagaaaaggatgaaggatggctcaggagtcaggaagattactgtactgaaactatgcatgctgattacttgcactatcagcaaaatttacagaaagtaacttttcgtattactcatgattgagcacaaagaaagaactcataagtactcaactttctgtatggtcgaagcattcattcgtgtacgtaaacattttcagattcctctgaaatcgatcgaaccaacgagcgaaagaaagaaagaggaggagaacacatctgacatggacatcgaccgatcgaacgagagcttacctgctgcggcgttcggccatcgccgtcgtggagcacggacagcgtcgccctcgccgtcggccgcacgtacgtcgacgtcacggccagcgatgccgccggcggcggcagcagcggcacggcggcggcgaggaggacgacgagacgcaacgctgctacgctcgccattgccatatggtcacaagctcacaaaagtcgtctctcgcccaaatcgatcagtcgacgatattggacaagcttgcaattgcatgcaagatgagaagaactatatatatcagtcgatatgacacaacaagaggcgcatagatatataaagccgtgtaaatctaatctaaactatgcggacaacgaaagtacatgatatatagatagataaatagatatagcctgccgtgagtgagcgaatgtcgtccaaatttggatacatttcagctgcaaatcaagcttctggatatagtgtttcgtcagctttggatgacttgtctttcaaatattttgctcccttaagaaacagaaaccgaacaatattttcataacaaaaaaaaagaaaaggaaaggaaaaagaaacagaggagaaggctggctttgttgagtgcagaaatggggaagctcggagaagctcatgttcttctgccggatgcttggctggacaatgtaagcaatttccacgtgtccatctgaccatcactatgaaatatttcgctttttttaagataatgatgattatgaaaaatttattatgctaagcatattccattttggtatggcgagttgacgactttgcttttctttgagaattgagacacatgcaactgtactttatatatagaacactgtccttgctggctgcctaattgtatgatcaacatgttaagggagcattaattatgtttttttttctagtatttagctgccgaccatgcctgaaataagtaaccatcaagcatgctaaacaatataatttctgtggtcaacgaaggaaggcagtttgatcaggagattatttcttatataaacgtacgatggtcgttgccgtgttttcctttttaggatctcccaaaaaattgaaatgctcttaattagataattaatcaagaggatagctggataagtatgtttatgcatagggtaagatctgcaagtacgccacatacaaagccaagtacgaaaagataaacgttctttgcttaaacttgcaggcatttctctctctgaaccgtacggtgacttcatcctttcagtactctcttgacaaaattcagcaaaatttgtcaggttctcactctgcaaaaccgaaaagatttccccgtgccgaacttattgcgtgctccaggagcataattggatcaccatatatacatgataagtgataatcatagtgtatttcctcatcagcagatgatcttttgacaccggatgttattgcatagaagattggaagaattaaagttccagttaacacacgtatcatgtcttaattacaaaaagaacaacatactttcatgttggtttttgcaattttatcgaaaacaataatgggagatggtgtttgctttgaaatatatataatgggaaataatgctcttttcgatgcattcgtctttcttgtccattttcaaaatctttaacacaaaacgaaggcatgaaagcattactaactgttctttaactagaaattttcgaaacaatttcatttgtgcgtatccaaaaaaaaatgaagctacttcttcaggtcactaaaattcagatatataatctatctatctatatctaactatggttttgtacattttctataaaaagaaagctatctatttatctatatgtctgtctgtctatctgtctatctatctatatgtatgtctatctgtctgtctgtctgtctatctatctaaagatagcttaaaaaagatgtcatttagagcctagaaattctaacattaagaatagaaaaagaaaaaaaatgttgattgttacaattatatttgtaatttatggaaagaaaagagagttgtatacataacccaatcatataaacctatcaagtaaaaaaaaattgtatctatgaaaaatatgttgagagttgtatatcaaatccaatttgatttttttcaaaactattgtatataaattacagttgtatttgtcgagtcaaaatttttaaaaataagagttgtataccaaatccagtagccccatgcaaaaatataaaaatcgaacagcccgttagctaatataataagcacatagtgcgaagtatctaaagcaataagattgaataaatcgaaaaaaatattgcagggaagattttcattattcatgattatttcacggtccaaataatatctaaatgaattcaacaaaatttacaaatttatagggaagattgtgatgatccaccagttattttacagtacttgagaatataccaaattttctaatataaattttgataccatatttttttaagttacctcatgtatcacaaagtaccaaaatttatcttgaaaaagaggtacctgatatattaaggaccataaaatttttcattgtctatacgtgtttgggaagtctttgaagctgggagtaatccaaaagggaggcggccatttcaaccatggctgaggagacacaacctcactcaaagtatcgtcctcgtagttgtacacaccaatatccctaggagtacctttaaaggcctgaagcgagcactcatcatcatcagtgaaatagatgtgatttggcatcaaccccggataatcctttgtagaaaggcaggcggtgtaattgcggccgatgaacacatcattgtcccctaaatcatagtcaacaaacctgtccttaattatcatcaagatcaagcatgagcacagaaatttcagtagtgcgtgtcaccgtttgatccgtctccaacgagcttgtgaatctgaatatttgtataaaatcaccatgattcggggatcgagcaaggtagacaatgagatacatcatgggtaaagtctcctgaacaatcactcctgtcacgtaggaagaatccggattgatgtcgatgagatgaaccactctgtggtaagtgatggtgtagaaagaggccgtcatcgaagatgcagtcggagaagcggatgttgttgtggaaggtgatcttattccattgcttgtctgatgatctagctgcatgtaaggattgtggatgagcatgatggtgaaatcgccagtcgctgggtcggaggatgtcattgccttcatgtagatgaagttgtggagctcgtcgagctggtagattgccggaatcatgtcctactttcttgggatattggtgtcgtagaagaagacgttataggcggtgacattattgccggcgtcatctttcagaatggggtttacctattcaatggtggtgacggagaggagcgaaatctgatcgccggtgatgaggttgaggaggtggagctcagagcgggcgtcggcaatgactgatgggagtagcagagccgacgatgtatcggtcactgatgggtgggcctgggaaggagggggcataggtggtcttgtcggcgaggctgcagagctcggcatcggcgacggaggaggaggcagggggtttcagggtgggagtagaagccgtcgcggaggagagcgcgcgcggtggtgagccaggtggcgcgaacggtgccacaacgaagcaggtttgagaattctagcgtggtgaaaatggtgcagagcatgtcggccggtaggtctaactagttgaccggcggtggtggtgacgcggcggccatagtgacgaagagctagcgctagagccgacaagaagaattaatatccctaacaactaacaatgaatcggtggggcttgacctcatgtcaatcttgttgttgtggattattttgctagcaatggaacagagaaggagaacagaggagagaagctctgtgtttgtttcacaaactggttatgctttgctcaagtattgcacgttacattgattgttggacagcagcatcacatctaggacatagctgcctatttataggatggctaggaacttttctgaacacaactagtactggtacatgcatgaaaatactagaactcacaaagaacatattattgtctacactactctagaaatttcacagaggaaggacttgctccttgacttttgtttcatgagtagtagagagagagttagagagtaggctggtatgttctagaaataaattaactccaacaaactcccccttaatttatttcttgcaaactccgatgagctctctgtcgcggacaaatttttctttggataaagccttggtaaatatatctgccaactgctcatcagttcggcaaaattccaatttaacttcctggcgatcaactgcttcccggatataatgatacttgatagcaatatgtttcgtcctgtcatgactgactggattttcgctgatcgcaattgcagacttactgtcgcaataaattgtagtaggctgatattgcttctcgcccagatcttccataattctcctcaaccaaacaacttgtgaaacagcttttgatgctgctacatattctgcttcggctgaagataaagcgacaatattttgtttttttgtagaccaggagcacatacctgaaccaagtgagaaagcgtagcctgatgtgcccttcatatcgtcaagacatccagcccagtcactgtccgtatagccaattaattttgattctttaactggcttataccatataccataatctgcggtccctttgatataccgcaaaactctctttgcagcggtaaaatttaattgacttgggctagacatatatcttgataataaacttgccgcaaacataatatccggtcgtgttgcggtcaaatataataaacttccaactaagcttctgtaaattgttggatctaccttatcagctccatctctagccttttgcttttcatttggcaacaagggggttgtaactgacttgcagttatccatcttaaatttctttagaatattttcagcatatttcctttgtgatataaatattccttcatcactttgatgcacttccataccgagaaaatagtagagcaagcccagatcactcatttcatatgtatgcatcatatcttttttaaagtcttgcatcatcttctcactattgccagtatatatcaaatcgtcaacatagagtgagacgattaggatatccgtacctgttttgttgacatatagagtaggctcacttatgctcttggcaaatcctttctgaataaagtacttgtcaatttgactataccacactctaggcgcttgctttaatccatataaagccttcttgagtctgaataccttattttctcccccttggactgaaaacccttcaggttgttcaacatagatttcttcatcaagatagccatttaagaaagccgatttaacatcaagttgataaatcttccacctcttttgagctgctagagcaattatggtacgaattgtctctagcctggcaacaggagcatatgtctcataataatcaatcccaggcttttgcttaaagccttttgccacaagtcttgccttgtatttctgaactgagccatctagatttaattttgtcttataaacccacttaactccaataacttctctgtccctaggacgatcaaccaactcccatgtattatttttctcaatcatatgaatctcatcttccatggcctttatccaattatcatgtttttctgcttcttggaaactttgtggctcaacaactgaataattgcaaaattcatgttgttctgaccctctttgttgagaagtagattctaataattcaaccatacttcttacccgtcttggagctgattccggtgtagaaatttgctcttcactgctcgggcttgaatctgaactagcacttgagcttgacattggacttgatggctgtggacttggagtatgatcttccacttcatgagtgccatgcatatgtggttggcctagtgtgatggtagtggttggcaataatggagtactagaggcttctggagacttccagttccatgtagcactctcatcaaaaatcacatctctgataatgataattttctttttctccaaattataaagtctatagcctttgataccatcagcatagccaacaaatatgcaccgatcacttttattatcaaattttactctcttttgtgctggcacttgagcatagcaaatgcaaccaaatactctcatatgaccaatgacaggctttttaccataccaagcttcaaaaggtgtacggtttggtactgccttggtaggacttctatttaaaatataaattgcagtattaactgcttcagcccagaaagatttaggcatacctttgtcttggagcatagaattggccatatcattgatcgtccgatttttccgttctgcaactccattttgttgagtactatagcctgccgttagctgtcttcggatgccagcattttcacaatatttctcaaattcttttgagatatattctcctccttgatcgctgcgcaatactttaatttttcgattactctgattttccaccatggccttgaattttttgaatatctccaaggctgcagatttttcttttagaaaatatacccagatcattcttgtataatcatcgataaatgtgataaagtaccaatttcctccttctgaaattgttggcactttaccaactatatcagtgtgcactagttccaatggtgcacttgctctccaagctccactgtggggaaaagaagcccgaatttgttttccaaatacacatccttcacatgggtcagacttgagagtaataaatggaaggccttgaaccataccttttgtcctgagtagcttcaatgctctgtaattaagatgacccattcttttgtgccataaatcggaaatatcaatttcactcctgagagccatttgagttggatgattcatccttaatagaaaatttctgttcttctccatatttattttggcaaccagacgattatttttacggtccaatattttgcaagaaaaatcttcaaaataaaccgcgtacccatgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttcatgatatgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatattttgcaatatggccctttcttttgcacttgttgcaggtcattttcttccagcacatatctgtagtatgactagatttttggcaaatgtcacaccacaaatttgaactggacgtacctttttctcttctctcttgaccatcttccttctgcctggaaaagccatttttctaaaaataaccacggtctcgcattggaaatccattttttttgaaaatttccgcgaaaccttgagttttgaggcctgaagctcaactttgactgaaatgcattttcaatagagctcccttcgcgctgaactttctttcttcgtgagattccaacgagctcattagttgctgaattgtgagagtcgacaagtctttcgactcctcaatagcagcaacaatgtactcgtattttcaggcagactgattaaaatnttctccacaaccttctggtcgtttatatcttcaccatagaggcgcatctgattaacgatctcaataactcttgagaaatagtcttttaccttctctgactccttcattagcaaattctgaaattgtcttctcaaggtttgnnnnnnnnnnnnnnnnnnnnnnnnnnnnnnnnnnnnnnnnnnnnnn

SEQ ID NO: 8653 - DNA, 1337 bp, Oryza sativa
ttagtcataagctgtgcaattagttattttttttagtgtatatttaatactttatgcaggtgttcaaacgttcgatgtgacagggtgcaaaatttcggggtgggatctaaacatagcctaaaaacagaacattcacaacatcaaattacatctgcagagagatcgctcgctacatggattgtcgtgcgaaaagctagaccaaacggagtgtcggtacaccacgacagtgcacgaatggtgggaagcgacaacaaacatggagaatgtgccaaaacgcatgtgctcctaggagatttggaaggaaagaaacgagaaaatctttcaatacaatgagctctcatctatagttttattggcaaaaattaaagagaagtcaaaacataggcgctagtaagagccagtgtctatttgttttgctgtttaaggataacccttttacaactttttcatgtcaacacctgtacagaaatttacttcaattctattcaattgaaattagcaacttgccgattcactaaaaaaaaacatttacaggatataagcaaatatctcaatctagatacaaccatgtagaggcaacagtttatgttgcttacagccacagatcacaggctcaagcaaagaatctcaattaaataaagaagcaaataaagtgaccaaaatgggtccatgcaatgatgggtacagactaccaatggagtaaacaccagccaatattgcatctgctttgcacagccacagggacctggaactctggaagatagctgctgctgctgcttcttctcctccattgccatctatcacctcacctgagctgaaatcaagaactggatctaggagaaggtcatggttccaaggatactcatcgttctcctggttgtgctgcttggattggcattccaggcaattctccggccaccacctcaaaaattgtgtggctcacccggtggacctcctgtgacatctccaagaatcaagctcagagatggaagatatcttgcttacagagaagatggagttcagaaagacaaggccaagttcaagatcatcagtgtccatgcgtttgattccaccaaggacttccccttgcaggtttctaaggtaaatgcaaacatcacgaacagttagatttgagaaaaaaaagtcatctttttttgtccatgttttcttttagatttttcatgcttttctgaattgattgcttagtttgtctgtcgaaattcaggaactggtgcatgaactgggaatctacattgttggtttcgacagagcagggtatggggaaagtgatccgaatcctaagagggatgtgaagagtgaggctttggatattgagg

SEQ ID NO: 8654 - DNA, 2892 bp, Oryza sativa
gggcataattgcctaatcatccaagaaaagagaaagataaacagggaagtaggttttttacatctccaaccactgttgttttactaagatacagaaaagaagttgttattcgtagggccaaaacctatggcatgacacactgccatgacggttcacgaagttcatccaataatttgaaccaccaatttttttattttgaatctactattccccctgttccaaaatatagcaacttagtaatcgattagacatgttgctatattttaggacggggtgacggggggagtatataagaagaacagcatgtttgatacatcaaggcccttgtttttttcttatatctgtagatgaaatatccatgcgaaacttctcctctggtatagagataaacatttcccttaactcgactggaatgtccaaatcttcaaggaccttcaaaataaatagagaagtataggatcagaccttattttccaatgggtgtagaagatgaaaactacagtgaatgcataccttgaaaactccttcaatatttcgaccaccaacaagaaatgttgtacctgtgtttttacattcgagaagtatctctagcattctattgtaatcacctccataatacttaggctgcaacgagtaaacttcattcagtacgagcaacaagtaaagcagttaaactgtctttcagaattcagcaattggcttgaaatattgtgtttagttccatctaacttcttacattaacaagcctagctgcagtgtctgcaccgattacaaatgcactgcctggaaatagctccgctttcttgtaaaagtatggttggttagatattatcacattcttccctgcatcagaaagaagaacaaaaccatcgatcaattggagtttcctacctacagaaaggtagtacattcttatctcaagcatcaagccccccaaaacacaaaatatgtgaaggattattggttagctgaagacagatttcagtaaatagaaaaggagttgttcaggttgtcgcttttcaattattatttcatacaattgattataaaaacaaactgaatcagaaacatgaatttcaaatctataaagacaccccatctgttcgctgttaccaatctaattggtgtatcatatcacattgagactttcattcatggcagtgggtcatacctacttttctaaattgctcaacccggcgcttgatttctgcgatagatagtggaggtttgtcggcattgattgctgatatctcaaagcatggaagaccatcatcacacatgctacaagaagcagatttgtggggaggaaatattagttcttactctcttgaggtcagaacaagcagactaaaagctttatatgtcatgttgtgcactttttatgcacatgcagctcgtggaaccaacgtcacacttatagttttaaaataattgaagcgtcaaaatggagaggggcaatctagtccttgatacagacatacagtatgtatctttatgtgacttgtaatttccagtttaacagagtgccttttcattaaattacttctttgttcatttctattcttgcttcctcgctaatttttaacatgaaaaaaaatccagttgtgaaaatgctatgatctattctcttcagtgttttcacatgataaaatcacaccttgatgcaacttctaacagcctaaggtgtccatcatgcaggggattgaatgaaccaggtagaattattttcctgttgaagtttttatccattgaatctgcaaggaaaaaaagaaatagatttaagagagagaaaaacccaggacggctgcaaactagtattaagagatactacttgtctgctatattttgggatggatgtagtatgatttaagagtgaaaatgaaatattcaagtgtgcacacatagcaacatcgagtgacaaagtataccagaaaagtgatacactttcatgcagacttgcccatcaataacttgctggagttcttggtcttcatcaaattgttccacgctttcttttggaagttcaggttcttgaacatctgactgaatggttgcaggaactttgcagccgtctgcaattgcctgcaacacagtatattcttacaacggagaactaactggaagaataccaattagcaagaaggttggcctatcctgacgggattggttgattgtatagctgaatcatgaccaagtgaaaggtttggtcaattgtactaggttatcatgaagtccaactcaagtgcatgttgccagtgatgacataaatatgtgtgacagtgtgagtacacctagttatacataacaaaccttgagcagaaagtagcttgaaactttatcttcttcctctctgctccgtaaaccctgggtagaaagaccatgttaatgtgatacatcatagctaagtaatgaggttgttatgtttatttctattgttgcactttccaaaaatgtgcatatggtaaaatgtgttagtaataaggcacaccatataatgtgaccaactcataccatttttgcactttcttaaaagaaattctatgttaagattgaaaacaaaggatagcaatacaagtacctttgacaatgtaacatgtgatgtcctgaggcaattttgtgttcgtgttgacacatagaacctattcaaaatcgctaacaaatattataccgtgcattgaagaaatgggaattaaatacatctctgcaaaagcagagaatatggtgtggtataacatgtcttaaagcccatatgtccgactttaacaacaaatgtaaaactactaattttatgtcagcaagtagttcatataaatggcatgtctgcttctgtatgattaatatcatgctatgttgctatttgatgtgcatgccatgtttcactaacttaatctg

SEQ ID NO: 8655 - DNA, 2700 bp, Oryza sativa
acgtgagctagccagtgacccagtgaagccaacacccattacttgtagacctgagcatatccacgtcgatttacttcaattcgcgtaacggatagatgatgctgagtgggaactgcaaactcttgtgtagacggcccacatacctgtccagaaagcttgagggcgcggttgaacgcggccaatgccatgtcctctgcggcctgcttgctggtgaactgcaagggcatctgaacaatgaagcattatcagtacaacagtatgtctgcacagaagataccagcttctgaacaatccaccgaattggctcacgcgctcaaagcgtgctcacaagatgggttcaaaacaagttcaaattcgggattactcggagggggagccgaggaattaccttgccgagcagctgcgccatggaggccatggagtagggcacgacgacctcgaggacggtgccggacgcgccgggcacggacagcagccacccgagcgcctgcggcgaatgcgcgctttgctttagtctaggcgccaaacagtactaccatatcggatcgaatctgccggcgaatcacggcgcggcggcgcgcaagtggggggcagcggcgaggcgaaggggggttacctgcgaggcgccgccggcgaggtagatgacggcctgggcgcgagatgagtggatagcctccaccaccgcgcggacccagctctccatcgcgcagccgcgagaagaagctaccagacgacggaggaatttgtccggttccctttacgcctctggccggctgaaccgtttgatcggtcttcccatcggacgattttgcccctgggcccactcgtcagatttaagagacagatagaggactccagaattcccagatcgatcgataaagcatttcccagcccgagcgggtcgcggcgacgagaagacgaaactgccccgtgcgccgccaacatctcccctctccggctaccgccgccaccgcgccgccgcgctcctcgctcctcgctccagggcttccggccatggccggcggcgacggtgaggaagcaaaccctaagcggcaccatccccggcaccggcgcccccccgttctgtcctatataccgcatctcccttacaccgttcccccctctcccctctgcaggcgatcgcgcccgcgcgccgaagcggcacaagtcctcggcgccgtcgaggtcgattgacgagaccgccgaactggactacaccgatgacgtcgatgacgacgtccgcgatggtaacaccgcgcgctcgaatccgccctaaactcaccgcccctcccccaatgtatgagggtttgcacggaacattgaactgattggggatttttgttttgtgggggttggaactttgattcggtgcagccgatagggaggtgaagaagagggacttcaccaagctagagctgaagccggatcacgcgaacaggccgctctgggcctgcgccgatggccgcatcttcctggagacgttttcgcccctatacaaacaagcctacgatttcttgatcgctattgcggagcctgtttgcaggtcaacttcagtcacctctagcctcaacattaaccttagtaccttaattgcatagtaggtttggactttcctgagactgaaattgcatccaccaagtggagtttagtccaaatctcaatatcttatacacttagaagccactaagttattgttaattctctcttatcttgtgaagtcacatcatctcaactgtttttagtttttttttcctttttgtggtttatcaaaggttcagattgtgctcaagcacaaagcaaaacctcctagctacaaaacaaaccacctcacatttcatgtttagcattttggtatgcaaatttcctgcagcattcatggggttccatctatgtggttgatttcccccaaaattagcatggtttcagcattcatgttggaataggcttgtttttgtcatgcagtgaaacagaagttgaatttagtgatattatcttcattgagagctgtggggatcatatcatattctgagggtttcactactttatcttttagggactttggtactgccatgtgattactcaatttgattttctgtgaaccacttggatataatttgtttagaataggttaatttgtttggaatttgaggggaaaaccaatggtttgtaatggaactaaccatgtattacttgaaaatggtgagcacagctatgtgataggcatatcattgtgccattagattgtttgaatagatttaatatgccccatgtggctatctagaacctagaaagtatactgacatatataagttgcaaccaagttgatgaccccagcatgacttcaagagagcataaccattccgttgttactgtcaaagtaaattctagccttctaggattctttagtttgagtgatgggatggtgggttaaggagattattagtcctttttttcttaagttaagatgggactgagtttgacctgaagtctttctgcaaaacaaaatgatgcctatactccgatggacgagatgatcaaattggtcgtcttttttatttgaacttcttttgaaatactacctccgttttttaatagatgacgccgttgactttttctcacatgtttgaccattcgtcttattcaaaaaatttacggaattataatttaatttggtaagaggtggtttatcactcataggac

SEQ ID NO: 8656 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagctacttcctgttgcatgtttaggacctttattgtgacaatggactcatcatctagctggcctttgaagactttaccaaagcttccactccctagcaggttatcatcactgaagtttcttgttgcacggacaagttcatggtatgagattaactggtaattcagcaagtctgcatctgagggtagtggcatctttcctggcttattcattttccttcttaccaacatacacaagcaaaatgctaaaataaaaaatgccacaactgcaggtaatatgaattttagtagccgttgtattgaccttgagtgagttttgctctggcatgattctattccttggctcggaaggccacatagtgccttgtttcccatcaatgacttgacagtgatgtttgagaacacacctccttctggtatctgaccctccagtctattgaaagataggttcaaattggcaagataagtgagattggccaaggactttgggatgacacccgaaagcacattggaggaaaggtctaactcctcaatacttagtaacttgccaactg

SEQ ID NO: 8657 - DNA, 1737 bp, Oryza sativa
tgagcagaagggtgcactggcagtccaattgctggcaaggatgccattagggtccttgacttgctccttgaagtcgagcagtgcagcgaggtctgtgttgttgtatggaggggtgagtgaagtggcgcatggtgccaataggatgaggagcaccatgctgatgcagagaagagccatggtagtgaaggaatgaaggttgatgatgaggatacacaattacgcatgagcagtgtgctggttctattggtggttttattggaagtgtggccgtgtgggatgtgcaattgacatgtgcattgtgttgaatggtcaaaaagttgttttttttagtggaaatatgtgtgaaaggaagaaagcgttttagactttttcgtttgaaaacaaactttcatttttcagagctggttgtacactgcagtttcttggtacacttcaaagtttcaaaatagaaagaaggaaaaaaatgaattccttccaagaaacaacctcttccagaagtcaaggagcaaagctgtaggagtatgtcatttccgtcattgatagcttcgttttttttctgttctgtttttaataatagattaaaacccggtctctacaccaacatgggtgtacacagccaactttgatgcttcatgcttggcgccagtacttatgtttgtttgattttccaagaataaaacatctggtttaatttttttttcagaaaatcacttaaatagtcgttctacgctagctagatttttttttaaataaaaactgggagataatctaactccaagtatatttttttgaaagcaaactccaagtatattcatatgccatttccatctttgatactatcttggtatgcttggcaccattacttatgccttttcttttcacgaatgaaacatctggtgtgatttttttcaggacaatctttttaaaagtttgttcctggctgttgtttcaggtatcaaagaactgtaaaaatactgaagcgcttctatcctagagatccatttcttattagggcccgtctagttacccaaaattttttttccaaaaacatcacatcgaatctttggacatatgcataaaacattaaatatagattaaaagaaaaactaattgcacaattatgggggaaatcgcgagacgaatcttttaagcctaattagtccgtgattagccataagtgctacagtaacccacatgtgctaatgacggcttaattagtcttaaaagattcgtcttgcggttccgaaatccccttccgacatccggtcaaacgtccgatgtgacatccaaaaattcccttttccccaactaaacacacccttaacccttattcagcagttgactaagagtctaagagaagcaacactttccatgtgtttggtcaatcctgagtagactatgctctgaatcgtgctcaccaacgcaccatttcacaccaaccgccatttcacatgtctattattgaaggcggtcaggttcagcgaagcaagttgatgatagtcgctcttccccatgctagactatccatatccatggagccatcaaacagcgtcatgatcactgataattgatagtagtacattgaatacaagagaagctgtacgtgcacaacttccctccattaagtatttaattgcttgcttgcattgtttgcttattttctgtacgatggagggtgggctgtgggcatcatgatggaatcgtggacctctcatatattgttgggttaactgaaat

SEQ ID NO: 8658 - DNA, 2953 bp, Oryza sativa
ccttgacgggagcgctcggttgacccactccctcaagctcagctctccgacgaacatggcgtcggttggcttcttccccgtgaagacctccaggagcatgaccccgtagctgaacacgtcgctctttcgcgatgcttttcctgtcgacccgtactctgtgatgttcatggtaaacaaagatcaagggggatctgcagaaattggcgatttcagtggaaccaaagatgaacggtaaatcgacaagtgattacctggtgccatgtatccgattgttcctggcatgctcctggagaatatggaggtgtcctctcctagcaataaccttgcaattccaaagtctgcgatgcaagccgtcatgtctgcgtcaagcagcacgttgcttggcttcagatcacagtggaggactacctcaaagtgctcatggtgtaggtaagccatagcgagcgccgcatccaacatgatgctcaccctctgcatcaatccaaggcaatgcctgtcactgtacagcaaccattcgtccaggctcccattgggcatgtactgcagcaccaacgccttgaagtccagattcgaacaggtggtgagtatcctcaccaagtttcggtgccgagccatgcgaagtgcacggcactcgacttcaaaactcatggtagctctttccatgtccatgttgaggacttttatcgcgacgatctgctcatcgtctagattgcccttgaagactttgccaaagcttccagctcctagtaggtgatcactattgaagttgtttgtggcacgaaccagctcatagtaggagatagccctatggttgttgtttgactccaaactcatagtaatcggcaggcccttcagtttcttgccagtgcaaaatttaatcgaaaacagcaagcagattgctattattccagtagccaatatgcttggaataagaactacttttagaagccttgattttttaccctgaagaggatggtcatttttgcaatgggggaaaccaaggcgtggaagaccacagagtgctgtgttccctctcaaagattggagggtaatgtttgagaacacaccaccatttgggatttgcccatccaatctattgaaagagagattcagggtagtgagaggactaagatttgcaaaggactttggaattgttccagagaaggagttatatgaaaggtctaagtaggtcagtgtgctaaatagttcaagtgaggctggtaaattaccagaaaatcgattggaagaaaggttcataaatgttgttgctttcagattttcaacttctggcaaagagccagtcaaagcatttccagccagatcaagacccacgatattttgaaggccccataggcccatcggtactgctgaagtgagctgattatttgatagttctaaggtttgtagccgacttagattactaatgctatcaggtatggggccatggagcttgttgtaggcaaggcctagggcaaacagatttgatttgccaatatttgcaggaatggtcccaaccaactcattagaagaaaaatcaatcatttcgagatccttcatctctgtaattgataccggaatttccccggtaaatcggttgttgcgaagatccatgaacaacatgttgctcttatttgtcatatcagggatatttccagtaatttggttcttgaatgctcgaaagatctggagggaggaaaggttgccaatagaacttgggatgctaccagtgaagtagtttgtgttcatcacaagatacttaaggctcttgcaacctgacaggtcagccatgaaatcgacatccccactgagcttattctcgtcaatgtagagttcactaagggctggaccaaatattggccttggcacagatccagtcaatgagttaaaggatatgtcaaggatagagatcatagacatgtttctgatagaggctgggatgctaccggtcaggttattcatctcaaggttcagccaccgcagctgtgtcagctgtcccagctccggtggtatcttcccatgcagattactcctggtgaaatccagatgggtgagacctgtaaggttgcccaagctggcagggatttcaccagaaaggtcattgccacccaaggagacattcaccaactgaggcatagaagccagccacggtggtatgccaccggtgaagccattgctgaatagaatgaactcttgcaggttcttgcatgccccaaagccttgaggcactatgccagttaaatggtttgtgttgagattaactgtttgcagcatgggaaggttgaagcttccgttgtttgggatagagccagagagattgttcttgcccaggtacatccgtaccaagctggacatgttaaacagcgatgcaggtattggccctgaaagctggttccctgacagtacaagcacctgaatgtttggcaagaaaccaatagcaccaggaatgctccctgttagtttgttgtaagcaaggctcaagaaaacaagctgtgacgtgccattgaacatgccacgtggtatctgcccgctcaactcgtttctgcttaatccaaggtacataatgttcttcagattgtgcaggtcgggagggatttcaccggtgaggttgttcgagtcaaggtcgaggatttcaagcacggtgaggttgccgagagacgaggggagattacctgagaggcggttgctggagagatcgagagacaggaggcgtggcaggttgccgatgccatcagggatcgggcccgagagccggcgtcgctgaggttgagggtggagaggaaggtgagctcgccgagctcgggggccagcgagccggcgagctgcacgccgggcagctccagcgccgtgacgcgcagcgggtggcggtggccgccgcaggtgacgccgagccagccgcagtagggcgcggccgccgtccagttgccgcggcggagcacgccgctcgggtcggaca

SEQ ID NO: 8659 - DNA, 8668 bp, Oryza sativa
agagagagagaacagagaagggactcgagcccgtgccgcacggggcatttccaccgtcggattctgaagcctcgcggccgagatcgagggctcggaggcaaccgtcggattccgatcctgggttactcatagccgtccgatcagagtagacgatggaaaagcgctcctggttccgagccggccgccaattcgtggttcctcctcctcacgggcggcggcgacggcggcgactacggcgatgcggctgctctccggcgcctctgcttcccgaatcccctgccccctcctctcactcgcccgcgcgagggcaagatgcttgccggtccccgcctctgccaccgcgtgccgagcggcctcctcgtcagccgcggcggccgcgggcgacggcggcgcgctgaagccgtggttgttcgtcgggctcgggaaccccgggaaagtgtaccaagggactcgccacaacgtaagttgcctgattttgagctgcttgtactagactccctgtagttattagggtcgaatactcgaactggtagttgttcaaagacgaaataaacaaaactgcaacctttctgactgttgaagagctcaaacccattctgcaagtatggaaatggccacatgttagatgaagtatttgaaaagaacatttcaatgtgtagttgtcaagtttttgttgacagtatatattacaaaggagatctcactttgagggcagcaaaattcattatgcgttgctttttgaggcatctaattcatacaatgttttttcgtctgattctcagtttctatgtcttcagtatcagtttcgtggaatatatatattgcacataacttcagtcctttgttcaataaatggtcacgcatgacacagtcccaatatgagtgcaccaatgcattatgtatctaatttagttgctaaccttgaggtcgctcatattgttcacaggttggattcgagatgattgatgttatagcagaagctgaaggtatatccctcagcagtatgcagttcaaggcaatggtaggaaaaggtaatattgacaattaatataattcttttcaactgatacatcttgtgttgaaagaagccatgctatctggattcccagagctgtactttgttcctcaagtcttgcacattaccttttcaactctaacaatatttatgcggttttcataaatattacctataaacaaatgctatttgtttaagatactctatgcttgaatattaaacatgagcaggtgcatatacttatttgaaattctgaaggtagtgctatcaaacattcataacagaaaataatatttaggtcgtattggagatgcccctatcatgctggccaagccacaaacttttatgaatgcaagtggtgagtctgtaagtatactgattccaaaacaaccttcactactagttgttccttcttttttttacctttttcgtttgacaaatcgagttatacaggtggggcagttggtctcatatttcaagataccacttaatcaagttcttgtggtaaagtgctatcctcgagtttctggttgctgttttttttaacagattgctatattttgattcttcattcattttttattctctgcagatgtatgatgatctagacttgccctttgcaaaattgcgtctactgccgaaaggtggacatggcggtcataatgggtactccagctctcttctacttcttttacaaaatggtcgaaactcattacctgcatgtgttaactcagtgattattttactaactttatgctgaagacctaacttttggaggtagataactctgaagttcacctaagcaaaaggatattcttaatttctcagctctcttctacttcttttacaaaatggtcgaaactcattacctgcatgtgttaactcagtgattattttactaactttatgctgaagacctaacttttggaggtagataactctgaagttcacctaagcaaaaggatattcttaatttctcatcatataccgttggcaccatctttctacttgtcctaatgcaatgcattatccattgttacttaagaactgatctaaggtgcatagttgtgagaaaatgcatcagacaaactttaggatgttcaattgtacatttgtttctcccacatcttctcttggggaacctctcatccatatgttcaccacttgcagggtgagaagcattatcaaccatttgaagcagaaccgtgatttcccacgtctaagaattggtatagcgcttctctcctttttcaactcagttaccatgtctgaaaatattcttgcggtgatatcttgcaggcattggacgaccacctgggaagatggatcctgccaattttgttctccgaccatttaacagaaaagaacaggaagaggttttaattagaatgctttcaagaaacccttttttttttcatatttacctcattttctgttctgggcatagcactgtttgtttaagatgtacacatctctttttgcagcttgatttcgctttccataggggcttggaggcagttagaataatggcacttgagggattcaacaagagcgcaacttatgtgaacaccgcacagtcctctgaaatgttgaatagatgataaagtgttcaatttattcttataacataaagattcttatgtcagatctgaatgtttcctatccagtagacacttgcacacatggtggtcattttactctcaggaaatcctgagctcccgaggacggaagagattatttgagctgcagcaacttggtacggtgattttcaccagcagcttaaatacagggaagttagagacgtcacactacatgcgtacttctgttccttacatttgtagccttgtattgatttcaaaaaacaattgtagcactgtaatttggtgacctggtagggggagagagagagagaagcctttttgtcttggtaatctatactttggaaatcgtcagcatactgttaaacaggatttcagtgttccacagtaccttgtctcactttctatatgtatatacaagtgttgattaagtaatcactcatttgaatacgttgttacttgcacacactgaattgagccataccgggtgcattctcctcttgttcttgcaaggccgctgcacgccatgagctcataaacccgtagcaacggcggcacaagatattgttttgcagcacggcaggagccggctggaccgctggaatatgctgctgaaccgccgttcgctttcgccactatttgttgcgtagaaatgtagaatcgcgtccattttcagagatatggtgatcttgtgtgggagcagtgctgcagcggctctggtggggtccccgacgattcctccagcccgtagttactatccatccaaaatcattttgcatgacgttgtcctctcgatctcgattttccacgttccaaatatgcgatggtagttcgctcttgtcccaaaaatggaggatagcgtacagctcagtggatattcactttttttaaaagaaatacacagtacaacagacactcacaatgcacgcatactcacccctataaaaacgcgtaagcaacagtggcggattcaggaaatcgattcgttggtgtcataatgtgtctatcggtgctatagtatgctaatcatgcttagattatggtgttataacatatgggtaaacaattttgctatagttttgccaaaagtcgtcggtgtcgcctgacaccggtccttcttctactgtatatccgccccttgtacgcaaaccctacccctataagcatcttcaaagactggaccagcaaatcaaatcctagagattggtgaagtcactttaggcgtctcactgtcgacgggcacgtcgcctactactgaaagcacaataccgttaaatcctgaaaaatttgctcccatggggagtcgaccccagcacctaaggtgctaaaatttcaatgcaatatgaatggaatgcgaacagtaagctgctacctacatccataaatataagcaattttagaatgagtacacgtttatcgatctaaatggaagaaaaccgataattgagccttgcaatatccattaaagggaaccggatcatttcataaaaagtgaatcgggattttttttttcttagtgctataagattgaaataatgatcttccgatgcttcacgaccaattttgcatgaagttgcttactctctctgttccactgtaagtatatttttaaaaagtgtgtgaggaaaataatagagagattacctaagtatccctattaaataagagctggtagggactgagagggtaattgaaggtatgatggagaaaattttgagatgtaatgcgattaattaatgtgagcaagtaatatgtgggattgtatttattttaggataaaagttaaatttaaaattacatttatcttgggatgggggagtatatagaatatgaatgttgcaaaattgcgattgttgtccatggtattagcattatttatagatgacatggtatctacattagtagcaagccaaaactagcttgactactgttactgtatttggatttaagctcacggagagagtaaaaaaactaaacgcaaatataccatcacaaagaatctgccccacctgtcggcctcctaacggctgcgcgcccaattaacgtccagatcaatcgaatcatccctcccctaaagcctaaaacctccccatccacgtcacccatcctcctccctaattactccccccatcccctcctcctccgccgccaagcacctcgcctcctccgccatggcgaccgccaccgcgtcgtccctctctctcctcttcgcccacccacactcgtccaaccccaggcccttcgccggcgggcctcacctccgccgcccgctgcgcgccgcgccccaccgcgcgcgatgcgcctccgacgccgccacgacggccacgaggcaccgccgccccgcggaggagaacatccgggaggaggccgcgcggctccgcggccccgggaacgacttctcggcgtggtacgtgccgttccccccgacgcccgaggacgaccccgacgagcgctactcgctggacgaggtggtctaccgctccagctccggggggctcctcgacgtgtgccacgacatggaggcgctcgcgcgcttcccgggctcctactggcgcgacctcttcgactcccgcgtggggcgcaccgcgtggccctacggctccggggtgtggtccaagaaggagttcgtgctcccggagatcgactccgaccacatcgtctccctcttcgagggcaactccaacctcttctgggcggagcgcctcggccgcgagcacctcggcgggatgaccgacctctgggttaagcactgcggcatctcgcacacgggctccttcaaggacctcggcatgacggtgctcgtcagccaggtgaaccgcctccgccgcgcgccgctctcacgccccatcaacggcgtcggctgcgcgtccacgggcgacacctccgccgcgctttccgcgtactgcgccgccgcaggtatccccgccatcgtgttcctccccgccgaccgcatctctctgcagcagctcatccagccaatcgccaacggcgccaccgtgctctcgctggacacggactttgacgggtgcatgcggctcatcagggaggtgaccgccgagctaccgatttaccttgccaactcgctgaactcccttcggcttgagggccagaagacggcagccatcgagatattgcagcagttcgattggcaggtgccggattgggtcattgttccaggaggcaatcttgggaatatctatgccttctacaaggggtttgagatgtgccgtgttcttgggcttgttgatcgtgtgccgcgtcttgtatgcgcacaagctgcaaacgcaaatccgttgtatcggttctacaagtcagggtggactgatttccagccacgtgtagccgaaactacatttgcatctgccatacagattggtgatccagtatctgtcgaccgtgcagtggtcgccctgaaggcaactgacggtattgttgaggaagctacggaggaagaactcatggatgcaatgtcacttgctgaccgcaccggaatgtttgcctgcccacacaccggggttgcacttgctgctttgttcaagcttcgagaccagcgcataatcgggcctaatgaccgcacagtggttgttagtacagcgcatgggcttaagttcacacaatcgaagatagactaccatgacaggaacatcaaggacatgctgtgccagtacgctaatccaccaatcaatgtgaaggctgactttgcttctgtgatggatgttctccagaacaagctgaatggtaagatctgagctttagttaaccccccatggccgttatcttgcttattgtcaccatgaactcctttttctgcatcttattcaactgcagttgatgaacttggtgtgtcacagtaatctttaatttgtagtactaggttttgaggctcttctaactatacacataagtggatagagctgttccttgtactttatatatgtatcatataatatgacaataagtggttatgccctagcacttaattgaataattgtttcgaatggatacctgtgactgcctttccgattgcttttactcactattgtctgtcaaattgtcaatgacaataagaaaccctctttggttgcatggtttgaagtctgaactgatagaatttattaaacatttcagttgctgcaaatcgctttagttttgttagtcaagaattcttttctgaaaagcataatataatccttgttctcaagacagcaagtgttatatagcaccgttgtaagtatataagaaaatagttttattagaactacatagcaatgttccatgttcagagtaaactataagtggatatcctaaatttagttcggttaaaactgtaaaatctctagtgtgctggacctatcactatttctgaatagattgtcatataggttgactgcagtaccacagtctttccatttagtagctttaagcctttaagctagattgtgttacaaactgaccaatcattctaggtggtttgaatatcctgtgacaacaaataaaatgtgagattgatctttttgagttattatcatcacggcataatgtttctagtatagcctttcagcttgattctgagttggagtttttataccctatgatattggataacattgagtttcgtctccctgtaacttactactactactacctctcttttttttatttggcgttggttagttcaaattgaaactaaccaacgtcatctaaataaaaatggagggagtaccatttagtgtttgcataactcttccttaatttggttgtttgtggcttccacttcagtttactgtgcctaaaacagtaaaggtaataatggtttcccatcagaaaccggatgctacgttcctcactggagactacattgcccccatagacccaatagttatccttgttacgtgtttatcactgcaagtttgctttgcatgtcttactcagaacataggcacattgtatattgtttcttaatcaagacacacaatcttgtataatactcacaactgtttgttctgctaaaagtcgaaggccttctcgtcagtctacagaacttcggtgagcatgatacgatggtagacttagtttatcttcgctgtgagtcgtgaactgcacaaggggaagcgaaatatttgctaaccaggtcaggtcctcgttgatctgaagccactgttattaccacataaaagtcaggtcctcgttggtctgaatccactttccttcgcaaaacggttgtctgttgagggcacacaaggaggagatgcagttatctcaacaatgtccgtcacttgagctagagctatggagtcttctgctaaccctcttactgatagttgattccttcccttccctatgttaattgtcaaggcgaggaaccgaggaatgagttgttggactgaatccagcttcacaaattgtagaattctttagatttgggctatctgttccatgtcaccttagttctaaccagtcagacatattgtgggctttgacactttgaccatgttagtgggcttatactactagtactctataggaataagttcatcggaggtctcttaacttgtcagtgaatccgatttccgtccttcaaccattcaaccagaaaaccagatataaagggtccctcaactatcaaaaccggtgcaatataggtcattcaaccagaaaaccagatataaagggtccctcaactatcaaaaccggtgcaatataggtcctatggcggttttcactgacgtggtgcctacgtggctaatttgactcggttttcatatgacgtagctagtgacgtggcgcttacgcggtaatttttatttggaaaattgctatttgtggtcccacatgtcagttacaccaaaaaaattcattcaaaaatggtgggacccatatgggccccacatgtcattcttaccccctcctcttcttcctcctctctccccaactcccctctcctttgtcctctctccaggccgggcgaggctaggcggcgcgcggtagtcgggagaggagggcggtgcgaagcggccgggcagggcggcgcgcgacggccgggagaggtgggcgg

SEQ ID NO: 8660 - DNA, 2962 bp, Oryza sativa
cctcatgcttgacggtttcatcacgccgacgccagtccactacgtgtgcaaccacggcgccgtgcccaaggcggactggtcgacaaggatcgtggaggtgaccgggctcgtcaagcgccccgcgaggctccaccggcgcggagccaacttttattcaaccgagtcagccattgttgccgaagaggggagagagaggagaggagatggggagaagggaaaaggaagacgagagtgttaaccattggacgagagtgttggggcctgcgtgggtcccatgctaactaagcttatcatgtcagctaaaaccagacgtaaatactgcctaggacctcatatgatccggttttgtaaattgtgagggactcgttatatctggtattttggtatagggacgatttcagactcgacaataatttgagggacgactcgacaataatttgagggacccaaagtgaacttattcctaccatatattggttaggaataagtccactttgagtccctcaaaatatatgtataatctaactcgtatccccaaactgtaataccggatatcttaacccctcaactattaaaatcaatgtattttgactccctcagtggcttcaaagcagtttttacaaaggtgtcatgtttacctcggttgacttagcatatggaaccatttgtcagtcacccttctctttcttctcttcatttccttacccatatttcctcactctctcacccatatttcctcatgacggcaaaatggcagcatggcagcggcgagataatagggtggtccggcaacagagggtgggagttggggactccgttgttttggcacccagagacgggcacagtagccatcgacggcagcaagttgagggagatgggtggcagtggcttgtgagcttgtctaacgctggggatccaacttccaaggagggcaaatgaaggtggcaacctgtagatctcgctgccctcgatcgacacctatagctccatgccgttgtcgcctcaaccagttgaacgagcttttccttccaaattagttgcataaacggatttctctcgatttcctctcctttccccccaagaaaaccccatcaatattgtgttaaatcccgtgaatttcggccccgttctaatcccgaagaactcaggatgaaccctagtttttcgccactgaatccatctgtttctagcccggtctctttctcctccacctatatatagcttgcctaaggtcccctcttccgattctaaccctagtccgagctcgtcccatgccctagccgcctccttgcgcactcttcgccgaaggccaccgctccagccgagccaaccgtgccaccacgtccgtcgtcatcactgtttggttcgtaagacgaaagagaatctcaactgcaccttcgcttcacttggacatcaccggagcgccgccgtcgacatcaacccgaggccaccgccttttcaagcttgttgccgcttgccgtcgtaattgcatcagtaaggatcgtcgtgttcccctcttctcgcttgtgccctcaatttccgctgtcgcaccttcgtttgccgtcacgcatggccaccgccgcgcaccaccaccaggcactgccactgtctacaagacactgacatatggggtccatgtgctaactcagctagttaacggggtcaaagatgccacattggacgaaaccacctcccaaaccgttcgaggagtcgatttgcaacggtcttatgagttggaggatgggttgtatcggttttgcggtagagcaaggtttacgattccgacaggcccttccgttccgggcatcggcggaattcggaatttcgcgaaatccggtggaaaatcggtaaattccgaacaaattttataaaccaaaatttgaatataaattccctaagttgccgacaagttctcgaaaatcggtcggttttggcgaaattctgatcgaaatcatcgaaatttcgatcattaatttgtaatagaggtaattttctgaatttttttttcattatgtaagttttagtaaatacacataatacatcttttttttcataaatttatatcccaataagttatatgaataccatagtatttataagattttattttattttttcttttttatcagttaaatttaaatttagatgaaactcctcggaatctcaaacggtttctactttcgagcctcgttggaacgtcgaaatttcgcgaaatccgaccggatttcgtcggaatcgtaaaccctgaggttgagggatgcgattcaaccaggggcataagttgagggagtcaatgtagacttgttctctctggatatgacatattgtgggctttgaccatgctattgggcttgtagcaaagttgttacactttatacccttcaaacatgataccatgcaaatatagcagtatatcgagtaggctagctaaagtttatctgcccttgctcttataaagccataaagctgcctttgatttttatttttcttttccttttctgggcgagacttccactgaaaaagttcctatgggcctgtttggagaactatcccagggatattttttgggctaaagattatcccaccaaaatagccccctaacaaaatagccctcttgctgtttggatccaaaggctatttagctattattgtaccatcccaatcatttgcctccactaaaagtatacagcagccggatcttctatggctaatccaatacaggcacatacaagcatacacaattccttacaagcacaaacacataatttgtctcaaatatataagcaagtatgtaaaacaatcgtgtcacataaaagatacaattccatacaataatcgtctcacataaatatacaattacataaaacaattgtctcacataaatattaaaatccatacaacaattgtctcacataaatattaaagtccatacaacaattgtctcacataaatattaaagtcc

SEQ ID NO: 8661 - DNA, 326 bp, Oryza sativa
tgtgcgagtagtactaatagtctgcatttctgctgcatttcgtgcttacgtacgtatacatacgcatgtttattgcgtagataaatgcaggtcctagtggtgtaccgtgggctacaatctggccacatcgatcgatggccaagtggctgtgtatactctagtagacctgggtagattcttccagctgattcacaaaaaataaattgttcagtcagggtaatactggtcaaagtccacaagtctacggttttttttcctgaaatgacagtggggattttatttttaccgtcttgttcgttgtttgctatagtagctaaattataatg

SEQ ID NO: 8662 - DNA, 1357 bp, Oryza sativa
aatagtatggtttattctatctactgtcatgctgttctgtggtggatcgtacggttggtaggaatgggcatgctggtatggtgcgtgaatgattggttgcctccgatggcagatcgagagtcctagcagttcaccatttatgattagtgctcggctgtgctgcttgactgaactattcttttggtgcttaagggggaccaacgctccttatcatgttcctgttgcttcagtcataatcagatctagagttgtagtcattccttctggtccttctggatttcatgtgggcatgtgattggtgatgactccttaataatagctcaacatcaagatccacaaggattgtcggtcccgcactgccattgcctatcaagatatatatttgaggggatttgctttaatgtgctttggtgcctagttcagggaagtccatttccttacctataaacattttttctatctagttttacttctgtgctatacctctgttttctgacttaggttttccactgtcataagaattcatatttgattttggtgcacattccaaacagtcgtaaagaaagctactatatatttatctggtgcttcaatctaacctttctatgtaatcgtaaagaatataagagatacgtcagtgcagctgtagagcatatttagctgcacactttgtactctacttggaagaataaccagcccgatggtcagtgattgagggttaacttgtgctaagcggtgcagttgttaatctgtgatcttcctggcagacatatacataattatgcatgttgctagctcaataagcagccttatcaaaggtagcgagttcaaatacttaatgaaactgtttttgatatggcagatcatgatgtttcagacaagagttctgttgggaggaatgagcatgtatgatcggtaccaggattggcgccttgatgttgataacatgacatacgaggtttgtctctttgccttgtagcatcacttttcaccaccaccaccaccatcatcatcaattgcttcgttttacaggagttgcttgagcttggagataaaataggttatgtcaacactggattgcgtgaggatgagatagttcgcaaccttaggaaggtcaaacacccagcctttgactcctcgttccggtattcaacagaaatggaaaagaaatgcagtatttgtcaagtatgccacaacctcttctcttgagttatcttcttcccttcagtcattatacagggtatccagtgtctggcatgtgaacaaacttcattctcatgtcaatgtgttgcaggaagagtttgaagccaatgaagagatggggaggctggattgcggccacagctacgggctgcag

SEQ ID NO: 8663 - DNA, 483 bp, Oryza sativa
  unsure (1)..(483): unsure at all n locations
caaaaaagataattttttaatcacggaagtatggtatgacctcagggaatggagactccacaaaatatcgattcttcttcagaacaagcttcactttaccataattggcagttgatgcatggataaaatcaattattcacgaggcagtttagtcttggagagcttgctcatgacactgattatagtgctagtctcaagcccaactgagaccgcagcatatagtgagtggggtgttagattgtactcgtgcatggattctggcctgcaccaccaaaggtcaaaatcaaatagtttaacggaaaatcagaaaccctttgacaaagtaatacatttcaggcactcaaccatgcacatatactccctccattttttaatagatgacgccgnngactttntctcacatgtttgaccattcgtcttattaanantttttatgcttatgtatgagatataaatcacacttaaagtactatgagtgataaa

SEQ ID NO: 8664 - DNA, 2444 bp, Oryza sativa
tcctgcagcctacatcctaatcgaatcaaaatctcaaaataaaaagacaaaagagtcaggttctgcatcaatcagagccgcacgtccaccctaaacgccgtcccgtctcccgtgtggtcgcgaggccgtgtgtgaggcagcgagccagccagccagccaagccaaggcactcgagatttcttcctgctccagcgcccaaagcccggcgcaaatcacaaccttagtattatttcctcctctctcttcccctccctcccttccctcttcgtccctcctcccctcccccccgccgcgatcgagacggcggcgaaaccaacaccggaatccgaggggggatccgccgcggcttcgctaccctagcccccgccccttctcgaatccgcgccctaaaatcccctttgcctccccaccccacccccgggcgcgccgccatccccccccgcccccgcgagcccctcccgatggatttggatctgtggatctctaaggtgaaggagggccagcacctcgccgagcacgagctccagtccctctgcgaatacgtgagctttcctcccccccgccctgtcccccgattggttcggttattagggtttttgccatgccccgtgctctcgcgcggcggcggcggcggcggcgcgcgtgcggttgctagggttcgttggtagggggtggacgtggggggaaaccgttgccttttgctttccgtactgaacttgagttttgttatgtatatggggtcgcgtgtaaccgcggctgatttccctgatctttccaggtgaaggagatcctcatcgaggagtccaacgtgcagccagtgaacaggccggtggccgtgggcggaaacaacccatggcaggttccatgccttaatgaagtttttcgcgactggggggcatgtgcccgagacgaattatattttcatggtgtggcttctggagcattttgtgtttatgtgtttctgtgtgtgtgagcttgttggttgagatggttctggatgatgctgtgttcctgaattcagctgtgcttcacgtgcagggtgattttgtagaccgcggcttcaacagtctggaggtcttcaccattctgttgctactaaaagcgaggtatttgcctacctttttgtttgggatcgtgaatgttctgtttgtttgttcgaaagctttgacctttctggcacatagctgcagctgcttcactgttccgtttggtattacagtacttcgatgttatattacctttttctacagggacattacatgaaaaaatatgtgaatggttgcagcagtagtttaccttccttagatgtgaatcatgttgttgtatggtcctgcctgtcgtttgattatatgccaaatcctgttgtcttttcattactgccttctccccttattttgcctggataaccttgagcaatgtatggggtcaatgtgttgttctatacttctatataatacaaatagctcccaggagttgaactgaaatgctgaatagttgtaggatgagacacactgtgatctaattgtggctcgtgcaattgagcctagttggctgaattttgaaattggtattcctgttgttgtttcacaacttggactgctaatttgagtagaatggttgcactgttaagtagtgaacaattcctgtaagactccctagtccttgctagtttcatttgttcttggttgcactcattttctcaaggattctgatttatagtttgtacccaagtgttactatctgtggctcattcttgctattgggtttcctgattgtgattaggtaccctgcacacataacgcttctgcgtggaaatcatgaaagcagacagttgacacaggtatttcctggtgcggacaatgttttcatttattatccaatttatttcttttcttgagatttgagatacttatgttgcacttttaagtgttgtatctcaactgctctgatgatttatatgttgtatctcaactgttgcatccaagaggtcctgttttagttgtttgttggcctgtacatgcatgtatgctcatatcaaacatttgtaggttttgtattaattatctatgagggtatcatgcgttggacataaatatgcatagctccattacatacaattctgattctggagatgtattaactcgtattgcttttctgcctgagcaatgtcaaataatccggtcattatatctatgattttcccttggtttcatgttcgtttcagtgtatgcacattggaatgaaatacacgcacatgttgcatactagtgtatctttagttcctaatcagcaccatatgatgagcaacctgtgttgtcatccttagattttgtttaatgagttggaatatgttttttacatggttccttacgtttcctttatttgtacagttcatcctcctgacagactttgtgctcatatatctgcactacacatgtatttgg

SEQ ID NO: 8665 - DNA, 2409 bp, Oryza sativa
aatatatactttatatctgactgtgtactattagaaattagttggttcatagctttgcatgttcacaattttttagtaagacatgattctgtgatttgttttatcttaagatatattgttgtcagataagaattaaaaaccgtctcaacgcaatattacaatgaaattaatcatgtgattgaatatccttgttaattctattgaccagattcggacgattgatcgcaattgtgaaattcctcatgaaggtcctttctgtgatctaatgtggagtgaccctgaagaaatagagacatgggctgttagccctcgtggagctggttggctttttggatcacgagtgacagctgaggtatgtacagtcatttgatgatttcttactctatttttcagagagtgtgtacagtcactacattctggatcatctattaattgtttccttgtaaatgtttttcatctaccttttgcagttcaaccatattaacaatctcgatctagtttgccgagctcaccagctggttcaggaaggcttaaagtacatgtttcaggacaaaggccttgtaactgtaagtttctgttcacatgtcagtccagataatcatagcattgtactaagcttgtatttcttttttcaatactgttatattgatgctcacataccctgcaataccttttttccaggtgtggtccgctcctaattattgctacagatgtggaaatgttgcttctatactaagcttcagtgagacaatggtatgttgtgcacctgtggtggaagcattatgtaattgcatcaaacttcatataggagtactaggatttgctagtgcacttgtgcacacacaatacagagatgaaacagcgctaggcacccaactgcttttgtgtgctcaacaataacaaatgccaccccatgctatctataatctactcagcaatgaattaacgatacacagcactttggtttgactactgattgggggaaacttaagttggactcaagagcaactagcatattcgtttctagttgtgtaactgtggccacctcaataaaccattcctcagggaatagaagttccaattgaacttagctcatctacaagtactggaagatttcttgctactagtgtgaaattgttatcttatctgtggtctgactcttgcattagttgatctgaatatgttaacatgtcttcttttgcaaatactgctgtgaagtatctgatttgtttcatgagctctaaggctcgcagctgattctgatcttttatatcctttgtctaaaacatcaggaaagagaggtcaaattcttcacagagacagaggagaataaccagatgcgaggaccgaggactgctgtcccatatttcctctgacttcatcaattgtacaattttagaagtcatgtttttatctgtaagggttaaagatgaagcagacctatttattgttgtaggtccaggtcatagtgcaatctaatgcgtatgatttttctgttcttttaaccacatgtacaatagaccatttggagtgtcatcactcctgtattccttctgtggcgttgtcaagttttgtttctgatttatttcgggtcgacacagtttgccacacaggaggtttgggccgttattgtgttatatttgcagctacagcttcccactcacgtgatcagataggcctgccccgtgacttcaaaatttgcatgcgatttgcgcgtaggtcgtatcatgtactactttaatattataagttattttgacttttttagtttagcattttaagttttattaaatttatagataaatttagtaacattgagaacactaaattagattcaatgaatatacattggtaatatgtttgttctgtgttggaaatgctactttatctataaactcaatcaaactttaaaaatttttattagaaaaaagtcaaaatgatttatgaaatgaaacggagtacactatcctatctcgtcgattatgtaagattgaccacttacattcggacacgtttatctcattgaacttgttaacggatgatgaaataagttgcatttgtgcaagtcacgttgattctctacatgatttatagtacgatagtacattatttgcacggtaaacttgtggcaaatccaaatattttctcaatctcaaaatataaagctctaaacacaaataccataagagaattattatcatttcttcgctttggtcacctcaaggctcaagcacccaatggtattagaaatattaagagtgaaggatttaaaaaaaaaatcacctaatggtatcaaaggtactaaaggattaaaaaaacaaatttacagtagagggatgtgctagttaattatacgtgtatataccatatgttatgagacattgtgaaaaggttattcgtcttatattt

SEQ ID NO: 8666 - DNA, 22007 bp, Oryza sativa
aaaggttattcgtcttatattttgaaataaagggagaagaagcgcctcatcttttcgcttacacttatccttatcatccaaaatttgaattttcaaccttaaaatttgaaggtgattttaaagtttctttatcaaagtttatttttcagcatttgcttttagatcactaagaacacgtatataaaagttttattcacgtattatttttcgtttgtaaatatgtcgttggtcttattctgtaggccacaaaactttaaaataacctggttgctattgctatcaccgttagcaatccaccaacgaaataatcatggctttctcttgaaatgacgttccctcgttgtttgcgtgtaaactcaaatagttatggaatggaaaattttgagaagatctattaatatatgatatatcactcctccacaaatatgtaagttaaaattttacttttacaagttgaaaaaaaattaaactacaaatattcaccgtaaaatttgtttttttcattgtaatacataaaagttaaattttaccttgtatatttttgattgatttactacgtattaacctatccttttttttcatgaccattactttgagtgatatgtagataatgagagatgtctcctggagagttccctttttctcattcgagccgaagcccacttcccattgcctcccgtggaggaagcggtggagccactcagccatgggatgacgggaagccgctgccgccgcctccgacgtcgcgctcgcattcttcaggttcgggggcatcgccttccctaccgctcgtgtgtctttctgttcttgattacacgtgatatcgctgaagattttacagtacaaccaccgtatatatagctcccacgtaccatattctcctgtgctggttccactgcaatctggtataggatggagccgagcatctggaagtggcagtcttggtcgcggcgggcggtggcggcaagcctgataactatagtggtatacctggtagtagtagttgcttgttcgcaacaaaaccagcgcatatgcccggggcgacgcgaccctccattgcgccggtcgcgggctcgcggcaacgaaaagatccctcacgacgcacgtgacgtgagccatcgcccgtgcccgtgccgcttttccaacggcgcggagaaggcatgcccttccgccgccggtctccctcgtccacccgtaacgaacaaaagaatctcgcacgcacgcacgggcggaggtgcaacgagtgcattgtggggggttggcacgcggccgcctcgttgccgcccgcgcgcaccgtagagtcaccgagccgacagctaccgcgtgcggctgcgtgactgcgtccccgccctgccgtgattccgcagcgttcgctgcttcgcccatcctctgcctgtgcctggttggggtggtttggccggcgcgcccgcgggcagcggcctcggatcatcctcacgtgatctcacatccgtggtgctggttcgctgctgagcctgatctcacgtcgcttacctgtctgtcagggtcgggtcgcgccggctgcccggttgctcacgacaagtcaaacaccatgtgttaggctgtgtttagatttaaaatttggatccaaacttcaaacttcagttcttttccatcacattaacctgtcatgcacacataacttttcaatcatatcattttcaattttaatcaaaatccaaactttgcgctgaaagccttagtaccgctgtgccaaccatcggttcggttgccatcatattccaggttcgagcattttttttgcaaaggacattctcctttgcaaccgttcaaaactctcaaatcatgcaaactcgaaccgtgccagacatattcctcctgatattgattcctgaagaaggggggcatcgcatctttcggcaccctgatttttttccctcgatactcatgatcattcaggtaggggcggcggtaggaaactatttcactgttcggcttgtctgctccccatgatttaattattcattggtctttgattaaaaacgaattaaaagctcaccatgttcgcaactgcccaaagtgcacgtatgtttgactagcaacggattactctgaacggtaagcagtttaacccgctgttttccaatttccagcctgtaatcaagagagagaaagaaaaccagtgatccactgttcttacggaacagttacatccagcgaaatattggggatcagttatgatggaagaagcagccgataatgcagtgctatcgtctcgtacgatccgcttgtgtgcgcgcgcgcgcgcgtgtgcaacgatcgaacaatctggaaccagaggaaaatgatgacaatcggatgtgcattgattagcaacctggccttgtttgattggggtgtgatacattgggggtggccctcttccttggcaaaaaatcatcttcttttttttctcctaatcatgagcttaggcactaaccaaagatcgatccacttggtggacgatctggtgatagttgcagcaaaattggtgcgaaatgatgggagaaataaaaatgctaactaacttgcactatcttctccgatcatgagggggtggttgctgctgctgcggatgcggtggcgccggcgacggggatcggcggctgccgcttggagttggagacgtcccccgtggccggaactcctggtccgccattgcgcgcctgggccgtccgggccggaagtcaccgagctcggcgtcggagaacgacgacgaccccccgggcgcgaggcgccgctgcggcctccgcctcctccaccgccaccgccagcaccgccgcgcgacgcggacgggcgcgcgcgccacgcagcagagcgccgccaggggcaggcacgcgcacagcacgcagcacgccgccgcgcactccgcgagcgccgcgtccttccctccaccggcgcccacgggtggcgccgccggagacaggtcgcgcccgcgcccgcgcccgcgctcccgctcgtcccctcccccccgccgcttcttcgccgccgccgccttcttcttcctccgcggcgagccggctgcgtccatgcctttgccctgccctctctgccagtctactaccacctcgcgctcccttccctctgccttcgtcgtggggagattcgattgggttgtgagttgggacgaggcgtgggaggtggagacgagaggagggagtgcttctcgcctcggttgccaatactcctccacgtttgaacgacaaacgcctccacgcaagttttttttttctttaaaaacttttttaaactgatcttaacaacactggtcagagatagaatgggatatcggtctctttttaattgagcaaccgaaagcctcacttaagtgagaatagacctggatatcttttctcaaagtagtctcattttgaagaatctggtttattaatacgaccatgggtatgtgtatgtcacttgtttaattaggtttggcttgtttatgccgaacaatttggagtttggtattttcctgcctgcagtggatcgatcggttatagatatccggtcaaaacgcagtcacctttcagaacggcacaagtgcggttactatttgcaggaccgcgtgacgactggctgccacgctactaggcgctccacttggccggcccccggcgctttgctttaaggcagtgtcagtgtgtcacagggtggttagttcaggggtcctatcttttcttttccagctgcaacaaaagtagggttgcacacttgcactagcttcagagaaaagctgatagcgatcagcaactagcaacttgagcgaggtgttaccgtgttaacactttgataattgatagagaagcaaaatggcttcgctaacgagaaaggaggtccattacgaagatccatggtccgatggccaacaaaattcgattggcctaaaattagaaaccagagctactcacatctattttacgtaatatttgtgagaaccatgatttaaatccttgtgaaggtagtcatacatcaaggtatagtccgtaacaaatcatgttgagaaatggccacgtctagataggaatggccaatggcccaactggcccaattaatttttagttttctactccgaacgttgtattctagcatgtgttggtttggagataagatggaataggttagactcatccttgttctgacggtctcatctattcgtttggcatgagggatgagattatcctactttttaaggaacgatccacatgtctgtgagagagaaaaaatgggtgggattgatccattagtttttaggtaccagatcaaccttaggggaatattctctgttagggatcatcccatcccacatgtccctaacctaaacagtctaaaaaataggttcaacccaatctgacccatcccaacctttgaaccaaatgcatagtaactaaattgatccactacttaaaaatcctaatatgatatcctcatatgtgccatcggttcatctaaaatcagcacatatggggtttttcacgtcctattgatcccttatatgggtctaaaattaaaaacctgcaccaacaacacttgtaaatgccattttttaaaagaagacatttatacgtgtgatatcattgccttttccttaaaagaaaaactaacacattcgagggagttgaaccaacgaaccaagcctggcactagtttttatgcctcggaatctccccctccgcctcattctctctcttaactgccgcgagctcaggagcagccccctccctttcccctagcctagctgtgccgcacttccatctccctgtcgagcaattgtggcctccttgatgtccccacgcctccctcgctcccttggcctccttatcaccatgggttgctggttcctgtgagctcggcgctagattcgatcaccgagaacttggggatggctagatccacgcgcaagtgggtcactcgatgtcagtgagcgagcgggcagacttcacctatagcgagtggcggcacggatgggaccacgactacggaggtgaccactagcagaatcggtggctccctcccccatacccttggcaagttgattttttatggattcggtaatgatttgttggtttttccgatctcccttgttgatgttgttttctcctttgatgctgaaatggataggtaatacttggatattagatggattctgatttgagtagtaatgcatttgtgccaaaaatttgtgattcactttctgtgatttgcgatgttgataaataatttgtgattgatgaagagcaatttgcgaaaaaaaaaacttgaagcaatcgactcgagtcgattcgtcttttttttaaaaaaaaaatcgtgcacctcatctatgccccctcatatctgtacccttgtgatcacactgctgattgagcaaaattatacttgtacacactaaaagtcgcctcactattttgctctccttttattcaagatgtacacatttgcattctgaacaccgctcaacagagactaacaaaatattttcacatgacacagtaccaaacaacttcttcatcgtcaaagcaggcgagcaaggcagatagattgccattaggtagaaccagctggcgaagccaatttagccagaaatcccttgtagtgctccaggagcttcccggcgtcgggcatcgcctcccggacggcgtccaccgccaagaaccgctccgcccacgccgccaggcccgggaacttggcctcgtcgaggaggctggagccggccacctcgtccaccaccttgaaccacaccacgaagccgccgaccacgacgtcgacgagcccgacggcgtcgccgccgaagaacgccttccccttggagcactccacgaacgctcgctccagcacctccacctgaggtacggcgttcatgaaggcctccgctctctgctccgccgtcgtcgccctcatcagcgccctccacggcgggaagaacttaatacagtatcaaaacaaaaatgtcgatctctctaatattgatttctcaatcaccgacatgaacgttgctatctatctaaggttgatttcttcaggaagatgccatcgattaccgtgctgtcgaagtaggtcgcccagaagcgagcggtggcgcggtcgtgggggtcggccgggaggagcggcggcgcggccccgggccaggcctcgtcgacgtactcgagaaccacgcgcgactcgcacaccggccggccggcatggatgaggacggggaccttcttgtgcaccgggttgctcttgagcaggagctcgctcttgccgaagaggtcctgctcgatgtactcgtagctcaggcccttgagccccagcgcgattttcgcgcgcatagcgtacgggctgtaccatgtgcccagcagctgcagctcgcctcctcctcctcctcctcctcttcccgccattgctgccgcgaactgtgtgagtatgatgctgttgttgtctggatcggttttacggtttgtgtacaagatgggtataactgtatgtctttataaggacatggcgaatttgttaagttcatctatcaggtgattagtgtgaggtttgagtgtttgactgattttagttaagctgtgtaagcaaagttggaatcggccggcgagtgcgcggcgataggagattgctccgtgccgttgctggcttggagaaggggccacaggccacttgattccgtcagtgttgattgcgatgttgtacatgcgtcgaccaaacgtgacagcagatgatggagttggtatggccttgactagtggatgaatgattgagcttgacgaggtgattagttgaagtttatttttactgttgtagcagtagtagctacgtacttactccgtcccattttaattgcaaccatagtttttcgcgttcaactttcaccattcgtcttatttaaatttttttaaaaaaatttaaaaacataagtcacgagtaaaatactatttatattttattatctcataaaatttatttaaataagacagatgatcaaagttagggcgtcctatctgcggcagcgctgcggctgcaaaccttgtgttgtgcggctgcagctgtgctgcttgcagctgcagctcgctgtcgtgtggcttcaaaaagggcagccgagcaggcccttggacgcagaaatttatggttgcgctcaaaatagaacggagggagtaagataatacagtatatatcgtatattggtgtctgtaactacttccagtccacgatttcaaacatggagaaccattttgtcatcctccaaaaatgtcttcggacgcttaaaaggaacaggaagtggatttttatctcttaacagaagacatacgctcgttttgtacgtgtcatcaaaaaagttttaaaatttttgacatgatagatcaatctgtcataccaattctttttttaagactttagatgattttttgggtgacatgcaaagcgaggggatgtaccttaaggatgaaatatagttttccaaaagaatgcaacttaatggaacgatacgaatttcgtgacaaggaagaacgatatttgccgtttaaaagtgtgcttagcaaatcaactaagtggttcgtctagaaacactaaagtagttcactgaacagcgtgtcaacatttccctccttttatgaaacaaaaaagaaaactgttattcatcacgcgtgtcaacgtactcctcaaagtacagatccccgaagcagaaagtattttctacacctagaaaatccacgaagacgaaagcaggcaacgccgttgtgttcaggttcagctcgaaccagcgcctgcagtccatttggccaggaaccccttgtactgcttcagaacatcgccggcgtcgggcatcacctgcctgacagcgtcgacggccaagaaccgctccgcccacgccgccaagcccgggaacttggcctcgtcgagcaggttggcgccggccacctcgtccaccaccttgatccacaccagatggctcccgagcgcgacgtcgacgagccccgcgtcgtccccgccgaagaaggccttccccttggagcactccccgaacgctcgctccagcgcctccacgcgagggacgacgttcttgaacgcctcagctctctgctccgccgccgtcgacctgaacagcactttccacgacgggaaaaactgcagaaaaaattgcaaaggaaatcaaccaatcaaacagaattcctatctgccgttctgatgtccagtcattataccgtgtcgttgacgtagttggtccagaaacgcgcggtggcgcggtcgtagggatcggcagggaggagctgcggcgtcccggtggctccccaggtctcgtcgatgtactccaggacgacgagcgactcgcacaccggccggccgccgtggatgaggacggggaccttctcgtgcaccgggttggacctgagcaggtggtcgctcttgctggagaggtcctcctcggtgtactcgtagctcagccccttcatccccagcgccactctcacccggatcacccacgggctcgaccacgtccccagcagccgcagctctcctcctccaccacgtcctgccatcgcggactcgtgaatcgtgatcttgcactgaagtctgaagagaacgagtgtatatattggctcagttgatcatcgggtatgagtagcaagttgagtggccagtgagtgattccgtcagcgctgccgtgtgccgtggaaaggaagaagacgagatcgacggagtggaccagctggccagtgggcattgggccactgcatccataggttgattcagctttggtcgcgtcgggctagtagtccaaaggagtaggaagacgagaaacaggttacaggggatcgagagttcgagacggagcacggcagcaggcattgcgcagctgggccaacgggcctgcgttcggagacagagggattgcaggttgaataagttcactttgactgccttgactaaccgggtatcttgaccctccaactattaaaactgatgcaatttgtcttcctcggtggttttgaagagcagtttcgctgtcgtgcgtctacatggtggtgttgaccagttttcgtcctacgtgacattgacgtgatgcttatgtggcatataaaaattaaaaaaacataaatgtgggcccactaacattctctctctactacgtcatggagctcgagctcctccttcgccgcgaccattactccgctttcatctgctccttacccacccctcctctcctcagtgcacctcctccgctgccacggcaatgccccaacccccaacccctagtgctggcggcacgccagttccctagccccctctccgcctctccggcacttgctggtggctatcgccgccacctgccaccccaggcccatgccaccgctccctcgttcgccaatcggcattgtcgatcagggagagcaggagagggaagggagatataaggggtacagtgtcaacgagtatgacaaatgggtcatagttttttctctctctagtcacttacatatgggcccacttctaatttgtgactgggctgccacattatcgtaggggttgaccaagtcaacgagccacgtcagcgaaaacactggttccaatatagtttaagggtcaagaatcaagatatatggtattgtggttgaggggtatgaatcagattggagcagtatttgagggactcaaagtgaacttattccattgcaggttggggacgcccggaagtctggaacgcagagggcatatataaatagatgcataacaccaagatagtacatgtgcaaaacgagtacgcaatgttggttgatgtctggccaccgagccagaaaggagagcgttgggcttagcccaccaaagcccacgcgatccctaacattgaggaacgagtctcacgcattctctcacacgtttctctctttagctttatgatcggaagcgtcattttcctcgagaaggaatcacccctgatcccctcaatacgcataaaaagggaaccttaaccccgtgcacgagcgacgactcatgtacgctaagccaattctccaaaccctcaaactaccgattttaaggcgtgttgaaggggagtgaagggcgaattcccatcgccgtcactgcatggtgatcttcatcaccgtcgcctcacaactactacaccgacgcatctaaggcaaccatatggcttcttcatccggtcagtacaccatcaaattctgtataagagaaattaggtgatcgtgcatagcctaagatcatgattttaagatttaactccaatacgcaaaagtagaagaaatgttacatgatacgacgatattttaacgaagcccctgtgtgaatgtgcaatgaaccgatgattcaatggtcactccgagttcacagttttgatcgatgaatctcatgtactgacgcacgtgatccaatttttgctctaatctatctctgcaaaagacacatgcgtgaacttcaaactacagcatcctcatcgacgaaacgaaatacaaaccactcgcaaggcagtggccggaaaatatctgaaagataccgtttgtcgtactccttttcttctctattcttctcagtacttctaaacttgtactctaatagtattcaacaatccacgtcaaggttcgtttggtaaaactctaattcctaaaatcaggagttagatttaaaggagagttatgaaggagcctaaacctatgagggttttttactgttgaggttgtgcaataccaaatcctgaccgttgatctagcatcattcaacggttagaaatcatccgtacctcatggtactgcacctcctcattgaagtggtaccattggtggaagggtatttctatcctttcctgtttcacgagaggaaaaatcggggagagcagcgagattgcggcgagaggcgcggcggctcggtgcgacggcaatcggcgagaggcgcgacggtggcggcagcggcgggctcgatggccgacgccggcagcagcggcggtggcggcgacggctggatgcacgacgacagcggctggatgcgtgacgcgtgacggcgacggcaacctcgatgggcgacgacggcggagggttcgatgcgtgacggcggcgctggatgcgcgacggcggcggcgggctcgattcgcgacggcggaggtcgatgcgtggcggcggcgatcaatgcgcgacggcggaggtcgatgcgcggcggtggaggtcgatgcccgacggcagcggtcgatgcgcgatggcgggggtcgatgcccgacggtgggctcgatgcgccggcggcggtcgatgcccgacggcggcagcgagctcgatgggcgacgacggcggcggcgagctcgatgggcaacgacggcggcggcggcgagctcgatgggcgatgacggcggcggtcgatgcccgacggcaagggcggcgacgagctcgatgggcgacgacggcgccggcctcgatgcgggacggccctcgatgggcgacgacgacatggaagaatggaagagagacctaatttttgttagcccaattatacccctgttaaatcaacggttagattagattggtacctcatgttacctcgtacctcatggtacttccttaaggatgggaaagatgctctaaacctatttctatctctctagtttattttgtgagagcgttttatccagctccattcctattttggatgagctgaaactatttagctgacctccaactctaagagatgcttttatttggcgtaaattgagcgttgtaagttattggctagtcagtttcaaaataataacaaaaaattattggctagtgaaaaccaacaactgcgaagttcagacaagaacaaggtggataatataacgggatcgacatgttgtgtacttgtgtggtagtgagctcctctagtcatgcaagcaggatagacccgcgagctgctacacttgtcctcatttaccaacacacaagctctcccttgtcttaactgttctccaaacaaataagtacttccaagaatttttcgttcgaaagattcagccttggtgcaattcaccttttctttggtgcgataaaatggaggccgccatcaccatggatgagaacttgggacgaagtgggtcatttcgagctgcgatgagcatctttggcgaaagcatcaacgggaggaaggcagacaagaacagaggaactgttccagcccaagaggtagtgtctgaattcacacgcttttctgattcttgtgaacaaacctcaagttcaacagttctcaatttcattgtatttttatacgatttctgtaaaaacgcactgtatctgtatctttatatccatttcggtatatatatgtgcagaatctgtcttctgaaatgaagcagctagcacaatccggtctggacaagctgaatgaacgcaaggcgtacgtggataaagagagagccggcgccgagtccgagctgtcgagagcgcgagccatggcgaaggagcttgagcgccaaatcgagcagacaacggccaaagccacgtcccagaggtcggagctccaagcaatgtgggcagcgaggacgaggaggaagggcaccgacgcaccgggcgcggagcgcgacgcgcggtacgcggaggtggtgcaggagctggaccaagccaagaaggagctgctccggctgcggctcgaggtgcggtccgcggcggaggccaaggcgaaggccgagcgcgacatcgtggcgtcggcgtgcacgatccagtccagcctccgcgccatcgacgagatgaagcggcgggtggacgaggcgaacgaggagcacgtgctggtggagctggcgcgcatcgaggccgagcgggagcgccgcgagatcgaggcccagcgcggcgccgaggccgagcggttcgccgcggacatcgaggccgcgagggccagggtcagggcgctgcagaaggaggcgagccgcgcgagggagatggaggcgaagctcgccgtgacgaactccgacgtggaggtgcttcaggccgagatggagctggtgcgcgccatggagaagagccacgccaagagcgacgaggcggcggaggacgcagcgaggaggaagaaggaggaggcgcaggacaaggcgctgctgaagaccgcggaggccgagctggacgcggcgaagaaggagctggagacgatcaaggccgggagcttccagttcatgacgtccatggactgcacgcgcaccgagatcatgcgcgtcgccgaggagatccgcctgctcaaggcgaaggaaaagaaagcggacgcgcaggtgcaacagctgaacaccaagctcctcaaggcgaaggcgcggttggaggccgtcacggcggccgacgagaggtcgaaggcgatcgtgtccaacttggcggcggcgatgaagcaactgaaagccgagacggaggcggcgaggatggaggaggacctcaccaagctggagaaacggtgcgtgatcgcggaggccgagaacatcgagaaggagatcgccacgaccgagggacggatcaagcagtcggtgaaggagctggatgcggcgaaagcgttggaggccgaggcgatgaggaagctcagggacaccgtggagagcacgatgcaggccagggcgtcgtcggcggcacggcggcaggggacgatgaccatctcccggttcgagtacgagtacctgaccgggcgcgcggcgctggtccgggtggtgaccgacaagaaggtggccgcggcgcaggcgtgggtgcaggcgctgaaggccagcgagaaggaggccgcggcgcgcgccgaggcggcggagcgggaggtgagggagatggaggccagggcggcgcaggtggcggcggaggcggagaagacggcggcggagcagaaggagctggagcaggagctgtacgacctgaacgcggcggcggagagggacggcctgcagtgcgcgtacccgcggcggcggtcgagcagggtgtcggcgacgtcgaggaggtccaagccccggcggtcgtcggtgtccgcgggcgcatggaacccgcgctcgccgtcgttcaccatcaagaggaagaggaaggtgatgcccaacctcctgaagctgatcaagaataaaagaggcggcaaaaagaacaccaactgatcgagctgcgtagattgtcatgaccgctcgcgacgctgcgaccgtttttcttgttctgatttccggcggcgcagcacaagaatgttttgatcatcagtttcgcgggattaatggcactgatactgtatacttgggctagatgtaagtacatattaagctggccatccgttcactacataatgtaacctgcacgttcctaaatggatggctggacgtcaacaagtgacgagttttgtgtggtctgttggataggatggatggcttggatcagttgttggttattgccctagcagagttaaaattaaactcgtgttcatcagctttaagggggctttgttgaccttgttacccaaatcaaccataccatattttggtaatctatttttttttcacattttggcattatcgaatttcgatagtgttggttttatttactttgttttgatgtatttgttaaattctggagggctgctatacaacggaatcccgttttcgaacgggctgctatacatgtatcgtgtcttgaaacttaaccggtatcaagtgatacatataaagtatcaaatgatttctaccacgtatcggatgatactcgtgatatatcatgtgatacctatcagatatcagacgatttctaccatgtattgggtgatactcgtgaggtatcatgtgatacctatcaggtatcagacgatttctcccacgtatcgagtgatacttgcgaggtatcagatgatacctaccagatatcaggtaattcctactaggtatcaggagctgagcaccgaggcgtcgttgccggcagccccaccctccacgccccatgtcggaggttgtcgccggcggccgcgtcctctgtcgtcgacgccttatgtcagaggtcgtcgccggcagccgtgtccttcgtcatccacgccccacgtcggagctcgtcgccggtagccgcgtccttcgctaccacgccccacaccaggcttgttgctggcggtagcatcctctgccgccacgcgccacgccgggctcgtcgccggtggccacgtcctccgctgtccacgcgctgcaccacgtcggagctcgtcgccggcggccacaccgaagctcgtcactggaggctgcatcttccgccgtccatagccatgcgccggagctcgttgtcggaggttgcatcctccgccgtccacagccatgccacgttgggagctcgtcgccggcggccacgccggagctcgtcgcttgcgaccgtgtcctccgccatccacaccccggggtgtgccgcaccgagctcgtgcagcagtcatgctttgagagagatgtggtaatatggtagaatagataaggtagaagaagatagaatcgatggattggttggttgctaacttatcccatccatcatggttgggacgggatcccgtcatatagcacttctgtaaattctgatagagtttttaagagaggaagcttctagaactgcaaaatttagtaaggactctagcgctagcccgggcgtgcttctttccggaccatgcgtgcagcacgacaggtcgacgacagctgcaaattaggcaaattttgttggcttatttccgcattccttcccgttttaatgacctcacacaaactgttcacacaaagatgctcctcgcgaacacagatttccggcccgatctgtacagctacttcatacgtgttgcttgttaaggcggtgaacgtgtcacgaaattcctttcccgttagatggcgactgccacatagacgagaaaattgacatttagctattgtcaaaacagggtttcgctggaatgctaccctcaaacagggggcaacatgttgcaatgctattccatccatttcttctcagtttaatgttttttattgctgagatgaccaaaatatccttgatcctatctcatctctcctctctgtcttcctcctctccgttcggctcggcgacgcagccagaaacggggatggtggtggcgcggccagggacggggacggcggcggcgcgcccggggacggggaacgcggcggtgtggatggggacggtagcgacgcaactggggatgagaaggcggcgttgcggatggggacggggacggggacggcggcgacgcggctagggacggggacggcggtagcgccgacatggttggggcaggtgggatgttctcctacgccgatgcagatggcgccgctgagccgagcagccttccccaacccacgccggtgccgtccctgtccccagccgcgccggcacctcatcgccgacccccatctccatcctcctcgacgacctcctccttgagtgcctcgccggcatcccctatgcctccctcccatagctccccaccactccaccacgcccatcgcctaagtcgcgcccacggcgagctccgcccctccctcctcgccctctccgtcgcgtccacggcgagccgacggatgttggcgtggtggtggtgacgaggatgaggagctggcggccaccgactcgtagctacgccccgtcgtcgctgccgctgctacactccaccgccggcgaccggatggggatcgatcccttttctcctttcccctgcaaagtcaacaaaatgactaggggcaaatatgtcagagcacgataaaaaacatttggaaatcagttaaaatggttgaaatggcattctagcaagttggcttcatttgacaatgacattataacaaaaccatattcgggactagcattccagcgaaaccccatcccgaacatggttaaatgtcaattttctccacatagactggcccatcggtcagtgtcaccaccggccttcgatgttgaagcggcgcaaccaaagccggagaacgcagcagaggcggccagagcgcgagggactccaactccaaccgccatgccgctcctccacgcggccaacctccgcgtcctcctcgccggcgccgccttcgcgcacctctcctcccccgccgccaccgcgcgcgcctcctccccgtccgcccctccccctccggctcccccgccgccgccgcgcgtccgggccttcgcctcctaccgcgcctcgccgcctcccccgccgccgccccaaccatcctcgccgtcgccatcccgcgccctcgcctccgcggccgccgcgtgcgagcagggggcgaagcccgcgatctgcacggcggatgagctgcactacgtgcccgtgcccggcacagagtggcggctcgcgctctggcggtaccgcccgccgcctgaggtgcgcgtgcttattcccctcccagcggagagggtggcggctggttagtggttatggttgttgatttggttctagcttggtttgtgcaggcgcccaagaggaatcacccgctgatgctgctctcgggagtggccaccaatgcgattggatttgacctgtctcctggggttagtatatctatatgatcctaacttgtggagttgtgtgcataatcgatcggcaatgagtacttttctattcttttttgacaaaaaaaatatgaggtttagttaatcgctacaaatcgcttaccgcttagttccagataggatgaatgatttaatctgagtataaattagcaattatcttgggaattagggattaaaattcggaaagagctgatcattgttgttacaattttatagttctgtacacttaatgtggagaagtaactatgttttggaacaacagagaatttactccatgctgtaaatacactgaacaaaaataagttggaaaacaaatcgctgcagtaaacagaactttctggaccaactagtgtgacaatgcttccttactttgcaatgtttaggatgcaataaggctccaaatgctgattcaagcatggcacaaagcagatcagcagaactagggaataacgaaaatttaaaaagtttaagtgcatctcttatgtaatttggtggaaaaaaatactccatttttgacagctatgaaatttcatgagaacagaaactggggttttggtgcataaaagatagcattaaagctacaatacagctgggcagaatttcttgagtaagaatctcgcggacatatcacacaattcagaacacgagtttgtgcaagaaaaaaaattgcatagatacattggtaaaattgtacacatcttccagtaaaagttatgctggtgcgccctacttcaggcttcagataaaagatgtagtagttgtgcttttatagcggtaagtttaaaaaaacacatgttttggggcattttgcttactcttattttaaagatacctctgtttatttttttctaaaaaaatgtaaatgtatttcgttttagaagtttgtttactcatgccttggtcactgtctgtttgatattctatattgtttactcataagcaaaaattgtataacgaacttgttattgccggtcatggttatagaattctgtttatattttcccttgattttgactataataattttgtcaggcttcatttgcacgtcatatgtccatgcaagggtttgatacatggattgtcgaagtgcgtggtgcaggcctgagcatgcgtggatctgaactagctgtagctgacaccacatctgacatgtctcgaagttctgcattggatgagattactacacagaaattaaatggcgctggacctgccaaggatgattccacttgtctagctcaaaatttcgaagttccagtagtagaagataaatttgaagttccagtagtagaagataaggatgtaatagagagtaatgcattagaagaaccacagctggtgacaaagttatcaaatactttggcacgattgggtgatacattctcaggttatgtaaaagatagtcgactgagaagtatcgctgatggcttttttaatcaagtgtcagaacttgttcctgatgcctcattaactagtagtcttgaggaagtctcagaaaaaattttgggcttactggaattgccacaaacatcagcaatatcagatcaaataagccatttaagtctacgtcttgtgaatattcttggggaaggtcaacagaatatatcacctcggctatttggttggcaagaacgcctgtctgcaacaatagaagatctacagaaacaattggagctcattattagctatgattgggactttgaccattatttggaggaggatgtacctgccgcggtttgttaacttagccttccatctataaagatcactcgattgatacctgggaaccctggtaaaaagtgttaatcttttctctttttatcatgcagatgaattatattaaacagcaaagcccaacaaaggatggcaaactgcttgccattggtcattcaatggggggaatattattatatgcaatggtttcaaagtgtggtatgtataactggaaatcttcttttgatctgtctcagatagcaagaaaacaacatatttatttaacaatgttgatattccacattttttaggatagtcttaaatatttcttatgctatgaatcagaaatttacattctgttatcaatacatgattcttgttctgtgtttctgcctcaaaaggatgtgaaggtgctgagccagagctggtagcaattgttactttggcctcatcagttgactacacaacatctaactcatcactcaagttgctattgcctcttgtaagttgaccatcgtgcaatttaatttactgtactaatatacatatacaggaacctaatcttcaattttattaggcagacccagctgagatgttacgtgttcctgctatccctgtaggaacattactgtctaccacttaccctatatcgtctcgtgcaccctatattctgtcattgctgcgctctcaaatttcatcaaaggacatgatggatcctgatctgctttcgaagcttgtcttgaataacttctgtaagtttcatatttaagctttgtcatatctgtaagttgtttcataaaaaggtacaacaacctgatattgttcacggaggaacttgccatccaagtgtagtatgatgatatggtcaagcgaacacttctattcctaagaagttgcacattttacaaatatagcctagccaggttaatctttaccttatactgtaagcatatgatagatatacatagcctgaatgttattgcatgatatgctcatatggcactgttccaccatgaagtttctgttaccatctgtaggagtattgattgcactggttcatttttatctgcctgccatctttatgatacatgaatttcaataaggaagcccttgaagttcttgtgatgacttgatgcattattgttcaggcacggtgccagcaaaggttttactacagctgacaactgcattccgtgatggtgggctgcgcaacagggctggtacctttttcttcaagcagcatctgcacaaaatcaaagtgccaatacttgcccttgctggagatgaggatctgatttgccccccggaagctgtttatggtatggtaataagctccatatttgcactgttatttccgatgaggacttttttggaattttataaaatgaatacctattcaggttatcatctgaagttagccaagtgaaagtcatttatagtgaactacttaatgcagctgactcttggaccccaaagatctgtagtcacaagattagctcatatcgtactgcctaactgcaattctcaagttctcatctatgggtgtgtttagttcctgaaaaaagttggaagttttaagaaagttgggagtttggaaaaaaagttggaagtttatgtgtgtaggaaagtttttgatgtgatatgatgtgatggaaagttggaaataggggggaaactaaacacggcctatactggtctgggttatatccctagctaaagtaggccatgctattagataatgcatatactatgatctctctttggcttcattgtttgattatgtattttttagtttcttcataaatacatatcacaacaacattttcttgtatttgcagaaacggtgaagttaattcctcagcatttggtgacatataaggtttttggaaagcccgaaggccctcattatgcgcattatgacttggttggagggcgaaaggtatgtttacattaatgagtacttaaaggatataaagctgtttgtttactgtggtatgttttatcatgtaggctgtccacgaagtgtacccttgtataatagagttcctctcccagcatgatgaagtgtcttcctaagttttgttattggcgtaaatgttagatgttagagctccaacacgctattgcacgagtgcacaatttcatcctatattggaactgaaatcatcaaaatggtaatggaatggtgaggtacaaaagtgtgttattcgtttcgctcccttttctatatccaaggtccaagcttgtagtttattaccacaacagttgatttataacctatatatgtaaatgttttattccttcacaaaaagagacaagaggcttacacgggcacggtggcactgatcatcgcctgcagaaatgccagaaacacatatcactattcactagtaatgtcagataaataagaaaaggtctttttgccaggaagatacaagtatttgtaatggcagcaccgcagcagctagtatcttggctagatagctgctaatacagtattgactacttgccgaatcagcttcattggaaacgtaactgaaaacacgattttgttaaaagaaactcgcagagtggtaatattcagacgtgctcatctgattgtttcaagctaaagcaactaacacgtgaaggatcgaatgaggttgcacaagacactagctgccgtcccggactgtgccaatattgacacctgagataagagtaacatatatttgataaaggatgcctcaatatggcatttctatctgcaaatgcaaaagaatggatgatgtgtttatacaataacatatgtaattgact

SEQ ID NO: 8667 - DNA, 22675 bp, Oryza sativa
tttagcgcacgaaagatgcaagtcaaccacttccaacgcccacccggccagccggccaccccccaggttcactcgcgcaccaccagacaatcaatctactccacttctaatactactactattaatctatatcacgcgtacagctgcttaatacgcatgtcagatcacgcgctaaactaccctacgcacgggaatcttatgcaggcaggcagcgtgtcgcaccaccaaccgctgtcagcatgcgcacttgttgcgggccgtgtccatctccgacttaggagtacgttggaaaaatgtatctaccgatgcatgcaatgcggtggctcaggacaagtgtgcaagcaagcaaaatgcagtgtgggggcaacgaggaaacgaacgaacgtttgttgcagtgtgcgctactgtgccagtactagtactgctgctactaccgtgagcctgtgacgttttttacctcttcctcgaggccgacgggggagtggcggtacccgcgcatccggcggaggcggccggaggggaggaggtcggcgccgaagaagggcgcgacgtcgaggtgcggcggcggcggcgagtccatgaacgacgacgatatctgctcctgcacggtcaccctcctggacaggcacggtctctgcgcaaaggcaaaaaaaaaaaaaaagcgtagcgggtgagatcatcatcaacttggtgaggagggagagagaatttcagagaaacatggcaaagattccgctcgcgcacagcgcgcatcggtacaggggaattcagtacgcccagaagagatacatgtcacatgtttagataacaagaacttaattagactgaccaaacacgacattaaagactggctttaattggttcgtcaggaactcaggactatacaagtggtagaacagtggcaaatgctacggtttttttaaagccgccagaattgattgtgggaggaaaacagcaacagaagaacggaaaaaaagaacagagtattgaatgttgaatttaaatcttttttcgccaacagacaaaaaggagtggaagaaaaggcacaaagaaacacaagtaaatgagagacgaaaactccgaatcgatcgaccacccaccggaaagcaaagaacaagcaaaaccaatcggttccaagagcacgaacagatccgaacatgaggcgaaatcaacaagtagaagcgaaggatcaacggcatccatccatccacgcacgcaagcgacgaacctctctgtgcggcctctccgcgtcgccgccacggcctctccccaccatctggtgccgcgccaccacgcagtccacggacgacgcctccgcggcgaacggtatcccaggcgcgcaccacacgtcggcgccgatccctccacccacgaggtggccgcctccaccgccccctcctcctcctcccctctccttcctcttctccttccccctcctccgcctccgcccgtgccagtccgccgacgaccgcacggccgccgccgcggccgccccggccccgggcgcgtacgcctgcgaggccgcggccgacgtgcaacccagcccgcgcagcgccgccgacgcgaaccccttccgcctcccctcctccgcctgcagcggcggcggctgcggcggcgaggacgacgacgacccctcgccgcggggcagcagcaggcgccggatcccccgccgtcgctccccgtcggccgagcgacgccgccgccgccgcggcggtcgccggccatcaggcgcgcagagaggtaggtggaggggcagtaatggcagcgcggaagccgggggtgcgtggaggagagaaggggagaggagcgccgcgcctcccgtccgcgcgtgtgcgcttcagcgtttggctttgttgcgtagtgtactagtagaagagtagagagaaagaagtctgtgcgagacagcggagactagagatgttgtagagagagagagagagagcgcgaacgagtggaagggtggcaaactggcaactggcaaggcgacgagggaggggtggaagcagcacgaggaaatgagatgtggtgactggtgagtgaattcttgtcgcgggttcggtgcatcactggatttgatcgagggatggatacgtacgtactagtagtagttgttaaaagaccggaccggtaaatgaaccggtaaagctcttggttaattggtttagggtccctttgaatcacaggaatgaaaaaatgcaggaataggaaaaatatatgattctgacataaataaaagtgtaaaatagaagattgcaaaacacagaaaaaatataggaatgaccgtttgattagaccacaggaaaaacacaggaatttgaggagatataacgactcaaaggatttcttccataaggttctacctcttattaaaattcctcaaaaacttgtatgagaagaggcattccataggaatttcataggattccataaggttcatttcttttattcaaaagactttgtaggaaaaattcctatagaaataaaatcctctaaaattcctatgaatttcctttgaatcaaagggggccttagtggtcggatcactggtttgcccggtcgaaccgtggtttgattggtaatatagaaagtactatgttttaggccgggtttagttcccaactttttcatcacatcaaaactttcctacacatataaatttctagccttttttcttcaaacatccaactttttttcttcaaacttctaattttagtcaaactttcaattttagtgtggaactaaacacacccttactaatggcacaagctgtacaacggtggcttggctagcgcacggtgctctcaaacccacgaccagaggtcgaatccccatctccggtttataaaaaaaacgcccggattaaccggtttcatctggtctgactgcatgcctgatttgttaaggggaccggaccggtgggggctctggttccggttttttccggtcgaaccgctggtctggtccggtcctaataactatggatggatgtcttgatttaccaggccccctcccaaaataaatgtcaaattaaattctttatgaaacactcctactaatactagaatagggtgcagaaaggggaaaaaagctttgatcacttaggccctcttctaacttgattaagatgaagatttttttctgtcttcgttagcatgcttttcaaactactaattagtatatttcgtgtgaaacttatataggagttgctttatagtaattcaattaatcatgtgttaatggttttcttagttgtgtgccatcacttaatcttcatcgtaatcaaattatttttctacatatggagtatcttcatattacataaaatatgtcaaaatgtatttttatagtataatcaaacatatttcatagtactccagtagactatgaaaatgctcctatattttcacattttgagacaaatacacttcacatttggtttttatggatcccaataacatgtgcctccgcaagcatagccaatgcctcgggacaacaaacgaggatcatgtgtacgcatggattttccgtgtttggttggtgacacaggagaaggaacatcagctcaccaataggccgatacggagtgggcagttattgagcagtagtagtaccactgcaagttttggcatatcaaggaggggtatgtggtgtgccatcaaagaaacacattaggagtcctaaaccacaataactgaaagaacatgtaatatctcgctatcgacgaatactcatgtcaagtttataatctgaatttagatgaacaggtttcaccacgagaaacataaccaagttcataacttagaccgttttagactgatgttaaaaatactcattatcaatattttggtagtttgaatattgcatatgatgattttggttagaagataaactttgattctaccaaaaatttggtttctaatatatcaaatcaaataggaaaaagtatgaattacccccgaactatcgcggtcgaccgaattactcccctaaacctgaaaaccaaacatcattcaccctaaactttcaataccggacaaattaccccctcgacccaatccagagtggttttgtcctacgtggcgtacgcgtggtagtccagtcagcattttatttataaaaaaatatgggacccacctgtcatactcctctctcactcttcctctctctcacttttcctctctctcttctctctcactcttcctctctctttctcgccggttggtggcaggcagaggatacggagcggctgcgggtgacgcggcggcggcggcggcgggggacaaggagacggcgacgaccgcagccacgacgagcagcgggccctctgcgcggggacggatggaggcgggtgtgggtggcgacacgggacgcggcaacaaccaagacgagcagccaccgcctcggtgcagggaattccatccggcgcaagtaggtttccgccgccccgtgcgtgccgcctccgtgtccgccgtccacgctcacccactacctgtccctggctccatccgttcgtcccgcgctgccgctgcctcctcgctgtggcctctattcgtccgtcccgcgccgtcactgcctccatgtccccctgtcgccgccgcctcgtcgtcctgcgtcactcgccgcagccacctccgttaaccctaccgagccaccgcttccgcgtgccccgttgccgttgcctccgtccgtctccacgctgaggggggcagttgctcgtcgtggctgccgccgccgccgcgtctcgcgctaccgcccacacccatctccatccgtccctgcgccgaggggcggctgctcgtcatggccgcagccgccgccgcctcctcgtccccagctgtcaccgccgctgtcgctctgcgtcccctgcctaccgccgaccggcgagaaagagagaggaagagtgagagagtgagagagaagagacagaggaaaagtgagagagaggaagagtgagataggagtatgacagatgagttccatttttttttataaataaaatgctgactggactgccacgtatacgctacgtagaacaaaaccgctttggattgggtcgagaggggtaatttgtctggtagtaaaagttcagggtaaacgatgtctggttttcgagtttaggggggtaattcggtggaccgcgataattcagagggtgggggtgagggggtgtaattcgtactttttccaatcaaatatgaccaatgtaccaaatattggtaatcttaaaacttgccatgtttcaactcttgcaacgttttggcagggtactttgaatcgaaataccctttagggcccctttgaatcgcagggttgaaaaaatagaggaataagaaaaacacaggattctgataggaattgaagtgtaaaacagaggattgcaaaacataggaaaaacatatgaatggtcgtttgattagagcacgagaaaaacgcaggaatcggatgagagagatagactcaaaggaaattttccaagaggttgaagctcttgctatatttcctccaaaaaccacatgcaatgtgccattccataggaatttcataggatttgaaaagcttcaatcatttgaatcaaaggatcaaataggaaaatttcctatagaatttgaatcctataaaatttctacataaatcctttaattcaaaggcccttactcagtttggggatccaccagcacgtaaaaggccttgacaaattcatttcgctccatcactcatccacgttagctaacagcgtgtacgtgaactgttcataggtgtgtacaagcaatcgagtgcacacacgccgcacaggcgcacagcgtcgtttgccttggatcctgccagagtgcgcagggaggagatccccgagtcaaaggggacaagcttgcaagaatacaagataccctgcttcctttttcgtttccatctcgctcttttactcatgcaccgatgcatgcaaagacaagcagaggtccccttgattggggaatttgtactgatcttgtttcttaatcaaacctaaagggaaaaaaagaaaaaccctctccactgccgaatgctgatggaccctctttggatggcttcaaattttggactgtatagtagtagtggattctctactcgatctttctggattctttttttctgtgatggacattgggcagcgtttgctgttgattctactacagaatgaagtgctaacctaaagagattacagtacacagtaatttaccctacatttcctctcttattggagtgggaccgtgggactgatatacttgtacggtcttacggatgggtgtcgttttttggttttgcccatgcaggtttaagcagcagagagaagtcagcaggtcgtcacgttaaagtattcagctgtaccagcatcgctcaatcaaaagtccactattgacgacgagcttgactccaacggatcgctcttctccatgggagaaatattctttgcttttttatctagtgggcgcgcatctaaaacctaaacgatgggaatacagttcgcaacccgcttttggcagccaaagagaagcgacgaggcagtagaaagaaagaggagatgcctcctatctcagctatcactcactgtgggcctgtggtcactggtcgcgacctcaagcaagcaagcaagcgacggagggcagggatggagggttaagtatcattcctgcacttgggcttcagctcacctcatctttattcttcacttccttgtcttcagatgcgtggtgtaattgactccctacttctaattatactttggtttgctgtgtgtcctttgcctaaacaaaggtagcacgctgtatggttcaattcatggaggaagattagaaagaaaaaggcagcagtgtccagtggatggtgaccagcaggaagctataggcagtagtgactagtgacgctgagcagcatcggctttctttcttcagactgcgctgtaaaatggactaaattgagctttcacccttctttgtcgaggctgatgttttccgtattctggccgtgctttcaatatgaattgtcaaagacaaaaggtattgtttcccataacaggggaagctgtttcagatttttagttacacaaggaatagaccacacgattacacaagaactggccagctatatatatactcctatatatcttttggctaatctgtccaatagggtgatgtatgtaagcaaatactactagtaccatttaagggcagctttcagtactcacacatgcatgacacatcggtaggacagtaggttactcggtgcatccaaaaatccaaaacactactgatggttgagaggtcatggatcatagatgatcacaaggatggatataaaaccgactgtagaaaatatgcagccgttatcttaatggaattatacaaagaaatttaaagcacaaacccggagccatcaggcattcaggctcatccaaagctagctccttggataaggaggagctgaggattattagcagcagacagagagattggtagctcgggttgagctttccatctcgcatctctccctttcgatggatgaccaaccgaaagaacacgagacgttggacgttgcgagacggcgcatccattaaaacgggctcgatcatttcgctgcagccaattagccatgcatatattgatatatatctcccgtgggaatctcatcatgcaagcgattggaggaaagcaacatttctgtactctatcttaatatcttatggtgtgatgctatatgcattttcaaattttcagtttggcgttttgtagcatgcctactctaacttctgatgatttcatcagcgtacattcttttctttttaaaaaagacatatcattgtgcggacagatattcagatgatgacgctgctagtagaatacctttacattgattaatcatgttaggatgaggctgacgaaatttctctctggcattactagtagaagaaacatgagacactggcaagtggcaacggatactgctacagcatctacctctcacgagcagttcaaacttcattttttttactgaatggtaatgaggctttacaggttggaagcaaagcaacgccgaaaagcccagtcaaactcagaagtgagacatgcatatgaaaatgctctctacacctgaatagtgaacagtgcctgcctgcctacttttttacggtatgggcctgtactgctgtacatgatctacgaaggacaatgcaaccaggcaagcatagcattcggcatcctgagaaaagaaaatatatagggtgaaaaaaatacaatgattaaagatggttgaggaggggtatgtgcaatgaaaacgagttcatgattcatagtctccttgccgaaatgatggggcataattgtacgttgtcctgctccttttacgtaaagatcgacatcttgagagcgtccaaaacgctacacatgctttgatatagattgacacgcatttgtctattcattctttcgtgagaaagaggtgggatattttaatgtgtcgaaacaacatttggcagcatcccggccttcctcaggtgtttctcgtggcacttacaccagtatctctacccttgatctgtcactaataataagtggtggtttactgccggtgagaaaatgcaactatcaatctaccaataggagtgctttttttttttttttaacctggatagagaccgaacattcgctggaagacgagaggtcgacgccacgcagtgatgcagagcggccggtagcacaaaaaaaatgggtactcctccacctccactaaaaacttgccaacgtcctcgcatctgcaaaagccggcggtggaggaggagggaggcctcgttttgtccgcgtctgcgtggcggcgccctcccagaccggtccgcgcgtgccgctgccctgccagacagacagccatccgatccgtggatgggatcgcaaggcagccgcgcgcgcgcccgcgggggcggggcatatgcgcacggctcgagagcccgtgcagtgcagctgccaccggccaccgccgcccgtgcgtgccccggtgcgacgcggcctcttcctttcctcccctcgctggcgccgtggcgcgtggccgggtttgtgctccccgacgagaggcgacgctgcgacgccacgcgatgacgagttgtattgatccggtcagctcaaccgttcttttgccgaggccgcgctttgggccttggtggcgtggcgcctcgacttgttgttgtctagctagcgcgcgcgtgcgtgcgtgctgggcctcgggcttgatggagttgttgccttgtttggtcctggcaatttcatgggctgaatggaggggtacgcttaaaatacataggaatgaactgaaagtggtacaaacactttcagtctacacctttgtactctttattagattttttgcgaacgcttgtactcttgattagattggcgctctaaaaaaactcgaaacaaattgaaagtggtaaaaacacttttggtctaaccctccgtgctcttccctagattaacgctctaaaatggtagaaataaattggaagtggtacaaacactactgctatgagtccacgacggtagcaactagcaccaaagctaacaaaccaagatagtaagactagatttgcatcacttaagctatgaaatgtatatgagtaggggtgggcagaaaaagaccgaaccgaaatgactgagaccgaaaaattcggtcagcactttctactaaccgaatttagtttggtcaattcggttttggggctcggttaatcgaattgaaaaaaaccgaaatataacactggcccattaggcccaatacctcctcagcaaaagcaaaaccttatccactccacgaccttatctaacccactaccaccatcatcctcctctccatccaccgggcccttcccatccctatcccctcctcccccgtgctggtgatgccgatcgcgatggtgaagctcccggatggcctcccgcagccgctccttcgccttccgtaggtcgccgccgccctgtgcgccgcctccgcctccagtgccggcaccacctctgcctccgtcctccgcctccagcaccggcagtgcctctgcctccattgcgctgttgtcgcgggcacccatcgatcatcgcgccgcctctgccttggtgtcgcctccgtctctactctccaacggctgtgaaaaaattcggtctgaccgagaccgagaacgaatttgttggtcctgagtttccaaagaccaaactaaccgaaaaaccgaagaccgagaccgaatttgtcggtccaaccgaacgcccacccctatatacgaggagccaatataagtattgtcctgatgatctaaattctcacaaattgtttggtcaaacgtgaaatgtgagccaagcatgtttttctacaacatgtaaccctcttcgtgcacaaatcaacatcaaacctacaaccatcacaattttatgaaatcttctacataaaaacttagtatgcacccttgtcctgatcgatggactgctggtccgactagtgaaccgtcggacgcaccagttcaatcaccggtatgtttttaataactattcaaaagatcgatatggcatggatatatctaaattagcaaaaaatagaagaaatctagtctatcgttgggaaggaaccaaatccttctacgccagagggacacaccgtctttgtcttaggcccagaagacagattgttcgattcatctcattcgtagatgtccacaacatctaggagctttgaccactagagccaccatgcgtcggggtatgtgataccgtttcaggcttcctgtcgctcttgctggtgttcgtcggcctcagctgttagcctcgtcaaatggtggtgctgccagcaaaaatgccttgagcatgtcaagtgctgcgtggaagcaatccttgtcctttcgcctgcgaagaagtagggaagcgagcatagatgaagcaggaattgtccggcgcgtcgtagtcctttgcaaggtttggacaacctggctccttgttgcctaggttcagtaaagcgttacgactatcgagaaagaagcagacgcaaggcatcgaatgatggctctttatgcagaaaaagaaagagcagggcaatatttcgatgagatccatgtagctattctgagatagcaagacatcgatatgttgtcgacctgcagtagcagcagagatgaagatgaagagtgtggctgggttgcccaatttgaagccaacatcgatgataggaccaacaacaagcattgagatgtcacccctgccatcgctgtcagctgcaccacgtatccctgtgcatggggaatatcaacggcgaatgcgtttcaccagcgagagaggagcttgagcaggtcgagcgacaacttcaacgacagccgttcagggagagtgacatgaagccactagcgtgccacataccctaacaaccgtagatccccaatgatgtggacgactgcaaatgggatgaaccaagcaggcagttgcttttgggccaaagacgaaaaaacaaagttagactaatgctattgttggaaatgcaaaggatgattatctagcgctggacatatgcctgatgttctacatcaaaggatttggttttcattgggttttgtcacttctaaaaccatccaatatagtagttcaatgaacaccgaacattggatcaaagtaaactgctaacaagacccctcaggaaattttactttacattgtagtcctccagcctctcaaaatttgaacgtgtccgtgcttttgagttcaggtatgtggaatgtatttataacacattataactaacggttgatagcaaattagttgttacaacaaaaagaccaacattccaaatgaaccgtgttgaaaattgggcaacatttaaatgcggcttttggggcttgtttggtcatgacccaaatgaatcattccaaaaatttggcagcattcaaagtagtccatttggtgtgtagaagaaagaagggcattgacaaatattttggtttagatgaaatgaaaataatccactagaatgcttttttggtagcaaagcaaataaaacctttgcccacctttatcagtaatttgataagtttactgtttttagttgttacaaaccaaacagagcgtgactgacatgtggaaaaccaaggtctcgctagctccatgcataccgtcttaagcgaaatatgcagcgagactacactagaattagatttttttccctcgtatcccgtgagatcagttgaagatgcgtcattttggtaatagagattgatttaattaaatgcaggcaacatatatggtcagaatgacgtctatactactattttgccacggtttgttatagttttctccacgagacaaggcgtgaccataggtggacgcaaacacacccctgctacttctgtggtatgatatcttgatttgtgttcatgtcgacgcggccaaccatccaatctgcctgtcttgcctctaacatgtccttaaaacctagctcttcaggggttaaggcagcaagcggaacaacaagagaagggatgccatggaggcaacaacgtcgatgatcccctctccctcggatccatctactccagcgtccccacgccacctctctcactgtccctattcgtggaccccgcgctgcttccctcgccaacgccagtggtcatccccacattgtctcatttgccgacgcagctagtggtctcctccacgcagcctcacttcatcatcatccccgctctctcttcctcattatcacaggtgccacaacctccttccccgctctctgtactagctcaagttcttatgtatgaataccaggaatcacctcactgtgtcactggcactaagaaccacgtgttgtactatgcttacattgagatgtgtcggcagctcgacccacaggggctattcaatgtctaatcaatcaatgcatctatgcataatttaattttgacgggtgaacttaacggatgacacaatatgagattatccttccttcattttagtatcaatagttaaaaatattttattggtcttgatgaattacattttgttggaaaattgaaggaccggttatgttcttttatgggacatgcactttttatacacttatcgtgtgttacatttattaccaatatatgttccgtacacttttgttttgtagttttgatgtggcctatttatttcatgattgcattccacattatatatgctcgtaaaacttcactgtgtaaagaccattcatttaattgagccgctctaaactgctcgaaatgggtagtttattttgtgaatcggcaaaataaactgctaaagctatccaatagaacacaaaacattgaattaaggtaaactgctaacaagatccctcagaaaacttttgtttacattgtagtcctcccgccccttgtaagtttgaacgcgtccgtcccgttgagttcggttatgtggaatgtatttataacgcatcataacttgttgttgaattggctgtttcaacaaagggaaattgacatttcaaatgaaccatgccaaaaatttgacaacatttaaatgcggttattaggacttgttcagttcatgacctaaatgaattacaccgaaaattcagcaacatttaaagtagtccatttggtttgtggaaaaaagaaaggcattgccaaatatgttggtttatatgaattgaaagtaatccattggatggtagcaaaccaaataaaacctttgtgccaaatatgttttgtgttcgttagttgttacaaggtctcaccagttccattcataccatcttcagcgaaatatgtggcaagacttcactcgaattggattgttttccttcgtattcgtgagaccaattgaacatgtaccgtttcggtaatagagattaatttaaatgcatacgagagatatggtcaaaatgccgtctatactattttgtcacggtttgttagaatcttcttcgggagacgaggtgtgaccccgtgtggacgcaagcaaacacctgctatttctgtggtttgatatcttagatttgtgttcatgtggacgcggccaaccttccgatctgcctgcctcggctctaacctgtccttaaaaccctagctctttaggctttaaatgcagcaaataaaataggttagtagctactataggaggggaatggatgggaagggacgccatggtggcggcggcggcggcgaaaatcccctcaccctcaccctcggatccatctactctagcgcccccacgccgcctccctcaccgtccctggtggtggcccctacgccgcctccctcatcattcctagttgcggcccccacgttgctttcctcaccaactcctgtggtcgtccccatgctgcttccctcgccaacacggccggtggtcttctcgatgcagcctcactttgacctcgtccccgcgctccctccctcgtcaccgcaggtgccacaatcttctctttcctcgctctctgctccgggttcgactcgccactaccgtaatagtcctcgttcctcgctgcttgctccaccttcgaatcgtcgccgcctcaacaaccccgatgaaggccagtccccacgaggccgcggtgaggaggcgaatggggacaatggagtgctagtcatggcgacatcattcccatgggtgacatcggctgatctgccagtgttgcattgcaccctagagagcatgttgctgaagggcatcacgtctgtggagggcaaagccacctgcaatcgttgcagtgcggaggtgcccatcgcgtacgatctggacgcaaagttccgggaggtgcgcgactatgttgcagccaacatccacatcatggatgaccgtgccccggagcactggatgtgcccgcggctgccagactgcggctcgtgcggcaagaaggcctgcatgtggccacagatcccaaacgagaagcgtgagatcaactggttgttcctcttccttggccagatgctgggctgttgcacactagaaggcctcaagttcttctgcaagaataccaagaatcactgcactggcgccaagacccgcgtgttgtactatgcttacattgagatgtgccggcagctcgacccacaggggccgttcaatatctgattgatccatgcatgcgtgtgcatccgtgtgtctagatatgttggatattatgttattttgtttctgtttgcttgattatccggtacttttaaggggtgaatgtaacagatgaatagatggctaggaaagagataaattttcctttcttttagctctgattgttaagaattcatccatttatcaatttgataattagtttttgcaggaaaaaggactggttatgttcttttgtaggacgtgcacttttcatacaaccattcacatttgttaccaatatgtgttccgtacacttttttctaacacttctgtttaattgtgatgttgcctatttatttcatccgtacatgcaggttccattatactgtacccataaaactttgcctggaatgtaatatcttgaagtacttgcttcccaatgaggtctgtatatcacccacgattttagctaggtattaacctttttgagttcaatcttctatacggttcactctatggaccatcttccaattggtgtatttttttttatgttacaaattacccttcatgattcctaactatacgagaccttgttcggtttggaggggattgaggaggaatgattccacaccagaattgttatgaaataaatctcctccaatatatctctttggccttattcagtttggagggtattaagggagaataaatccacagtacaatagatgtgaaatagatcccctccaatccctcactcttagggataataatcgtacatggttttacaggcattagatgaacacaatttgaaagaacaaaatccttattttttttcatgccaccggaaatttatttttcataaaattcaaagttttaggtgtcaagttaagtttccatagatttaaatggaacatcattgagtctgaactattctttattaatattagtgtgcaatggtttggagaaatcttagataatttagtgactattggatgattggagtcttaataaattgctagtcctttgcatttggattttattgtgttgatactaaaaactctgcctattttgtgtagttgtgtgataaccttaatctcatattaatttttagatgttttgtcaatgggattgactctgataaatctatgaccgacaattgccactatcttagtatgttatgaagtattttgatggatataagtttatataaaattgttcctatatatagggtagtacatcactacattgtactagagcctttgcttcatactgtaacatttgtttttggaaaaagtacgaattactcccccgaactatcgcggtcgaccgacttacctccctgaaccacaaaaccggacattcttcaccccccaactatgcaaaccggacgaattacccccctcgacccaatttgcggtggttttggtctacgtggcatacgcgtggcagcccagtcagcattatatttataaaaaaatgtgggacccacatgtcatactctctcattcttcctctctctctcttctctctctcgctctctgtctcactcttcctctctctctctctctctctctcacggtcatgggtcggcggcggcgggggacgaggaggaggtggcggcggcgccgacgggggacgaggaggccgcagtggcacgggacggatggacagaggccatgacgaggaggcggcggcaacgcgggatggacggacgaaggcggggacggcgggggacgaggaggccgtggcggcgcgggacggacggacggaggcgggggtaggttgtgggcgggtgtggacggtgccgagagatgcgtgctggtggcggagctggtgcagatgcaaggcatcttgaggcaactggaggtggaaatgggcacacatgggggcgttggcggcaggggtagggcggcgatgtcgtgtaccacggcgaccacacctgcgcgcacggagcaacatcagcagccgacgctgccacagaagtagaacgccgtcggtcgcattcacctccatggccgtcaacgcatgtcgtcgtcccccttggtcgtcgtcctccactcctccgtcgccatcctccactcctcatcccccgccaccaccgacccgtgagagagaaagaggaagagtgagacagagagtgagtgagagagaaagagtgtaagagtatggcatgtgggtcccatatttttttatataaatagaatagaatgctgactagactgccacgcgtacgccacgtagaccaaaaccaccgcggattgggtcgagggggtaatttgtctagtttgcatagttgggggtgaagaatgtctggttttgtggttcagggggtaattcggtcgactgcgatagttgggggggggtaattcgtacttttccctttttgttatgtgttcttctactagaaccttattgcttttagtttgaaacagattattgagcagattgttgcggcaaattatctacttgattacacggataaattaaatattttacaaacaaacaaatagattgaacaagtggcctgatagaattaatttttagaaaatgtattttttggaagtgggaagcaaatattccatttcattaatccggtacataatctgaaaagagttgactcacatgtagtttctaaactttgtattgtggtaaaatctttagctcttttataaaaattgaatatgattctatactcatcgcgcacttcatccatcgtcgtgctggtttttcatccgattttatttcagtttcatgcgaccgacttcgtctcgtctcgcatcgcatcgcgccgtccgtcaaacagaagtgaacgagtccgcatagatcgtgtgtggtcccactcgcaccaatcctgttctattacgatttgctccatggctggcgattcgatcgcctgcatggctgcatggctgcatcgcctgacatagcgggagacaggttaatccacgcgccaccgcccgtcacgagccacgccgctgccgctgccgcctgggagaatcgggtttccgcgctcgccgctggaagctgccggcaacgggctccatcccgctatgacggttcaattccattccctcaccgcaactgcccggggaggatgcaacccgcgtcacctgcggcgagtttctctgacccagccgattccgtctaaaattaatcagaaagtgagtagcctcatcctactatactactacccatcctccgcctgatttctcttatggaaggggaacctactaccgatctcacattcacatatttgtgattgattggtcgagcgtggagatggcagccgggagcccgggaatgatagcacgggacgaccttcacttataatcatatagcggttcgaaatggtatgcatgtttaattgccattgcttccccttcgcattcatctaatgttcttcatttcagtgtgggcgaatcaaagaaatatgtggtcagggtcagggacgacagttctgtgtgggggagaaaagccgatgatggattgagacatccctcttcaagctgaggagtgattcctcaagtatgctataatcaacctcctatttcaatctattcagagacaggaggaactgtgctgctccgaactattctgctcatgatcctacgaaaaggtgcggacttgttagcctgccttgagaaggttcagcacattaagcctccacaagtcaaaccacacgataagctcctatgatttgttaacatccaggtaagtccttaagaaaaactaggtatgtattgctaaatttttcatattctgatattccgtcttgtttcaatcacagattccccacctatcatgtcattgtgctgtacatcaaaaatctcggagtacatagacaagggggtttcatagcatttcaaggagcctattatggttagacttttcgattcaaaatcttattatactttctaattaagttgaatttgttcctgtgaactaataatagaatgtatctgaccaggccttccaagggggaaaaaaagatttatgtatctgactgcgaaagaaagtgagaaggtgaaaaggttgcatcagaatcaacaatcacttagacaggttaaaaatcatgacaaatctatattagctttttccgttgtaacttgcgggcattgtctttagtagttctctccgttgcaactcacaggcattttgctagttaaaaaaagaaaacaaagcaatatcatttttgcatcaaatacttgatatccatgcaaattttagctgcaaacttgtttattttctatgaaaacttattgagtttaactttgataattgttctcgttttttctaaactctagtaataatgaatcccccccctccccccctaaaatgtctaatactacagatattcgaacagattttcaaagtacaaaaacgcacccattatgcccgttttcaaattgcatgatctgtaggacaccttgtatatatatatcaatatcaatgtcaaaattttcacaatcaatactgaaaccgattatattttgaaatagttggctgcaattttttttggtgcccctgttacaggatatgcaccaaactcaaaaccatacctgggatggggggcttggcaattgttctccctcgtgggcttgtggcccggccaacaacccaaccaaactcagccaaatccatctggaagcacgcgctttcccccttccccagataacaaattcaccaaattcccccgcctcgaggaggaagctaacgaccgtccggtcaatttccaaccgccctctacgactgccgatccttcctactaattcctatgcttggacagttggacatccttgaattccaagagtcagccgcgccgccggccggtgccctctcccactcgtcttcaaacgtcccaactaaattatagcagccaagagcgaatcgcctctggcctctgctactttttcatcccccgcacggaaggatatctcaattgtgaatcgtatcgcatggtgtccggggaaaaggagaagtggaagagaagccagaagggagacgacgagagatttgtccgggcggcaagccaaggcggccgttctttccgtcgtgaacgcttcgtgtaaggttcggtgtcccatctctcatgtccgtttcagaagaaaccgtattgctgtgttgatgctaattactgatgatgctgaggttcggctatcctggatgcatggctagttcttagagttctagggacaagtacaactattgttaaatagcacgaattcaaggttctgagtatgatttctgtacttcttttgatggacaggcaaaacatccatctgatttatcttgcgaattggattgcttaacctaatctgggaattcaagtcagtacgtacgatatgccggcaccatcggcatccatccatctgggagttccaactccgtacataacatctcatggatccaaaattgctcgcctacacatgtatgactggattgtgctgattcttctagtcgtagtagatggaatactgaacataatagaaccattccatcgatttgttggatcggatatgatgacagacctcagataccccatgaaagacaacacagtcccattttgggcggtcccggtaaacatcttacccttctagttctatccaacagatttcctttggcctgtacaggtaattaaagtttcttgaaaattcatgctttcgtagataattggtatcattggaccaatgattatcatcactggaatatacttcaagaagaggaatgtgtatgatttccatcatgccatactaggtgagctcatgttctttctattctgttttgttttgctagtctacacattttgtaatttcttatctgaaacctagcaatgcccttgcaggtctcctattttcagttcttatcacggcggtaataactgatgccattaaagatggggttggtcgaccgcgtccagatttcttttggcgctgttttcctgacggagtacctgtaaatttctagctctcaattggattctctaagcatgattttatcggagccggcctttgttgcatctgtcatgtatgtggaacttatggattttcttggattgcaggcttatgataatttcactacaggagtgctttgtcatggtaaggcgagcgttatcaaagaaggtcacaagagttttccgagtggccatacttcttgtaagtgaattctgtcagttgataatttcgtatgtatttctctaccttgttactacgaaatctcagtggaatttcagttagcattatcaaacacataggattggtcatactctagactgcaagagcttttacgtgctgcctgctcttgtggagtactgtggatcgctgacgaatttatttttgtttcttcagggtcttttgctggccttggtttcctgtcatggtatctggctggtaaaataaaagtttttgacagaagaggccatgttgcaaaactctgcattattattctccctctgctccttgcagccttgggtgctgtttctcgggtagatgactattggcatcattggcaagatgtgttcaccgggtggaattttgggtaggttaattttatagtgttacctttgcagattatacctcgcaacaagtaaaggaggtactgacaagtgtgctgcatgtaattcttggaaggttctaactttactgttaaaactttgcaggggtggtggtttcttcattttgctacctccaattttttccaatgccatctgatgaaaacggtatgcttcatagttcagactacttttcttcatgattattgcagagatgaaaatcacccccaaagggtcattttgagtagtacatttgatactgtattttgacatatctttcgtactgtaatacgctgacctgaaatttttatggccaatttcctgggcatcgcgtgattgataataccatgttctgtacgaaatatctgaagttgtactgtaattttgtatattctcgagcttcagatatctgtctctcctaatgtttctgacggctttacattgttcaaattttcgatgacaggattatggcctcacgcatacgcccggcacattctcaaccctgatcagctggagaacaacgcgcaacccacgtccgtggatcgccctaactctctgccgaacgggtcctttagaagccctaatggattggaaatgggaaacacgggccaaggccaagcattagatttcatggaagctggtcgtagatatcaataacgagataaaaacctgctactgttgtagcagacatacctgacgtactttttgatagactgagaattatacggagacctttcaggttcactttggtacatataccgtgtagaattgttacttgtacatttcaacatgatgatgttagctatttctcatgtaaatctataccagattaaaataatgcacctacatttgggtatccggaagtatgcctgacagtagatggtcacattgtcgcttggcttatcatacagaatagggtttggacctctggccggcttgtgaccagggggttggaaaaataatggcaggtgccctctctgcatataagagaagatgatacggctttgcacctcgtcgccgagtgcaggtatacgagaaggatttgaaacctcgt

SEQ ID NO: 8668 - DNA, 1535 bp, Oryza sativa
ttctcacccaagcatgctgttttttttttatatgctggaaccattgaagccgccgcaacagatagatggtccagcgcggggcttcaaattaatcagatttaaatggtggacgatttatggctttttctgacattgagagatttttcttcagcatacttttgaattgtctgtgaccactggatgcacaattcatcaatttctgtggcacccgcccccatcaaaaaattcagtgatgcgtccatctgtggtctgaccagattacagttgatatatggacctgaattaatatatcaacaaccaaatacctgtccccatgctatattgcgaataattcagggatgttgaggagtagtatgtgtcaattctcaggtttcttaggtcgtctccttgccgaaaaacctgggagaacattgtttaattctggtatgaagaaaattgttgattctggtatggattctgtcgtgcatataacagctgattagatggtagtctcactgaactaaagtatgtttgtattgggttctttggtcatctctgctgcacaactgccaaaaacttacgagaagagagaaaagatcactgaccaaattaaagaagcaaaattaggtgaagaaaaaaaaggaatgcagaggggacagtccacaatctagtctcaatctgtgtggcttgaactctttgatctcgtcctccagctgtctgatgcaagctttgtcaaatcacagagcccaccacggaaggcgaagttggcagcaacatgcacatgactttcagagagagtgattattcaatcgatcgatcagccggatgggctacatgatgacaaacgggattgactcggacgctaatccggcgtccaaagtaattaagcctaagtcctaagacaagttgtgttgtgccgatctgtactgtgcacggctgacccaatcgtggcgtgaagtcctcgaattaagccatcgattagattaattactcgtgacttcttgagtctttgtagatgcatttgctgcaaacagtagattgatgtctacgcatgcgtatggttttctgaagtttatagcttttgacggtcaaatgctaaccaccgggacggatgaaaacgctggatagcatagtactcacgggcttgtcggtttgtggtttaatcagcgtggtgcattgtagatgtactattaacttcacgggtagatatgcaaggtttacttgacctaattaatactagtatcaacctgtacgagcccaactatttggtgaaactactttgacagtttgattgagtggaaagactgaccaggtacattgttcagatctagtagacaacttttaattattctgatctaaaaaaattgttatgccaatttgttttggttatgatacaaccatacaacactactagcttattgacaatctggtaatatagggctaatcagtactaaaacttaagcggtttaattgttggtgctaaacagagactagcagatgatcgtcgtttttggagcacattttccatctgcagcagcatataaaggtagctagct

SEQ ID NO: 8669 - DNA, 1526 bp, Oryza sativa
agggagtagatcctttggcaattcatacaatccttatctctactttatgtcccttttcttttggaaaaccctcaccatcaccatgtgttgtacttcacttaatacgttgtatatgtactatagtactactgctaattcattgtcaaattaggacgtcgaacacattatattgtttgattaactgaagatgacggttgatccttgaagatgtgaatggatgggccagcaggttcggccgtcagctctgaacaccaagcactcatagtaaagtgtaagtactggagtagttgtttaactgaagaaaagtactattacctatgtgtgcatatctacgtagctttccgttttctcataccatattgtagtataataccacaccattctgcctgcttttgatgcgagcatcatttggttactcaaaaattttccggcgatatgtgaatctcaaaacttgtatgcacatcaagtgagaaaacgactggtgatttacgctcgtgttgtcgtgccgtcatacgtgcaagcctgtaataatgtaatatatgtactctatactccaacatgcatgtgtacagtacagaaaacgcagtgcaagttgtatagtgccttacaactcaacgacgactaaattaaggggaaaagttaactacaaatagctagttaatccggtttgatctctttgctatctaccaagtcagagagagagagagagagagagagagagagagagagatgtgtagctttcagaccggacgtactgaactgggagtgcagctagacacataaaaagaaagataagaaactatccagtgatggtgagctaacctaaacaatgtaaccacttgggcaagttcgcttttgatgcgctacaatagcttatagctacctgcacgttgattaattaggcagcatcagcagcagcaggccggatggcatggcgagatcgacatcgaaatatcgcctgtgaagtttgaccggtgtccaatgcccgccaatggcgtcgcaggcgtccatggattacgtataccaaagacgtgcttatccggcccccaatttgcgattaaagtgaaggttgagcacatgtggatgtggcgccatcctcttttgatcccccaagagccacacagaggattaattaactaactaatcgcctaaccggagcagcagcaagcagggcatactgattgatcaattagttggtagttaaatatatcttgcttcttgattcggtaaggggggagaaagagcatgccaatttgtccatttcacaatactactttggtgacaagatagtgtatgtggtagtaggcttggtagctacaaggtgatcttgtaatttagccctaagactttagcataatcccatgttttttttaatttgtccttgtatttatgtacaactcaccagacaagtactccatatgcgggtgtacatttgtacctgcagcaagtacgcatatattttagctgaaattcaggggtagatgccgcgttctacaattcttttatgcatgttgtaagctgctgca

SEQ ID NO: 8670 - DNA, 3595 bp, Oryza sativa
aaaatttgtagagttgaacatgctactatgaaagtaagtagaattaaatgagagaagattgtgattggttgaaaaatggaagtaagtgaagaaattgaacggtggaaggtataattggttcgaaagagaatgttgatagaaaagttattatattttagaacaatttctaaaaaccaaaacttactatattttataacggagggaataattactaccttcttacatgatcattgtcgatgtcattataacctcctaacttaattttatgcgatgtccctaatgttgatgctaattttcggaagtcaccaatcaagaggtgcaaagtatgccctgagacggatgctgggcctagatacttggggtatatttttgtttaaagacgagaatgcatgtggacaacttataaattttgagggtcgttgtcggatatatgggcccggggatatgcaaagtgagggaaatttatcttcccatccagccgcgtggccctacagtctggtcatacccttggacctcgcggatcgcagaagcggccggggggcctcggggtgccacgtcatgcccctcgggccctcgtgccgccttgccccgaggccctcgcccaactgccatgtggcggggggagcgagcagggaggggacctaggctgaaccgctatcaatgcgcgcggcgccccaactgcccctcgccgcatttaatgtggtaggggcagacgtgcggtaccgcccgactgacgcacgtcagtcaggactgtccggtctgtgaccgacctgtccccagacacgaccgattggacgggcggctgtgcccccacgtcgcttctgtctccggcggagtggaggtaggtgtgacccgtcccatcggagtgtcattcggagctccctccacgagaggaccaccccaagtcttcacccatttatgagggaatgacagtgttgtaccccgtgtcacacggggggcggcgctgggtcccgctcaaggacggggtgcggcttagcttccaggcgaaggcacagatcatgattcgttcaaggtagggttggtccccaccccgtagaagagtaggtagaggcggtgcatgtggtatccccttgagctataaaaggaggaccctgtccaccgagaaaggggacgactcccagtaagcctgagctctaggagaagagaagcgggaacgctctccggagtttaggaacccttgtaacactcaaccttaatcccacacacaggagtagggtattacgctccatagcggcccgaacctgtataatcttgtcgcgcacacgctacctagcagccttcagggcggatacgcaatttctagaggcaagctccttcctccggccgaactgacaaaagggagatctcacgatcttccgctagagaggatcactcctcgacagtcgttaacatacgcaacctttgtcctaaaataattactccttccataaaaaaattataatcttaaagatgtatctggacatatataatgtccagatatattctaaaattggaacttttttttaacagaggagtacatttgtatcatttaatctaaaaaatgtagttttattgaggtgaaatactgcatttcttttaatcaagaatagcaattaagttggcttatggtctcaaccttcctttaaccaagtgtacgtatggaatatgcgcatacaatgcggctattaaataggattatcatggtaaattatatttgttgctaatctgtctttaatttattttgaaatgtaattattttgtgatatagtagcacgataacatttttcatactagtgaaagaaaattaaacaggcatatgaattaaaacttgttagcggagggtcagccggcatccatatcgaattatcaatcgggactctattacgagggtttagtgtcccacgggggatggtgcatgccgggatgtcgcactgctagattgaataatgtcccttgcgcagctctagctagatcgatcacgtacgatcggtacgtacgcacgcgccgcggcagctagcgattcaaccgttccccaacctatcacgcttcacgcctaggtacacagatcaacctgcgggctgagggtcgcattggatcagcggttatgtagaaattgcatgttgctactgtagcggctggctgctatctagtcacaccgaacaggcccgtagtaggtgtcgcctcctccgcgcgcgcgcgcgccccactgtgcagcgaaacgtggctagacgcacggcgcacggcacggcacgtacgagaaaggccacagctaaagccattaggtcgaggagaaccgcgctaaaaccccgccgatctcatccgaatccaaccaaaggaaacaccacgcggcgcacggcgcaccgcgcaccggccgtcctgctcctgcactgcaccacgccgatcgagagtaatcccactcgcccggacgtgtacggcgccccgtccccccatccttatctcgtcgtcgcaagccgcgcccgcgcgcaagcacgtttttctactgcgctagtatccctctccgcgtccagtactaggtaccctgcggctagatcgttacatgaggggaagggttttttgggctcatcctgcatgtacaggcagcacgcgcgcgcgagcccagccgcccacgcatgtgttcctccctatcaccaaagcaaatcgtacgcgagctttcgcttttgtcccttttgttagttaatctacctactactacgagctcttcctccatctactgcgtgcacacgtaagcccgtacgttcacatcacatgctggagccgtctgtgaacagattaatccctggagtttatctggctgacatggcggtagttagcgtacagatccatcatctagacgctctagactctagagctcatcggtcctgtgaatgtgagcgatctgctagcagaaaagcgttgggctctagctagctttccgtcatcgtcgtcggcagatgagatcattgggcgcgccttgcatatttaacttgactccggtttggttcagcgatttgtttaagacgcacttttgacccgagagatatgcggggtggtggtggtggtggtggttgccctgcttggagctgtacttgcgccatttcttttctcctttccatgtgaagtttgttttccacagacggattcctaaacaatggggtagtcttacaaattaattctctggtatttggtgtagtatatcatcagcctactgattgacggtagctagaacacctttcagttctgctttgtgcgtgtgtactggatctgtttgtgaatcactttaatttcggagtttcaatagacaatcttggaggagttaattgttcgcacgcatgaacatggagattctcgtgtagtctttttgaccggtgactacagcactgtggctagttgtagtagatagcacactgttcttgtggttgaacataactaggtagtgatctgatggcctgaaatgtatattctgacttcagttccctgactgtaatctagcgctggcgagctaattaaagaacgcataggctcagctagcatagtttgattaagaagcgctcttctgacttttgacagtggactctgttttcttgtagttaaacga

SEQ ID NO: 8671 - DNA, 2185 bp, Oryza sativa
atggtaatgttaatgtactcggaagtgccaatctatggagcaaaatgtagctagctgttgttgcaacgattgcattggacgcatctacctactatcgtagaaccaaagcagttttagttaagatttcccatgacgcattcactcgtccaggtactagtacatgtttatttcctcgtggtgcaactagctagggccaacgaggcgaacgtgaactgtggtaactaaccattaatttgtacatgtgagacggttctcttgataaatcagagtcagattcaaacagtgtaaacactgtaggctcgttcgtcccgtcgtacaacggatcacaataagcttttgtgaagggcgccgacgagacgaagagtggctagtaaacacgtgctttttttaagccttctgcaccggccgcccacatgaaacctgatgatataggagtaacgagtgtaaacgacatggttctcaaaaaaaaaaaagtgtaacgacatagcaagaaccattgtgttgtctcgccaatcaataataatgccatggagatgtacgcagcccctaaccctaagatcacacatgcgcccaccaagtttactgaaaaaacgcaaacacacaggcgcgcgcacacaagtttaattaggatttgtcttttttacaggcctgtagattgaagttagttgtgtacatttgtgaatcgatagatgattccacatatatgtttgttaatgttttgagaaatttccataaatacagtatttgggtagcatgcaaattaaaagatcgacaaggacatgcatgcaccccgaggtgtacagtagcctagcatgtgttcaagatgtgtgaaaataaccaaataataaaaggatgcacttctagaccagctacctaaattatttcaactagaaagaaagaccgctaagatgtgcgaacaatttatttattgattataaaaaaatcaaaaaaagttatatctcattatattcactatacgaataatagattatttatatcatgaaaaagaacatagactctgatatactaaatgataatatctattatattcaaacaaaaaatcactttatcccagttatgtgtaaactcgtctatcaccattcttcgcaaacatataagttaatatatattttttattatacatttgatccacctgtgtatgtacataggtaatatacaaaataatctatattgccaaaattattgtgctaattgttaattaaaagggatataatattgtggctaccacctgagtaacctaggtctcggtgttcaagcatgagcgaagaatgcagcggcagacggcatcgtggttgagcatgagtggagcagatggtagctggcggcatcggatcatgaatgggagggagtagatgaggtgatgaccgttgatgttcgcaagagagctggagaagaggatgcaatggtcgacaccaatgcggcgatgcgctggaggtagcggtcaatggaggaggcagggaggtggtgtacgagcgtacgagggagatcgggaggtcgctcaatcggaatcgggggaaaggttgatgcaaaattataatcttaccctcccacgaccaaaacacgattggtacacttgctctcgcatgggcgcaatatttggacggtaccgggctctttgagctgttagatcacgcgtaattaacggtcaaggatatggtaccttctcccctaaaggattgtaaaaagctcccacacacacatacacacacatatcatctccacaaatttgcacaaatattaaagtacaggtgaagtatgctcacactgcttatttattcatccactttctctaggatttttcatttttgtagtccacgttgtaaccatgattctcatccgaactccacaattttaaacaacgaacacgcagcgagcaaattggcacttaaaaaagtagttaaaaacaaggaggtcaggtactcactcgggcacatgcattagaatatgatccatttgtgccgaagccgaaccagcgtgcccatctgcccacaccaccggaaaggcggaaagcatcccaagggcaacacacgcatatcccaccccgaataccgagtaagatcgcttgtcccgttgccttgccagccgcgtacgtggtcctccccggccagccaagcccaagtcgacgtttatctcgacgggcgatgcgcgcgccacaaaatctcgg

SEQ ID NO: 8672 - DNA, 2312 bp, Oryza sativa
agtctggttccttttcctagtctatttagtgtgtcggtgtgtccttcctctctttgtaacccatgatctacattagcaggttgcagttacaaaattcttttttatgttaatatgccaatgcgtaaggcttttacgagttcaagaaaaaaaattacgtggttaaagaaaccaaggcccttcaatctttcatttgcccttgcccactaaatttcttcagtgtcggcttattcctaacgcgcaactggtgttgccaatgcagatgtaacaatagttcatgatgtgtatctctctctactccctccgttcttaaaaaaaaaaggtaaatctagaactggatatgacacattatacgtactataataaatctggacagatgtatatccagattcgtagtagtagatgtatcacatccaatactagattgtttttttatgagacggagagagtatttcttagcgtagccgtaagcctttaactacagcaccgtcagccatggagaaattacctgcaattcagcggtaggcctcgcaccacgcgctcgctcacacgatactgcatgcattacattatactccctccatttcagattataaaatattttgactttagttaaagttaaactgtttcaagtttgactaagtttatagacaaatataatgatatttataataataaattagtttcatcgaatcaataattgaatatattttcataataaacttgtcttgattgaaaatgttactatctttttctacaaacttggtcaaaattaaaacattttgattttgaccaaagttaaaacgtcttgtaaccttaaacagagggaatagtattctcttcctaaaactcaacctaaatactccctccgtttcgttttatttgacaccgttgactttttagcacatgtttgacctctcgtctaattcaaaaaaattaaataattattaattcttttcctatcatttgatttgttgttaaatatacttttatgcatatgtatagttttacatatttcacaaaagtttttgaataagacgaacggtcaaacatgtgataaaaagtcaacggcgtcagataaaacgaaacggagggagtatgatgtcacctccccgcaaaaaaaaatgatgtcacctatcttcaggttaagtttttttcctttttttttaaaaaaaaaggaatgaaggaagtaatttgcattgacccgatcatctgtcgcgcgcgtcaacgccgcctcttaactcgaccgatgtgtgccatgcgcacaacggaaaatcggtgaccgtttacaatgcaccagtcgtcgttgccccagccgatcactcgctcggacacatgactagagtggcacagctgcacgtatgtgtgctgtgtgaagcgagtcaggagtcaaagtcttcgcgatgccacttgttcttcttgagagttcaggaagagcagtttccatgtgatttcgcctctatagtacggtgattcttgacctcggaattcgtgagggtactattcagtctcggtgcacacagcggatgatcgtgggaatgcaaagctagcaaactgctctgtcacatgccagcaatgtcatcccaagtattgcatcaacaaacactcccacatttctttcacgtgatcctagcgtaacgagccgcggaccgtcgtttctggaaccacctgtttaaatatagataaaaaaaaactaattacacagtttagatgtaaatcacgagacaaattttttgagtttaaggggggtgtttgggaaaaaggggctaaactaaacataagtctttaagggagggacttatacttttgtgagagggactaatgtttagtccctagttcctaaacaccccttaattaggccatgattaaacataaatgctacaataacccacatgtgctaatggcggaattaattcggctcaaaagattcatctcgcggtttccaggcgagttataaaatttgctttttttattcgtgtccaaaaacttcttcaacatccggttaaacgtctgatgtgacactcaaagattttcatttcaccaactaaacagcctcttctaagcaggtaaacgtgcaagacctggtaaaatgatattccatccgtcccaaaaaaaattattaggacagtaatgaatcggacagtgaaacggactactaacctgtggccgtctccagaccagctgtcaatcataagagctgtccgtcctacgtggaggacgtactaggcagccgccgtgcttgaacagactagttgacttggatccaacagatagctcacttttactggaatcatctagctttccaaaattgtcag

SEQ ID NO: 8673 - DNA, 1576 bp, Oryza sativa
ttcccacggatccgttccccgcgccggcgtggacacgctggacctcaacacccaggcggcgtcgggccaggagttccctcacctccacgagtacggtgccttcctccagggtggcggcgaggaaggagctggccgcggccgaggctccggtctccctcccatccgtgcaccacgctctctgggagtgagggctggtcgagggggcgccgggccatctcgtgctgcaccgcgtgcccgccagctcaacttcggcgcggtaggtggccgtgctggacacggtggaaatggtgggtcgtcgtcgggcatcggcggcggcggccctgggcgaggcagctcctcatcaggggcaacgggtcgccgtcggcagcgcgccatggcaaccaaccgtggccgcgaccgcggacgtgggggccgcggttggcgtgtgccgaggagtgtcggcacccaggaagcacccatcggcgattacgtcgaccttgacgaagaaggtgcatgggacgatgaggtggaggaattaggcagcttcggcggccctccggtgagcattgctgaccgagctaactggactgataggaataatagtattttgttagcattgtgcatagagcaagtaagagcaggccactacaatggtagccaaatgaattctgatggctataatgctatagccgagggctaccatgccaaaactggtttgatgcacagtcgtctgcagctaaagaatcaaattgggattctcaagagcacgtactccttctggcgttacttgcaaacgcacacgggcttaggaagaaaacctgatggaacagtcgatgctgattctgatttctggagtagtcacatagaggtacttttctaccattttttttattgctgatcatgtttttttgggttattatctgtctgcgtttagtgttcttatgtttggattattcttgcaggcaaaccttacctgaagaaggtgcttaaaggacttccagcaaacttggatcagcttgaggagatgttcagtggcagtactgtcgatggtagcactgcttttgctgccggtgatgatttcggtgaggcacaagaaggggctgaagatgagtgggcagaagaaacagaggagttcctgcaaactcctcagagtacaagtagccagaagagcaagaggtccctcgacagcactaccagcacatgtagcactccagtgaagaaaagcaaaagccccatggttaagtatgtgaaggacatatccatgtcattcaaggaggccatgcaaatcaacagccaggaattgaggaagcgtactattgagaagcaggctgcttcagtgagaaattgtatgaagatggccttcgagtgtggaattgagccaccactgagaatatttttgcaatgtccaagatgtttgagaatccctaccaaagggagttcttcgttggactaccaaaccatgagcttaggttcaactacttcagcaaatggagcagggataacaacctggtttagttaggcacctcttttatgtggtccgtttgttgtgtccaggaaccgtttggagcttttgttatgtgctgttaatttgaacctc

SEQ ID NO: 8674 - DNA, 735 bp, Oryza sativa
caatagatatagcagttaaaaaaaaccacctcatccccacttaccaccaccaataggctcagaaaaagagtggctatgtaaccattcaatagtttgctctctgtgatatttctccctttctcgtggtgcactgtttcatcatttgcttgattcgatccaatccaactctttcgaaaggatttgtcctcctcagccttctttctttggtccccgcacatatggctatgttcataacttacttgtctagcatatatggctatgttcataacttacttatcccgcacagaaaacaatgtaacttattagtgtataaataattaagtattaatttttaaaaaacaaaaaataggttataatatttttaaaataacttttttatatataacacattatttagtagctcgataagtatgcgcgtagagaacgagaaagaaaaggatgtaaattcctagttctgaacgaggtcgtaatcctctttggcttcttctaatgctagtgcattatgttcggcggtatttattcccaacacatctctcgtgttccgtgcgcacacttttcaaactactaaatgatgtattttttgaaaaaaaatacaaaacttgctaagtattttttaaaaaatagattgatataatttttaaaagcaactttcgtatatattttttttagaaaattcacaaatataggaatttagaatcggatggaacactttatagtagtatgaatatgaataga

SEQ ID NO: 8675 - DNA, 3355 bp, Oryza sativa
tctgtatctaaaaaaccaaactaatactagatatgacacatcatagtactgtaaatctggatatatctttatctagattcgttgtactagaatatgttacatctcgttctagatttgttttctgtgggatggaggggggtatagtggtggcggtagtgaatttgccacccccacctactctcatggtaattttttaatttagcgcttaaactctcttagtatcaaaatcaatcaaattttaatggatagtcacaaataaagtcaaattaagatgaatatttcttatagcaaaatgatttattgatactccctccgtcccaaaataagtgcagttttgtactattcgcgttcaacgtttgaccgttcgtcttatttgaaaaatttttatgattagtatttttattgctattatatgataaaacgtgaatagtattttatgtgtgactaaatatttttaaaattttcacaaatttttcaaataagacggacgatcaaacgttgggcacggatatccacggatgcacttattttgggacggaggttgtaggtaacatatttcatggagaatacatattttatttattttaagtaatattataagatatatttttttacttatagtaaaacatgcacatataactagtctaaaaaaatactactactattctttatctgttgcccatcaagaagacgcaccaagtctccggtttagaccccccaagtcttcccccccgcgcaacagcactccggttttagtaatgcatacgccgcagttttaaattgcctcattaactttgtagtggtaccttgcttcccccactggcacactacctagctggatcggggtatacatccaacagtggcatatatctggtgtgtgttgtgttgttttcagtttacacaggagtattaaaatcccacgagacgagaggagagatagcacagctaacacactcatcactagcagccgcgcgcgtgagagagaaactatggagagcggaggccgcgcatgcgccacgcaagttgcaacgtgcaagtcgccgctgcaattactctactggttcgtagcgagtccacttgcgcgcgtcgcggtcgcggcggccatatcgctcgcgccccggttgctgcttggctttggcattggcatacgcattctctctcaaagtacgcccgcgtcgcaacaaatctggccaaatttctcgcgctgttgttttcgcggcgcggcccgggccgcgggggtaccagcgggcgaacggcgtgtacggccaaaaagcacagcgcacacccacatcagaaattctaaggcaacttgcaggggtttggcacgcgccgacttatcaaccaccactactcagtactcaccatcgcgaacgttatctcttcgacgcggatcgaccggtttgtttaagatagaaccgatcgacgtgcaagggtgcagcactggagggggcaaccaaaatcgtttttttcatgcggctcagcgacccgcctggacccacaggtctacgaaaatcatcttttttcatacgtagagcccaaccgcatgtgaaaaacatgatttttatatgcggtaacctatatcaaccacatacaaaaatagttttagagaaaaataaaataaaataaaattccccaaaagaaatttagcataaatccaagatttccattctaccgaaaccctagctcctcatcgtcgttgcagcggccaccgccgcaacccacggtgccacttctaagggtgggggcagccggatccgcacaccaccaccgctcccgaggacgggggagtcagatcccctcacccccaaggctgcctccgcctccgctaaggccaccatcgccgctctctcggacgggtgcagctggatccgcgcgtcagcaccgcccgcacccgagaccgccttcgtcgctcactggcggcgcccacctgcgaggtcgtcacctctgtctcagccgttggaggtggagaagagatggggtaaagagaaggggaagagatgaggtggagtgggagaggaaggcgaagagaagcggttttggagaagaagagagaaaaaaaagagtgatacggtggagataaggaggagaaaaaaaaaggtgtgggagaaaaaatagtgcggggatgcgtagggcccacttgcttgctgctccaagttgccggcatgaaaaaatctatttaatttttcatacaatctcttaataagtctgtctaaaaaatagacttattttcgtacgtgatctcgatagtaaaagaaatatcgtttttataatagttccagtaaaccgcaacgtttagttctcgttgtttcgcacatcatttcatttttacctgtcgttgaggatataaacactatatcgatctaacatgtgccttgaccgttacctcttactaatttgtagtggtcgtacgtcaaggggtgagattaatgtccatccccggtgtcaaggtctagactttgtgttgtttcccactaatcttcattacgattacatatatacgcggcgtagttcagtgaacaaattaatgcattccacactccactagggattgggtatgccaccaacaagatgtgtgcgcgtagagcatatgatagtttgttactccctccgttttacaatataaattattttagcattttccatatttatattgatgttaataaatctagacatatataaatatatatgtttatatttattagcattaatatgaatgtgaaaaatactagaatgacttacattgtgaaacggaggaagtacgcatctagagtacgtttttatcgtagttagtacctcctccgtcccataatatatgggattttgaatttttgcttgcaacgtttgaccactcgtcttatttattttttttaaaaaaatattatttattttatttgtgacttactttattatctacagtactttaagcacaactttttgttttttatatttgcaaaaaaaaaattaaataagacgagtggtcaaacgttgcaatcgaaaactcaaaataccttatactgtgggacggagggagtaccttttgttggtagctaggttaatctatatcgttttaacacgagaaattcaaatatttctgcagctcagctggcctccgggttgttgaagtttgacaatacaaatgctaaaatggtactacctctatttcaagttataagactttctagcattgcttatattcatataaatattaataaatatatatacacatatatgtctagattcattattattattttatatatatatatatatatataaatatagataatactataaagtcttataatatgaaacagatgaagtatcatttttcttccctttcaatgtgggctgcagg

SEQ ID NO: 8676 - DNA, 3320 bp, Oryza sativa
tattggatacggctacagatacggatacgtattgcatacgccccgatacgtatcccatacgtatcggccatttttacgattttcagataataaaaaatatttccgatacttctccgatacgctgtaaccctaaaatcatcgatcaaaatccccagccaacacacagcgagcaaaaacccaccaacagcgccacctccccgaccccaactctgctcgcctcttcctcgcgtcatagcgcagcgccgccgccgccacgccgtgcagcaccgccgccctccgccgccgcaacgccgcacagcaccgccgccctccgccgccgtgccgcaccgccatccccttccgctgcgccgcgccgccgtcgccctccgcccccggccacagcgccgagcgccgccggccgcagcctccagggcgcagcaactccttcgtcgggctgccgactgtcaaccccagcctccgacgacgggctcaactgcttctctagaagactagaactcctacgtatagcacattatctatgggagagctacctgatgggcctgatctcctgtcagagtgctaaaagatttttggtgcattggacctgttcgatgatatggcactatcaatgatacaaacaccaattaaacttatttacctattgacagttgaacttgatatcctgactagttcatgccctgtaatgctatctcttttttctctatttatactcttgcagttatttatgttttctttctatattttttattttttaaatatatataaacgtatccccgtatcagtgttttctaggaaatgccgtatcctcgtatctccgtatcgcgtatccatatccccgtatcaagataacatagaggagctccatccccattgctctttgttgagtccgcgttgttgtcgtttgtggttatatccatacagcagagttagcaatcaaatctaacgtgcttctctctctagctatattatgcactgctactgaagatgcatgtaggaatcgtgcacggacgtacaacaatggctggacgctcagataatggcgatggcgctctgaccaagtgcgtgaaccaagaactgcatcatgatgaacattttagttttatttacaagtggaaaaataaaatctccagtgctggcaacgcacgtttatattaccattatggatacaattttgagatgatatcatcaaagtcggagctaaggaaagtaagacattttccaaccgaatgagagcctcattagttgctcatatttcataataaaccaaaacatctttatttgcagcaaattaaaagacaatactaaaaataaattacgttgaaaatatcttaaaatcaactttaaaatgaagttcaaaattcaaatcttgacttttgctttggcgtattaggctaactgatggggctctgagtgaaggagaaagagtggaacttgaaataatggatcagaaccctttaatgttatattagcattgattgaaacacaaattttaggggccctagtttttggaggcctatgccatctctttaccttgcacttatctagatgtgggcctatttatatttttaaaaatctaactatatgaaggttttttgcataatataatctttatatatatggggacaaagtatatttgaaaccaaagatagcactagggcatcatctttttcatgatttattactacatacaccattgctaccttggtcaccatacgcataactgatttcaattaattgtatatttgtgttcatggtttttactttccaaaagtttttccacgctaaatttgtgcctcagttcttttggcatcatgtaataaagctatacttttctttctgtcatatggtacaaaacatgtcccagtatacttttacatggtgtttccactttccagttccttgtttctatcacactcactaggaccaaagaattcccctgttgacgcaatatcccacctgattcctccaaaatttccagaaaagacgcatactagtccatgcatggcacaacagaacactccacaatgcacaggtcatcacacgcaatatatatccacccgaacagaataaaccatggatatttaagcaacactaatgcagccattgctttgatcaaagcaactgccaaagcaaacccaataaaaagaagaagaaaaaagaacacagaaaggggccaagtgtgacatggcgagctgcccccaagggcacattttccaggccaagccagctcacatcaccagagcaacaagaacaatctatcctccatctttatccagctaccagctctcgatgaagccatcccgcggtatccatgggctgagctgactgcccccacaaaccaacacttgccactccctccctcatctcccctgtgccgtgacgtcgttctatccaaagtccaacacaacagcagggcattttttatacggttccagccaccgaaaagaggaaaagataaaaaacacacacacacacacaccagaacaaaagtagtatagcaaaccatcagcttcctcctccttccctccacgcggacatggtatagccgtatagggggcgcagtatggtagcccccattgcccccatacacaaacacattccggcatctatcgcaagccaaaccacccacccacaccccccacccaccgttcctatatatccctcctcccccttcgtctccctcctctcctacttatcctacgcttgccgcctatagcatcgccaacagaaggaagcaagagatagttcgagtcgagttgagttgcatccgtccgtactggggtagaggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacgggctgcagg

SEQ ID NO: 8677 - DNA, 719 bp, Oryza sativa
atgcggtagacgagctagcttctggttaaagtcatttggctcaacagccacacagatgcacagtattgggcagagagacagagagagagagagagagagagagagagagcgcaaaggacacaagcacaggaacaaaaacaccagagaggcagcctgtctgacttgggggaccgatcgatccatcgacaggatcaccggcacgcggctgcgtgtggaaagtggagacgcgagcaatgcaagaagcagctgctcctttccggtggccagcgacccagcgccgcagctaatcgttttctttttttctatctttccctgcggctctcgctgacgccgtagctgctgcctcgctgcgtgctggccaatgcagggcccgtagtggccacatgcagcaggtccagcccctgccgtgttgtttctgcccatctgattctcattttttaactctctctcccgcgttagtatggtcgatcgccgaatcatggaaaacaatcaaacatgcaccggcaagacaatctttttgccttgcttgagaaacatattaactagtgctaacgcagataggggtttttgcacaatctctagcaggcatgtggatggttgctgaccggctgttatggcaagtcaacccaatgttttatggtcggatttcgaagcctgcaaaggtgcaatgcctactgggggtaagttggttttcttggtttttccaaacgttggcgttt

SEQ ID NO: 8678 - DNA, 1114 bp, Oryza sativa
catgcttgatatcttcagccagaattatataagaacaatattagtttgatccatcatgcattttatttttctcactaatccttattatataaaaagcattaacattttatgatgaattttagatacaaagagaagtatcatggtaacatcattctgttccatgaactaatcatcagattcaatccatttacctttgccctgagaatacgtcccaaccgttgagcttcttgacgccgtgaaccagcatgagatgaaatttgtatgatcacatttgcttctggaatatcaatcgagttatcacccacctaagtgacagtagatatgcagttaagatgatgatggttgaatctacaaaagtatgttttgaatcagaatatcagttactgcacctttgaaaggaaaattgtattcacatctgagctgttcttgaattgatgcaagaattctcgtcctctcaacatggctgaatgttttcaagcagatataagcatataactaatggacacaaacattctgtataaaatgagaatcaccttgtggaaccataaatcattggtttacggagcttcattgcgtagctagttagtgcaaatagattatcggcaaacacaattatcttgtccccacgttgttgctcatggaatcgaattagaaactcgcaagctctgaatttgtttgggttcatcgcatagaggacctgataggccagggttagtgcaatcctcgaagatgacaagatttgataaacaagcacattgaccaataaattcatgtctggcatgtacaaagcacaagaaaaccaacattttaatgtaagatgatttggttttctcctaagtcaaacttctccaagtttgatcaagtttatatatagaaaaaatgtaataagattcacaatgccaaattaatttcattaaatccacaattgaatataattttataatattatttgtttggtgttgaaaatatagctacgtctttagttatttatgaacttagtcaaacttaaagaagttttgactaataacaatagcaaaacattttacattctaaatggaaggagtatcacaaaaagctatactagaaattggaacatgtggactttatattgcaa

SEQ ID NO: 8679 - DNA, 1466 bp, Oryza sativa
  unsure (1)..(1466): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcatatataatggagtatcatatatatacatacatgtggcctctcctttgtccttttctcttgcaggaaacaggtgccattcttgacatgtatcagcaaagctagtagctagccagggtccagggcgggcatgcatgcagtagcaagctatgcctgcactgcatatcatgcatgaatgcatgtgctcgatcggaaatggggtggcagccttggcgtacgcctgccaatttaaccaagccactacatggccggcagactggccactttactttgtcctctccctgttccgcgtacaccgcccggatacatattgccacactgtttgatcgatcgatcgtcgatcgatctgctttgatttctctttttttttttactctcttctcgatcaccggctacagctaccaacccggtccccggcatttttagtttcattgtgtacatcccgtcagtcgtcgttttactgttgcttggtagtcgttctatgtgtggtacgttcggtggttggtctatgagcttcaagttctgatcaggcagcaatggaagatatatactaccagcaagaatttgaatccatctattatatacaaaggcagggctaaatgtaacatcctagcccttttgtttgtatcttgtagtgtggtgatgtgtggtttaggtccgtgtggctagatgtgtttctagtggtggtttaatgctaccttaccccagtttaacccttttaaatgaagcggaactatatgtaaccttttacacgtaggatggtaataaaaagtaagtggatactatgtaaacatgggcctgttcaacattattaagagtggactaacatggattttggaggctatgtgttgagtgttacactaaagaggccaatgcaccttctctatatgcctagaaattataccatattagttggagaaaaatatataaatttacactgtttaatcgtgactttctagaaaaatatattatcgatattagttgtatacaataatatacaattgtaattaatatttataaaaaagaagcaagagatgtttataaaatcttactttatttttaaaatctaggtccatacaaattgtacggaaaaatctgctagctagttatcaaatagatatcgggtgttcatcttttagtttttcatataattttttaaacctcaaaaccagtcttcttcaattcaaaagctttggctgattgttggctagctaggcacaat

SEQ ID NO: 8680 - DNA, 3158 bp, Oryza sativa
tactgaaccaggtcgttagcttgacgtatgcacggtcaaatattttgatttgattgttacaataacattatcggcgatggatgaataataatgccgctctccgcgtttgtgtttagcaataattaaagatcatctatctgatgatagtagctgtcatgatgacaattaattaggtcaattgcgtaaatttcttgtcaaccggtggcttctagtccaatcgtagaacaggtgtggcttgtggttaacgttaacatgcatggctcacactaacctatctcatctgggtagtattcccttgctaggatttcagtgtttggttctaatctctctatcaaaacttggttaatactgccaatactgcatagtgccaaaatgttggtaaggacagaaatgaagtgattgtgtttggtactttggtttggtggttggtgccaaatagtgttaattaatgtgagatgaatatatcagctagcccagcccaatcttactagagtaagctgtttatcaaatgtttgtctttattactttaccaaaattttgaggggtaaatgaatcaaccaaactagctagctagccttgaatctctcgaaacactactatgagaaccaggtgacccaactatacccttttgtctttgccaagaaagaaagagaattacctctctggttcttgcctccaaagggctggaattaaataaactggaatggtacttgttgctccaacaccgtgcagggatctacagcatcataactagtaccctgtagctctcactgcaaggccacaacttctctatcagaacaccgtacaagatgctccagatcagttgctagctagctcgatcacctatctagtagctggtaactgtagaaaaaagtttactgaaacacacaagacagtgttgtttaccttgaaggagcaagcaccgtatcaatcgtgaccaccatcaatgttaggatactgtagacgctgatagattgtacttggagcttgggccccggacagcgatgcaggcgtagtagcagagcagcaaatgcaatgctttggtcttcttccatcagaggggaggagagggggggggaggggggtctcgcttcatcaggtgcccaatcctatcatggatctgaccattcatgtgggtctctctcccttcactctacagctcacacaccaatctcttcattgattgtattttgtcatccttatcagggcttgttcatcttttttttcaatctgttcttccctgcgaaaacggggaaaaaaagatctcaaatacgaatagaattcgtgcaggctacaagtaggtactatcagatatggccgcgtccgaaagttttcttccattatctcagaaaaaaggtacgtggaccataagataaccagacaccagtactctttggatcgaaactaagataataaagtagcaaaaatgaatcacttaagagattatcagccctacctgaacagttgccgactgcagctagtgagtggaaacatcgtccctcagatgacaaccttgacaacacaagcacaaacgaacgcacaaagtttcagagagagaaaaaacatgggtaaaaggagggaattagcatattagcttgcacatgaagatcagctgttcactgtacctggggtatggagttgtcattcagaacacagtttgtccaggacaccttgttgcacataaagctctgatgcccatccaacctggtctggtcctgtggtatgtcaaggcagaaaagatgttgttgagatatgtcagaatatttgtccaaggcaatcaggccaaacagcactgaggacagcaataatcttctgttatttgtcaaacagcagagttctggagataggtcggaatcagagatgatcatgtatatattttcctggtccataaagcaaagctacagaatggggttttcagaccttcaatgatcatcatgtcagtgccatctgactctcaggaattggcaaatagccattcatggatggagcaacacaggagtagctatggcgtcgcactcgcgacaggaacagatcgatcacacgagttaattaaaaaggagaggttacatcgttttaaaaattattggcaacaattcggtgacaaaaagaattttgtagaacccaggctaatcactagcaggcaattacattgtaggacccccaagccatgtacaaaaagaatctggaaaagaatagttcattagctaggtcttttgttctcctgtcggcaattgaatctgtacatgctattgtataggttagtgacttgagagattcaagtgccccatatgttgaatatgtaggaagatctagacttggcaaaacatcccgaaaaaatatttgatgtattgcagctgtatcttgatcattctcgtctgtagaacagcacataagcagcaggtgtctttatactgtcttcagttataggtctcacgcactcatcatcaaacttataccatcccttcccttcttcatgctgcagaaaccaaccagccttgctcgttatcaagacattgaaaaagatggtttaaaggctgggtgtaatgagaatacatgaaagaggaaactcacgtagatgctggcggtgtagtgtccacctcccatatttccatagtgattgctaatagcatacaagcgatagtggcagtctgatagttcactcttgtcaatgatatatgatgacagatccaaatcactaatggggaaatccacaaatgtctcaagcttatttcttgtgaattgggtgtacgagaaccttttgagatgaatgacaagaacttccggtagcctccacagatctaatttcttcatcgcttgttgatgctttttgcagcatgggcagtacctgaatgcaaagcagagaaaaaaagtgggtatcagtaatgcaacaacagtacaacagtacacttccaattcagaatccaaagcaagctagccatgtattgaggtaatattttgcaaaggtaatcaatctatttcagttcatacatacgcacatcaacctattttgggttaacaaaagaaatgaagattgcaaagaaggctattcaataagcagtgaagccaaaagcataacagttgttcctcaggggggcactcatgactcaccacatgtcttctgggcccaacggttcctcttttagaaaggcttccagaca

SEQ ID NO: 8681 - DNA, 59931 bp, Oryza sativa
  unsure (1)..(59931): unsure at all n locations
agcctgaacaagatcattaagactcccaaattgtggcacagtgacatcatatgagattggctctatactaccatcagtgctgaaaactgtaacagtcattgtcctctttgccgtggaaggtacaggcaaagacaagtacataaatgggtcaaaagtgacagatgttttactgcaagtagggcaagttaatgtagatttgtactgcccctgcaagtagatgtcagaaaagggtcaatggcaggagaagcaggagaaaataatagtgtaattgctttaacacatgaaaaatttaaagaacttacatggtaagtatcaactattacagagtcatttcgagctaaatgattactccagtactcatcagccacttctttgtcagggcgcccacttgcatccttagcttcttcatatggcttgcacttgacctggttaagatcttcatggaggccatccaataagaaagcaagaagctcctgtgaatcatgctgattgaagccactgaactgaggggcaaaacaagcaatctttgccttaaagtgatgtggtgaaactggttttctctcggtgttccataatctcctcaataattctccaaatgccaaagcaagttccccctaagtaatgaaaacatcagtgaatttagccgatatattcaaaggaaacaaacagtaaactcatgacaaactatacatacattcagtcctagtgggttagtccgatttatatccctgtcataatctcctaggaaataatcaacaagctttgatgtgtgggccaaacattgaattgaactgttcataaagcaagtattcccaagattttccaatccaattagcccatgcgagctagatcttccaaagcttccataggacaaatcaacatccatatcattaacatctgcagaagattgttctgtatactctttgctggttccaccaatcttggaagttaaggagtcagacattgcatagacttgcacttcaagaatattctgcacatgccaaaaaaaatgataagaatatggatctaggaaggaaattttatgcctgattctgaaacagaaaaacaagggtatcaagcaggggagtatcaactgataatacctctagctctgagtggcagcagtcatgatttgacctattccactcattcattaatattaggtttgtctggcctgaaatcccaaacatgaacctggataaagaaacattaagtaaactgaacaagtgggagtatattgctgaacttgaaatgcagacaaacagcgacatactggttgagaatccatatcaaaaatcttgtatgcccgtttatagttctcaactggattgtcctgaaatagaatagaaattgtaaggatgggcatgagaaaaaaatttgatagagccatatatcatctgtcaaataggatagcattacctttttgctgatcttcacagtcaaaatgcttgtttctcgaacagatatcctaagcaccaaagggtacgcaccagcactatcctcagcaaatgaatgtttattatgcaatgccaaactagaattttgcctggagaagaaaacagaaataaagtcagcagaaatagatgcggcaagatggaagctgtaaattgaacctattaggcaaataaaaaaataacacagacaagatttcatgaaaattgatattctgaagaaacatctttggcatcaaggtacaaaacaattggacgacattacagcactgcagaatatatatattcctagaactgaaaattaatcctctgctctctctcacttggcttagctgacccagacaaggaaagagctactcatgtaagtgtgagtgctgaccacacctcatgctgcaagcagcacgtgcacatgcacaggaaatatggtgaggccggaaagctaagtgcacgctgcagtgaacagctgagagctgagctgaaaaggaagatgtaatctgctgtgattggtggaaggcaagaactgagcacattgatgaaatgtgctaagcaaggagaggatgctatcagcacacagatatcaccacatggtccaaaagtatattgtccaaaagtgctcaaaatgcacaatagtataacaaagacaggcataatggtaaacatagtgacaaagtggagcttgaatggtattaaaatataccaagaaaataatgtcatatttagctaacattgggatctactgagaatacatttaggtacttgccagcgacagagaaaacgataatatatagaacagcagcttctttctagttatcctattcaattaatcatcaatcctctagactgcagattctttgttattgaaatataagtccagacttgagaggaaataggaatcgcatgtaacaatagaaagtttatattattctatatgaaacattttctagcctaacttcagcaaaacaagtttaccttcgttaccaagtcttcttcttcgttacttgtaaggaatatttaaaaccaaatagaactcctgaagattaaaattagggtcccaagaaactcgtttcagggagagctatagcctaagaagctggattaaaggtgcaagaatatggaggttcagaatataatcctactcatgtctcacatataggggtattactaactgaacatagacgaataatttcaatcacaattagaattgatgattatgcttactgtttgaccaaaacttgctactcaacatagtgagaagagagataaatagtggctaggttgcacattgttttctaaaatgaaagtctaggttaccaaaatgcaaaacatgagatgatattcatggatgcttctgtgataccaaaataatctataaaatcaaacccaacaaaagcccctgtcataaaagcagggccagcctaggattaaagggaacccatattgaattgctttccctctcaataattgaataaatcctacagaccagaaggccctatattttccacgaaagtcaaaaatgtgcacatgtgtatttattatcgtcttttgtcaagaaacaaaaatgtatttataaaaaattgcacctatcaaccaatggggtctactggactaaacagttgagcctcaacacttggtatgtgctcactcagtaaatcctatttgcaaaaagatgcagaacagagcaacacacatcatatgcatgcatgattttattgacaagcatattgcagaaaccttactttggaaagcaataattcaagtaagaaaacacagcacaaacttaagtgcagaaaggaagatgaacccatcagcattgctgttgagacactaaactctcactagataatgaatgcaaaatttatgcattattaaaagcaatcattttgagacaggtttgatttgcttcctaagaaagccaaacaaaaaaaaaatcctaactgcaccctccaagtttgcgcaacatggagatgcgaacaatgttagcatagccctgcatgaaatgtaagtatgtaactatatcatgacttacagttttatttattttacatgcaattatattatgttgagaacttcagcttatagagaaatttctttaagagtaatttatcctggcttcccacaaatcagaagtgaagctgcatgaaacgctacagttttaaaagtccgttgcgtttgcaactgtccatgccaaattgccagtattgctatgttagaggttcaaaagttggaggaaagaatctatagcaaaggcatagagctaaaatgggctaaaacatatgtgtctagactgaaagggacaacatatttaaccatcaagcaatgcaagaaacaagttcaccacctagcaaatggtctggtacaacctacaagccctgccctcagcatcacgttgtggctctagtatggatagatgattgccaccctcacgttacaaacgaggcactaatctagcttgaaatgctgaattcatcctttcgaggtcacataccaagccatggagcattcccgagtttcagggattgctaaatacacttcccctaactagaattcaagcttattgaagttcaaaaaatcatggaactcacaatacattagaaactaattagatctcaatgctgaatcaaccaggtcaaaggtcatgtatgtacccataggaatcaggaatgcatgtaccagatcattccacttagccacatgattgaactaaattctattgcgctcactagcatccatcaatacccctcaccgagtagccaaaaatgaaaaaacggaagtaatggagatcatcccccttagccacatgattgaactaaattcgattttgcgctcactagcatccaccaatatcccccccccctccgagtagcccaaaaaaatggaaaacggaagtgccattagcgagtctctcacctcgcgagcacacgcgagagctcgtcggccggcacgagcgcgtagctccgccccccggcgccggcacccgtgccgcggcaacccccgcgctcgaggcgaagcacgagatccgggtggaggaagctgtggagcaagcgaagcccgtagtacgacgagggcgacgccgccgcggtcgccgcgtacctcaccccgccttccggcggcgcctcctccctcaccctcgcccaccacctgcgaaacccacattgccccatcaaaaccaaaaccaaaaccaaaccacaaccaaaacacagcgaagatgatgagtaacatatacctgaaggggacgaggcagacggcggagtgggaggaggaggaggcggcgggggagccgcgggtggaggcggtggaggaggaggcggaggcctgggcggtggcggcggtggccatcgcccggaggcgagggcgagatgggatctggggggcgaggatgcgtgcgggaagtgagctgtgtgttgtggcttcgcttcgtttgatcgctgggatttgtaaaattttccggggaggaatttggggcgtcgactcgtcggggcttgggtatatgtgatgctgctgctgctgtgcttggctggctgggtagccgtttctttgactgcttgctttgcttgctgtggttgctgccagccaagcggcgcgagcagcggtgtggtgtgggtggatggctgccgccgcgtggctgtggagatgtggcttgcgtattggggatttggatttctgttgcggttttggctgggcgtggaggattagtattaattgttttttttaaaggcactttggtggttgtgacttgtgagagtgttagccatggggggggagcccgcagcagcgaaagatggagtgtacttgtttctttttatagataatatggagtgtttttgttagtctgagtattgttatgcatacaatctagttataaaactcatgtacaagtagagatatatggccgtatatcaatcaaggagagtatgttcatgtgcactgcggtcgtttgcaaatagttgattaaattcggtcgtacgtgtgtcggacagctgggtcgtttgcatagcgatttccttgttagtccttagcaatattttgcaagcattttcactaattaacagtggagttgccggcggcggggtcttggtggctgcttgactagcccgggagctagattggtcactggtcttgtatgagcttacctcgtatcacgattggattagtaatatagaggttatgttactttgagtcttacacacttgtattttgatgtaaacggctcatgcctatggattttagtcttactttgagtcttacacacttgtcatataaagtttgttttgcttatagatcaatgtgttattttacgccctagttttgtcccttaggtttccgatttcatacttctatctaacagcctcatcgtttgtcatattttctgaatatgccaaatggcatatttgcaaacgagaatcaatttgtgaataaaacttttatatatgtgttcttagcgatctaaaagcaaaggctgaaaaataaacttcgatgaaaaaaccccaaaatcagctccaaatttaacgttgaaaattcaaattttggatgataagcatataaatatgccaaacaatgaggccctaaatgaatacgtattgagctttcgtgtccagccatgaaaataaacgaattttcatgtgttatagttactatccagtcatagcctcttaattttagatgaccaattaatttgggcatatttacagagtacatgatttttcacatgtgctaagtttttgtcaataggtaaatagagataatagcgattttgtaagtctatcaacatagcatcatctgtaaaacattcaaattctataggaaataaaataatttacacatgttccttacccttggccaattaattttacataactaattaatttgggcataatatcgaagctaagagttttcatgtattgcattcctcgtaaacagataagtagaggtaagagtgaattcataagtacatattgacatagcatcatctataaaaaaaatgtctatacacacgactagtgtgtacgacttgtatccgactagtgtagggctgctacatacctaggcctacataaagagatgttgaacgtattgattgttggtcggatgtgggttgtacggctctagtcgtacgtatagcagaactcataaaaaaaacacttgaatttcatacaaaacaatgtggggagcgtcctatttcctaaaacatttatgcaatattccttccttctaaactatcactaatgagatgctaacagataggaatgcaaatgagcaaatgtgacccacaactacatggccacaactattgagatgcttacagatgggtagacaatccttggaccattgcttggtgttgtgttgcaaggagccacttttctccaagctagctcaggcccattggacttagccaagatgaacatatgggctcatcaacctcagccatggcttcatcatggtcccctgcaatgctcacatgtgcactgctggtgtcaactatcaaatcaagtgatgttcaatcatcaataattaatcccccctataagtatcctccttatctctttgctctgttcatttgaggtgcaatctctagtgctccctaaaaatgaaaagtgatgttgacaatgttgatgctgatgtaccatctcacatcatgataattgataatatcaagtgtaagtactcaagctctactttttgctgctattgcaaatctttgatcagattggtttatgtatgcagtcccctaattgcctctccatttggctgcaagcatttgtaacacctctgcaaatggttttttgctactgtgatgcattgtgtttgctgaatgtgatacatcataaagtagttgggacttgggaattgattgattcagtgcatcaaaatcttcagaaacttgagtggtgacatgcaatgatgcaaagctgctaagacattaacacaccagctttcttttaatccaaaaggctatgcacaaacagcaaaagtgtaaagctgcaattgcttgctcttctaatctgtaataataatctctctatatatacaggaccaccacagcaagagaatcctaagttgcttctgtcagaaatcagaaatgcgctaagctgctgaattatgtcaggaaacattctgaaatccacaccaaaagatgatgaaatccagcagtttaatttggagctgattgccatttgtcaaagtcttttttcatgaaaccaccaagtttcatcagaaaggaaactgattgattgatgcatgcaatgatgcaaattaaggttgtgaaattgacatctaaactaagcatatatacatcacattcacatatgtagtttaactgaagcaagtactagtagcagtagtggtagtttatgtacatgacaggccaaccactaagtccagacacacactcaaaaccatcaagaggggtaattaattactactaaaaagatataagcagattagagtgagtgaaaagggaggtggtaattgacaattaaccgctaattaatttttactttgctactacaagcaaagcgcgcacatgacgaggccgttctcgttgcagccgcggcaccgcacgccgcgaccgcgctcgccgtcgaacaccttgcggctgccgtcgcactcgccgcacaccacgaacctgagccccccgcaggcgtcgcacttggcggcggcggcggcggcgctcctgtttttgttgctgcccggcgagaggagggcgaggaggcggccgtcctcgtggagggcgagcacctgggcggcgccgccgacgtcgcggccgcggacgaacaggcgcgggggcacggccttctcccccgtgacggaccagagctcgtcccggaggcccctgtccatggacacgtcccgctcctggaacgcgacgtcgaggttctccagcagcgcgcgcacgccgttgcagtcctcgaacgtcttgcggatgccgcggagcgtggtggtgtagagcaccaccgccccctcccctcccggcgggcacctcgccgggaactccctgagctgttcctcctcctcctccgccgccgccgcggcaaccccaacccgaccctcctcgtcgacgagctcccaatcatcgatcggctccgccccgttcttggtcggggtctcgtgggcgtcaaagaaggacgcgtcgtcggagaacgcgtcacccgcgaccaccaccaccgccgcggcggctcgccccggcttggtcggcgacggcggcggggacgcggcggccggaagcgaggacttgagcgcgcacaggatccgcgccttgagcgtcttgatgatcatggcggcgacggcaatggagattggggggttgcaatttgggtttggatttttgggaagcgtgtggatttggtgatggttgaagaggagggaggaggaaggaatgaagaagaagagggatggagggagggagaggggggttggggttgcttcctttttaaccgcctttttgacaacaaggttgaattgaattttgtactagtcattagtcaagtctttttcatggctaatggttgcttaattattgcttaacctcctctagcatatagggatggatgaggaagattaagagttaatccaggtgatcaagggactaatcatacttactggagtagtagtatatttttaggctttctttggaaggagggagattttttattttcatacggaaattgacctattttatgtggaattactacggaaattgatacagctatggcaaaattaaatggaattttactgcgttccaaacagggtttgcttgcttaaatagcttgattaacctcctctagcacagagccacagagggatggaagaagattaattaagcattaattcaggtgatcaacgcctaatgatactataatttttaggttttgtttggaacgcggtaaaaaaatttgtatcaatgctgaaattgatccattttgtgtggaattactacgaaaattgatacagccatgacgaaattaagtgggattactgcgttccaaacagggtttgcaaattaaatgggtttattaaacagggtttgcttgattagatttttgaacggatttttttttaaaaaaaagttgaacgtaaggtttgcttgattaaatgagtttgcttggttaaatgatcttgcttcggtgccttaaaaggtattacacgaaaagttgacactaagtgcacatgattaaatccgttaaaattaatcatggattctttattaaccaaatcgttggatccacactttgcatcgctccaaattaaattaacgtttgctaacaacttgtgtcctgcaaattaaattaacgtctggtcgtaagtggtaacaactggtgttaatgcgaattaaactgaatgtatgttagcatggcaggtaaaagtagcaatcccaatttcgttttttttatatacagtctctcgttttcgagcggcagaaatcctatgctttccctacctaatctcgatcacattaacccaaataacgaagcagagtgaacttgagagaataattagcccatccttactgatgttgacacgcaaactccaaatactagtaccctaagctgtcaacataacatggttttcccatgtggctagtggttaagtacagcaccaaccacccagattgcttgcacaagcttcacacctcaaaagttcaggaattttttctcaagatcaagatgcatccaggctcaattcaacatgcaatgcaacacatttcaacagctaaacggagttaggtacactagtgagtgatgtttttattgtatgttcaactctggataaaacgtcttagttgaacacaatgtgttggcagatgcgcattgtatttgagttctatgatctaagatacataggtgcttttgtaattacatccatggtgtgatatttctgaattctgcctctggatgcattcagatggtggcttctgatgcagcgaaaccgatgctgaacccgaacgagatgcagctcagctcctcatcgttatcacccagcatcttcatggtgatggtgtaagagccctgaagaagaagcaagtgtcatcaagcatgaaccgaagtaagatgatcacaaaacacaatttggtattagcagtggtatttgagctgaatttatcgtgtaagagcatacatttcagacttagaagcgaaatttcggacttactggtggagtgtatgatggcagggtttgctgatgagctaccaagaagtcaccacttgccgggcaggaagtcacatcacagagctcacgagtttccgagtggacatagaagaagaagtatttcacatcaataaccagcttccctttaccgatagttttatctgcagcaggtcatcgagattcattataaattaattgtcagtatggcagaaagaaataaacaattcttgtgatcctaaactagattcctgagtcctgacaagcataatatatatactaaggattggatctagaaaccatcagggtttataatgaaatgtactcatagctacattcgactcactcatatggtaaaacaaatcactaaggttgtttttttagatttggttgaaagaaaaaggtcacgggttttgccaactgtgatgctacaccacatgcaaaatggcctcacatacatctatcacctacctataaggctataacttgcaaggttttaagcactacgtttcaagaaaaaggaaaaactaaaaaaaaaattgggtacagtgggcatgactgagtctgaggcacagtgccatttccaatgctttggatgcttcacccttttttctaacaaaaagttttggatggttcacttacagaggtgcctattcctaccatgacagtatactgatgcggaaactaatgatgcaataagatggactctgctttggtgtcccaaaggacaaattactaaatgatcattgtcaccacaacgtgcatacactgaatttaatcatgtccatacataatttgctatgccctgtaaaaaatagggtaggctgcaggcaacatggagatgactcaatctggtggatttactgatcaagcccacagattttgaatattagaaaaagcactgcttgctattcagttttagcttccttttacataataataggcaaatggatgctgcttctcaggtgtaattaagccgataaagattcttattagtcaacttccttaaatgtacacaattatagatttattgtgcagatatgttaaatgcgcattatacagaaagttaagaaccaaaacattaattcaaaaaaaaaagacaggaactaaagttcccttatttactcgcctacatgaactgataagcagaaaatgtcaaaggcatgatttgtcctactaacaggatgcacactatacacatgattgcatcatcttcagaaccatactcctgtttttctggcaacgccagcgacccagaccgcttctcataggcaagcaggggaaatgagccagcagtcctgcctctaaaatatatgctacctaacctagagaaggccattcataacataaaaggtggtatgacaatcttcaaaaaatgttttcattatggctgagtacttgactggccctaaattcctaagccgttacatagggaaagtgatatttctgataaaggcttacaagaaatcaatgccatgttacgcctaaatctctaggttgtgatcagcaaatcacaaatcaactagggctctgcagcgttctacatggccattaccgccaaacataaatactacagggcgagcataataaggagcgcacttgcgaacagcgccaccgatgtctaaagaatttactaaacataactgcaatttctctcaaccactaaattaaactctaattgtacacaccctaacacctctaaaaggagactctccatggcacgcactgtcacttgctgttaatacaccataggcatatagctacacagtgtagactcatccccaaacaaaactgcaaaacacaagccatcaatcgccacagataatagtgtatctgcgtatgccaatcctaacctcaccgtacaatcacaagaaaattctggtcagcattcagcagcaagcaaaattattattcatctttttttccttctccaggccaaacagcaagcgaaattctaccaccaccttaaaattccactagtacagagcttaattctcgcaattatactgccaattgacttcagagccggtgctagtacactaaaattcatggcggaacaagtaccccaactgcatcacgaagagtaatatttgcaaaagggggaaacgggagaggttggtttattataccagtggaagcggagatcttgaaggttgcgggctcgccgcgggcgaccggatcgggcacgatctccacgccgctcaccttcaccgggtacttcttgcccttatctgcacgcaaaagcaacagcaacatcatcaagaaccccaaatcatccaatcttcgcgtaaccttcgccccctcagaaccgcggaagaaagggggttttgggggggcgagcgggagggacactcactgcagtactcgacgtcggtgacggcggaggcgacggccgcggcggcggcgaggagggcgaggaggaggaggaggctctgcttggtcgccatggctgggttcgagttcgaggactggattgtgagagaagaaatctttcgggggtgtaatttataaaaatccaggagtcgtgaggaagaaagggatctgttcggtttcttcgcgttcgcttttgactttctgtttaaaggattagattatttcgcggggtgagactgacgtgtgggcccggggatctaacagtctcggataatgacgattaggtgttggtggttagcgatgagaccggtggctgtggactctttggtttttgacttttgagctggaaattaatccacgtccaaatcgggatataaaagctgcaaaattttaaacttttttccttttagaaatacggctgaaatgccggtgctcacgacacacgcacacttacacctacgcgcacacacgtacatcctacactatatacatctccgtaaaattaggctgatatatacgtgtctgttatcaagagatatgtcatctcttactgaaaaaataattagtcgtaaatgcgaataactatgttaaatctagaacttaaataacttaaattcatataggctagttatatatatgattgttatatcacatgaaatttgacattgagaaacactaactttcttgtatgactataatttgggtgtgaaaaatttgaaacgaaccttacggccccctttgattcaaaggaaattcataggaattttaaaggatttcattcctataggatttttccctatatagctctttgaatcaaaggaatgaatcctataaaattcctatgaaataccttttcccatgtaagttttggaggaaatttaacatgaggttctacctcatgttaagaatcctttgaatctttatctctcctcaaattcctatgtttttcctgtggctcaatcaaacggttattcctatgttttttttgttttgtaatcctctgtttcacacttattcctgttagaatcatatgtttttcctatttctctatttttttcattcctgtgattcaaaggggccctacgtgtaaggcgcaaaaaatatggaggattgtgtaagctatattaggagaacttgcgtaaacgatacatattaaacggctaattattctcgcacccaacatctcatgatcgaataagtacctacataataattaaaagaagagtaaattgtattagcagtacacgaacttcttgttaagtaggtgcaatctagtgcactaacttgtaaaatgctcgttatgttacatgaacttgtccggtgcgtttggaccaaggctaaaagaacactatatggctaatcctgttgatttaggtactagttaggataaacacatatctgagaagatttatatttagacatacacctcttcaatgaaaagataaaatgagatatagtgatagcatagacatatatgaaaagggtaagaaatatatgaaattcctcatttataaatatagcacatcttatgtatactcactatacatatgcacgtcacattctaatcaacattagcgtggtaaaattaaccttgtcaagccattgtggtcctggtttgcacgaattagacaagttcgtgcaccaaactagtattttataagtttatgtactgaattaatcccacctaacaagtttgtgtatcactaatgcaatttactcttaaaagaattgcatcccaatacatatgtatatgtatactagatgattccttacgtgttgctgcgggaagtggtatactccaacttatgtttgcaaatttgatgataagaatcttagaaggtattgggtatatataaaaatgctagctataattctagtcaaaacatgaaacctccaccatcggatggttcagaggtcttttttcttcccatcggtccagcgtgaaacctccaccatgccctgcactatacatctcacatttgctgtgtgtattaaaacgagacaatccattagtgatgtgcactagggttcctgatcttctgaaaggttctgataaacaatgatttggacggagtcgcgacacaaatcgatccggcttcttgaacgcgcacgctcttgagccccgcaatcgcagcaccacgtctcctctggttatcacccgtgtcgaaacgcggatgacctcgccgagaaggctaattcctgtttgccaatcgaagaacacaaacaagaacgagatagaaaaacaaccaaaattgcagatgaatgattaagctcacgagttggggtcttacaaaccgatctagcggcgaaactgttcttgatagattaatctaagcaaaacccaaaaacctaaagacggcggcgggtactgatatatagagtttagggtcgtgcaaacccctcttgacgtaaccctaatgggttccaacacgatacacgggccaaaagcccaaatacggtgacgcagcaccggaacagattctggatgtcaacttgttcggtcaattcccgttgactcggaaagaatttggacgtgggaccaaaaccattggaaaggttatcttcttagcttttcatccatataaagaacgccccaatccgagcacgtatgcgacctgggcgtccattttagtgcagactggtcctggactccgaattacacccgacgtcgacttggtttaggcctccaccttgacttggacgtccccgatgatcctccatggctctaagtccttctccaagtgtctccttgtcccctccattgttcctaatcacaatataattattaggtagcaatctattcttgaattcatacaaagaagaacataggaatgaactcacctctaaatttaattgtcgcgcacgagctcttgttatcggtccttgaatgaccgttggaggattgttacgtgtatccgagacagtgatgtccgcatcaattagcgcttggttaatcgaatattaattgttgtaaacttgaaaatgatttatttgatttctttacgcttttttatatagaaaacttttatataaaacacatcgtttagcatattgaaaaacgtgtcagtaacggaaaaactactgagttgccctcccctaccacttaaatgaacgggaccttagtagccgcgccccgcccctgttgaagtcttcattcgttttcctccagccgcatttcttgctccccaaataggccaaatcacagctgatactccaactgcaaatcaggtttcccgtcttcatatcaaattgcattaaccatccaccaaaaaaaaattgcacttcatatgagagttttgccatacgacacatttcaaaaaagtatggtcaatggtttcatcttcaacacataattgaaacttcttttcctttacaacttctcttaagcaaattatcctttctcaagatactactccttaagaggaacctggtaaaaacttcgatttttagaggaattttcaacttcaaaagtctttaagaagtgtaagggactcattgcaatttcagagctttataaaaggatttgacggtgaagacaccatccattgtcgatttccaaaaatcagattatccttttggttagtcagagcaccattaccagagatattgctgggtatcacgaaggtagatagatcagagatactgtcagggtgggtatcaacatgatactgtgggacggtcatgctctccaatattcctggccagtcgatagatcactgtagtgatatgccttagaatcaaatatatgcttgcatacatggaaagcatctctcacgtccttcagtggacactgcttcccttattgaaaatgattgtagttgtgtcataaatttgttgctatcaagaaggtagaaagatcacggcaagcttccttttttatagcaaggtttacaaaaccgtgtggcggttataaggtaatcacactatgtctcgtggttaccgcggggttcggtaaccgcgtcgaaaacgataggaggaaccctacttcatagacaaagttgcccatgacggaaataagataattgagttgagaaaagttcattgattatataatactagtataagcaacaaagttagcaatataagtgtaaaaatattttttttcaaatatataaaaatataagtgtagtagaacaaatcataaccaagtaaacgataattatatttttttaataaaatgaatagtaaaacgtcttcaaaagttatgggcatgaaaaaaaaacaaaggaagaagatggcaactgagaaaccaaagtaatgaactacccaagcgtgcaggattaatttcacacaatgtactggtactacgcactgtcacatgctgccgagtactcgtgtacagtatttattagtcgtacgtgagggtttttgcacagatcgagtatatatacacgtacattttcttttggagtgtagccacctgcgtattgcgttggatcgtgcggcacgtggggtgtcgcgcagcacacgttcgtacgtgcgccacgcgcgcccaccacacgtgccaaggacgccacagtgccacactactacaactagactagatctctgcgttaaccaagagataaaaaaaaattgtgtttgacttgcaggtgattaattaattgatctgttgttgctcgatcaaaatgtccggagaatatatgcgtcaatcaatctgaatatttgatcaaaatggctaaatggctagcgaatgatttttatgttaaaatcatgcagattactgacattgagatttacttcacgattgtgctccggtaaccttagctcttcccctccagctccggcaacaccttctccaactctagcgaccccgacgaaaacagtagaatggtttagggtcctgggctaggatgggggtgggggagggggaagaggggggaatcgctgggtttagagggatgtccatgagaggcgccggctcggcggtgggcggtggacacagacgggcagcgaggtgtcggcggtggcaccaaagccgcggagatagaggagggcggtgggcctacgttcgtggcggggtaaacggctaggagacggtggatccgactgttagtgtttaggaggcggtggctagtggtggcggatctctctctaccaactttattttcgtagtttaatcttagcaatcttttcagtcttttccttttctttttccttcggcaatgctatttttaacctttttgttgtgtaacttaaactctactttcttctaatattttagcgttaactcttttgcgtgttcgcgaaaaaaagctactaccattaacattttaaaccatctccctacccctctattttcatttacttatcatcattaatcatttctgctacgattttgattattaggaaattttaaataaacggaatgtttaggatacaatatggtactttaattaatagtatggcataccttttaagtatttattttttttttaaaaaaaaaagatgagggatcaaacggcagggtaattttgcaccgaacaactgaattgacaaaagaaaaccaaacattttttgcaagcagccaagtgtacatgcatctccctttcttctcttctcttcttttgggaggatcacttgagatgaaaggctctgaaaacaatgtcacatctgcaaatcctggctgaaactgaaagcaaggaagcatgacacttctgcaatttctccaatgtttctctctctctttttttccatcccccccccccccttttttttctcttcctgtgtccaagattgttggaatatccccttcccatgatgtgaaaagattcccagcagcataaaagtgaaaaaaggtaaaaaagaaaaaaaaaagaaatccaagagctggcacatttggatgtggttactcaatggctggataaaaatgtcaacagtgttagtgctttccctcaggttgggcaaggaaaaagagattaacccaaacagtttaataccttcctgacagataactaatctaacaagtatttccatgcaactaaacaagaattctgatcggccatctttcagaaaagaacagcactggccctagttcagggctttatgctggaagtaaggaggccaacacaaattcttttcattataatgagaaatactaacgtgtagttattattttatctttaatagattgataaaaggtgataatataactaatcgtacttaaacgacaactttaaattagagaaacggcgagggtaacaactttgaagagagggaccctcccaaaagccacggaatcatcactcacactgtaacacaatgtaaaatatcaatctccgtccacaaatataagaaaaccctgacagtttagcagagttctagattgagctaaaactatctgattaagaaatattacgtctagcggtgcaactacagcaataaataaaatgaactggaaaattggtacttcttcgataaccatcgtaccgataatcagatattctaaactctgtgtataaatcccttatatttgtgaacggagtagacgaagctgggggaaccaaaagcaggctaggctggaaggggaccgacacaaaggcaacaacaaacaacaacaatctcaagcacagtactgtagcatactcgattaccagtaatcttggcatttggcgacgccatcaatcgtccgtaggttttctgtacctgcatgactccatcaacaaggcaagtagcagcagcagcagcagcagcaagaagaagccaatcctgcagctgcaggctgcaggcaaccatactgccaaacagtatttcatccttccatccactcgtcagtctgtctgtctgtcagtcagtcggttggtcagtcactggctgctgcaatccaatcccccattggaggtgacgagtgtgctcttgcgccggcgccgacgaggatgggctgcctgagccggcatcagctctgcctcggcggcaaccgtacggccctcttcttcttctcctcttctttgtagctgctttctgaagaaatatttggttcttgatttgatgccttgtggccattcttgcctttggttttgttgcagtaatgcattagttttcttgagatttttctcttttttgttcttttggaaccagttgtttaaagcaagggaattttggtgatatcatttggtttcttcagtcttttgcgcacaccctgcagaagaattttccacattttcagcctgaattttcgctgaattttctcatatttttcttggcaggtgggttgccattcctaaggaaattcaagcacaaggagatcgaggcggcgacgaacgggttcagcgcgatcctggaggccggccccggcggccgcgcggcgtacagggcccggttcgccgacggcctcgtcgcgacggtgcggcgagccggcggcgacggcgaccaggacagagaggccttctaccgcgagctgcagctgctcgcccgcctcaaccaccgccacatcgtcaggctccatggctactctgacggccactccaggtgaggttcagttcatcactgtcctgaattcatctgaatctttttgtttttcgtttgtttgtttggtgttgaattgttggttacagtgtttgttaattttttctgtttgatgtttcaggtttctggtgttcgaccagatggagaacaggagcctgaaagaatgtctccatggtaaatttgcttgcgcattttgtggcagaattcttcagaaattgtgtggttttgtcagtcaagtttgtgatgatggttaatttcttggcagatcctctcaggacgcctctgaactggaggaccaggttgcaggtcgccatagatgttgcagcagcattggtactataaatctccatactacattgctctcaacatgttacacaaactggcaggaaaatgcaatttaaagtcatctgatgccagatttggtttctgaacttgtatagtgagtgacatcacatcacattgttctttgttgtgtggtgatgcaggaatacctgtactacttctgtgatcctccggtgttccatgtgtcggtcaactcaagcaatgtgatgatggatgccaattttgtcgcaaaggtaagattcacagtaaccattgttcatacatgtctgaagcacatcgatcgaccaactgaagcttgtaccattttcagttatcagatatcagtgtcatcggttacgacccgaaacgaacggtggaatccaatgctgcatcttttgaaggtctagttaccacccaaacaacagaaacaactccagatttgtctcttctatatcaccttgtgtggaacattggcaggaactgacactgacagcattccatatatgtgatcttcagatgaaattcagcagaggagaagggacctggtgttccagtatggtgtgctgatccttgagctagtgaccgggcaatcgccgggcggcgaaggcgagctcgtgcagtgggtgcaggagcctggatttgcctgcacaatgtacaaaatggtagatgcagatcttggcaatatctatgactccaaggagcttcggaaccttgtgatcattgctaggttgtgcacaaggcctggaaatgatgcaatggtttcgattccgctcattcttcggtatttgcaagggaaggtggcaaatcttgggtgtgaaagtgaaaacatttgtgaattatctgtgtagggagcagttaaaattgctccatcttgatctctgaaataatcttactttctctgtctcctttacttgtagagagaattttcttcttgtgtatcattagcattatttttcatgtccatagaggaattacagcaaatgaaatttgtgtatgttgaatatgaacatggcatggaaatttctgatgtgaactcaatagacaatacattcaaaaatgctggtacttatctagtgaaaatgcttgtgaatctgggattcaggacaaattcaatgcattctgtatcacaggggagatttgtacatccagtatattgattgacttcctggttcctgttcctgttctcaatcaattcacatccaaggacagacactcaaaatttattttgagctgtacagcatgcgaagaatgttcttaccctcaattaatccctttttattctattactgttcagaccatttgtgtcaacttttgaggaaattttgttgaaactcatccaacatttatatgtacaaagtagtacaaaaatatagaattaggtggtgttattttctcctgaagatgaagatgaagattaagattaagtttttaacgcaaaacgaggtggtattagcgtatgattgattgagttttaattattacaaacttgaaaatagattaatatgatattttagagcaactttcatatagaaaattttcgcacgaaacgaaccgtttaacagtttgaaaagcgtaccataaaaatcttaatctttatctaactctagtcgtcaaattcccaaatgaacaaatttacatccgtggaaacaaacaaatttgcttcattttttgtctacttctagtgatattttctgatgtattacaaacgaaaaaaagaaaagaaaaataaacagagagcatcagaccaagaacacacggctcacctgatgacgtcacgtcacgacggcctgacgagagccagcggcgtcacctcggcgagcggcgtcggcatggggctcggcagcggcgacgtccggcagacggggcacgtcggccgctgccggagccacgggtccacgcactcgcggtggaacaggtggccgcagtccggcagcgcgcggagcacgtcgccgtcgccgtagttctccaggcacacggggcagcacgtctgcgtcgccgccgcgccgccgcgagccttcctcgcctcgccgtagaccacctccgggaacgcctccagcgtcgcgtcgtcgatgccggtgccggtctcgacgtcgccgtcgtcgcgtggtcgaggcggagatggcgggcggccggcggcggcggcggccaccggcatggacgtgcggctgcagaagtagatggcgagcgcgacggtggagacgacgaggagcacgccgacggaggcgccgacgccgtagccgaacccgccgatgccacccgacccaaatatactcccgccgccgccgccgccatcgccgccacccggcgatgggctccccgcgctcattgcctagctaacgcaagcaagcaagcaagcaagcaagctctagctgaggtcgaccatggtgaggcagcaagaagcaagctatggtctccaatggaggaggagaaggaaacggagacgcaggtggtagcgtggcgtgtttagttgcagctcaaggtcaatgagttggattaattgcttacttaattaattaattaattacgaatgtgcaagaaaaataaataattacgactgtttgctagcttgggttggattcaattgtttgtctgtacttaatatctaggatcttgaattctagatgtggctagatttctgcttagttgtgtgctaacacgccaggttaattaagttttgacatgtttttgttcgtttctttccatgtcttttctctaaccctgacgacaacatatgtgtagaagtccataaggtcttctaggtggttccttgtgattagctacagtcatcggattaacattcatcatttttagttggtaccaacttggttgcggggtatatacgccaatgtttagcaagattccaattactatacctccgtcccaaattaaaatttcatcttaaaatagtcatcactatacacatcactatacagtaccatatgtcccatcattgacctctcatttaaatatatttttctactttattctcattcaccctcctactttcaatcatatactcttattttgttttttaatatatggcgttgctgattttctatgctatagttaccatttgttttatttaaaagatttatgtaattattatttattttattgtgatttgatttatcgtcaaatgtttttaagcgtgacttaaaatttttatatttatataaaaaatttaaataaaatgaatagttaaatatttgttaaaaagtcaatgacttcatatattaaaaaacatatataatattatttaatgagaggtactatttttaaagtgctataattctctctacttaaactttaatttatactaaacaacctagaacaacatagaatggcaaatactccctccatctctaaatatttgacgccgttggctttttaatatgtttgaccgttcgtcttatttaaaaacttttgtgaatattattcaaagactttaactttagtagtatatttaaccatgaatcaaatgataagaaaataattaataattacttattttttttaataaaataaacgatcaaatatgtttaaaaaggtatttagggactgagcgagtatagcggaggtaagaattcttaggcatggtcactcagagactaatttcaggggctgagctagccttatgatcaaagtctgttacttcctccattttacaatgtaaatcattctaacattttccacattcatattgctattaatgaatttacataaatatatatgtttagatttattaacattactataaatgtgagaaatgctagaatgatttacattgtgaaacggagggagtacatcattagttagcactcgttatttacatgtcaatggaaatatttggaaaaaaattaactcggagaggaaggcgagaaagaaaagaaaaaaaaaaagaagaagagttgccggcgcgagaccagacgaagccatccgatccccacccttcctcccctcccacctcatcagcgctggcggcggcggcggcggcggcggcgtcccctggatccctcggcggaggcagcggcagcggcggcggcggcggtagatcaatcgcatttgtctcgctaaatccggcccgcgccgcccgtcgcgtcgcggtaggtgggtagggggaggtgtgtcgcgtcgcgtcgcgtggtagctgcgctcccttcccgcatccgcggtgcctgtgcgtgccctccacacgatccccccctcccgtcgtgttcgtccgaccgtccggcagatcggcgaggtgagctctctctcttcgtcgtttccatctcctcccccatcgttgaatgaattaatccgcctctcttaaggcttttagggtttcgttagcttccactatcgatcatccaccccgccccgctcgatcgcgcggcggcatggggtttaatttgctcttggttcctctacttttggtttggtgcgagtggtgtggtgtgggtgtggtgggtttaggtggatctggcggtgatcgctgtggacgggatctttagcctcctcgtcgagacggattgaccccaattctgtctgatacaatcgactggacttggtgtccaatttgtgtgttagtcattggtttcggtctgcttcccctcccagttactccacccaattcttcagaattgggtggtggcctggtgtgcaaaaagtgcatcagacaaaatttgtatggcacacgccccattcaattagtttttgtgcgtttgctctagttgtgaaaatggaatgctgccccactttgtggggaatgaaagatgattgctgtattggcgcttgcaaaccaatcctagtgctttgtagttgtgcgtttgctctagttgcgccgttaaggcctgggtgaaaatggaatgccgccccactttgtggggattgaacgaaggttgctgtattggcgcgagcaaactgatcctagttctttctagttgttgaggtccatgagtcctcatgaaccaagtcgtcaggtccgtgaggaatctgtgaggtgaaagataaccgagacgactttggtcaatgtcttatcatgtaatcttgtctaactagtactcgtaactacaatgatgccatgggccaataacagctactagaacacacaagacaacagaatctatccacaataggaatatacggcgcgaccaactcctgagttagcacaaatcattcctaaaagtgcacatcatgtttcagccctttatggtaacatcttgaccttcactgagcccgaccaactctgagttagcacaaatcgttcctaaaagtgcacatcatgtttcagccatttatggcaaaatcttgaccttcaatgagccatttctctaagacccgtcttcttggctctgcaaccaagtggcggccttgaccatacaagaagttgggtgtcgcttggtgcgccgttggccaccaacgtagatatacaatgtcatgcatgtattagcaggggcaatgctgcaatggcagcatctcgttttttcccaggatgtacttatatagcttgactttgtaagaggttttattccttctgatgcataatatggttatgcactgtttctctgcccttttagaaaatatagtttgttaaaaggtatgtgtgctgttttgagtagaacaaaaatgattgatctggcatggcactaagtgtgttctgttatatttctctctttgtaaagcaaacactcctgaaagtactatactctattggccttgtaattcatttagggtactgtagaatcacagaactaactaaattaatggcctctatgtctcaatgcattgcttgaacttactaggcttgtcttttgctctcacatgcgcatacatgctgtttgttcgaaggtgatctgagtatgttcaattatcatgacgatattatttatttcctcatgctcaagtctgttgctttcacaatcctcatttatgctttattgaactacatttaccataatatgatttatgttcatttggcatggtttctccaggatggaaatgttcttcagcagctttcttaatgaatcggcatcatcagagaacctctttggtcatccaaatgtcgagagatgcccattcctgagaaacatcaatggagctacaacatattcattttcttctgctttgccagtagctgtaagatcttctttacatgacctctggtgatgacaatatcaatatcaaaagtgcattggatccttaatctgtgctattgtgcaggcccgaggaggaaatggtccaatttttgaggacggaccaggctttgattcagcatttaaacttttccatggatgggatggaatagttccgctttcaggaaagtcatatttacctgatgagagcaacagtgagagcattgatgccaatcctgaacctgctctgctgtttaacccattggctgctagagctgccacaataagtctatctgcatttgggccatttggttttaacttctttaatggcaaggggaaaaggcagaacaagaagcccaacaatctaaatcagtcaaacaagaagcccagcaatccgaaccagaattccatgaaagtttgtcctcattccttccttttattttgtttcttttttcttatggggctatgtttgtgaaatcctatctggtttctcgcaatcaagtcctaataacaatgcaagcctcaattatctatcttaattttgtctattattcaaagtaagaatgttccctactaacttttttaccattttgttataacgaactgatccagaatttgttcagttgaagttaatgattgtgactttggttcacaagtaggcattttggcatttccttggatgtttggctatatgttacttttcatgtatccaagtgctaatgttcttgatcggacagccatagttgcatagctaggattttcatcaatccgatcagttttctcatgttacgttttgaaccattttcagcagaaaggaggtaactcatcatcgcacgaggcaatgagcaacgaatggatggaaaatgggcagtgcccacttgcccggtcttaccgagcaatgagtggcattctgccccttgttgcaaaggctttacaaccaccagcaggtgtgaagctgaagtgcccgcctgctgtggtcgctatacgtgcagcccttgcacggactgaacttgtgaagtctctccgtccccagcccctgcctgcaaagatggtagccattgcgttgcttggaaggcagcaaacatccctctcggggtgtggcgtgagcacaccaagaaattctccccgcagtggtttgcagctgtccatgccgctgttccattcatcggaatgctgaggaaatctgtgaacatgcccaagactgccatggcattcaccatagcagcctccattattggccagacaatcgggtcgagggccgagcgcattcgtctgaaggcattggctgcaaagggcgacgccgattccaccaccgtggctgacatgtatccaaacaagtctggcaattgcagtgacactgagggcaaggcatgggatccgctcgcgatgaagatggctggacgggcttctggtggcgttgctgcaccaacaccaagcatgtgtttctgattgttcattgcttttgaaaatttgtgtctataccagtatctctgtatgtttgagagttgatattgagtctatttttatcttgtgatgtaattgcctttccttgcccctcagaagtatccgtttgtttgtggggtgaggcaagtggaataagagtgctgcagttctgcagttaagcttgccagttctgcagttcatgcatctgtaatttgatgctgcaggatttctgctattttaccaatcatcattgtactgtgtgtaacctgttggatgaacgcttgttagctgttctggtgagtgaccctgtttgaattttattattgagaggattatcactgtttattattatgtacttaattatacatataaattaaatatttttagaaataaacttgacaaatatcttaaaacaaatgggttaagtaatgcagtataagtctttttttagaaaacacattttttaatcctagagcaaataattcgataaataaactaacatttcaataatctgataaatacgctgaaaaaaatatggcttggacgttggctatacagcacagtgcccacacagatcaacagccagactgggtcctaccggcagtgagagggagagagagcagcctgccaagtggggcccagatgcatagagaggtgtatgaaagcgagattaaccggaggagcagcacggactcccgccatttcctttttaccgccatttttcttggcgccaagcctggctttcccgctacgcgctcttatccctcctatgaactccccgatgttttcctacggtaagttgagaaataccagggtctttcggctagctcgatccacaaggtggtgggctagacgatctgagttcgaagcctcaccctttctaattatttatattagatcatttcttaatattcgcgttttttccctacggtaagtaaggcctcgcttagttctaaaacaaaacttttcccccatcaccccatcacatttaacgtttggacacatgtataaagtattaaatatgaaaaaaaatatcaattacacagcttgtgtgtaaattacgagacaaatcttttaagtctaattgcgtcatgatttgacaatgtggtgctacaataagcatttgataatgacggattaattaggtttaataaatttgtttcgcggtttcctgacagaatctgtaattttgttttgttattagactacgtttaatacttcaaatgtatgtccgtatatccaatgtgacaatcaaacctaaaaaatttccccaactaaacaaggccttaagagaaatgcttgccatcaaatggaagaaaaaaaaatggatgagcccgagggaacattaccgacattgcatggtgcatgcagtcaggtttagcaagcctattcaatagatcgaaaattcaaattattttttctcttgaatcttttacaatgtatgtatcgattaaaacatcatgtcaattacattttagcacgcacacattctcccatgctgtattaattgtattctgatgaaattcgtgtccattcggttatatgatgatcaatttgagaaattttaaattccattatattatgatcaatttagaaaggagggagtactacgtatttctatcatctcaagaacattattccaatattaatgacaactttaatttaagcaaattttgttgagactcataaaacatttatgtacaaaagagagaattatagctagtgatcaagtttcctcactgagaaaatcccttatatacccctgaaattttttctaatcccttctatacccctgaattttgcttacttccttatatacccccaaaatttgattttgatcccttgcatacccctcccgtcagttgaccgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacattttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaaggaatcaaattgaaatttcagaggtatagaagggatcgggtaaattttaggggtatgaaagggattgagtgagttttcaggggtacacagggaatttactcttcttcacttgaccaccattcaacctataattacacaaggaacccaaatttacatccattgaagcaatttcgttccatcttctacttctagccagtgacattaattaattgtggtgtaacaaataaattaatgaatggaaagaaagaaagattaaccataaaatttaaacagagagctgcagaccaagaacgtcggcgggcggcgccggcgatggcggcgcccggcagaccgggcacgtcgggcggcgccggagccacgtgaagatgcagtcccggtggaacaggtggccgcactccggcagcgcccggagcacgtcgccgccgccgtagctctccaggcagacggcgcagctcgtctgcgccgtcctcgcctcgccgtacagcaccagcggcagcgcctgcagcgtcgcctcgtcgatgccgacggcgaccacaatgccatcgtcgtcgtcgtcgtcgcgccggcgttgaggcggcggcgcgggcggcgccgcagggaagacgcgtttgcagagctgcgtgatgccggccatgatcaggaagacggcggcgacggcgcagaggcagacgatgacggcggcggcgccggaccagcttgttttgtacgatgagcctcctccgtcgacgaagacgggccagtcgccggcgccggcgcccattaattggctcctcggagtcggaatcgattgacgtgacgtgacgtatgcacttctacgtaagcaagctagctgaggcttggtcattgatctgctcgctactatacatatatatacacggtggggtgtattctaatccgttgagcggatttgcggatgtccctcgtgtattttttttaaaaaattcaaacaaatgttacgaaagattttgaaaaaagttgacaatgatgtaatgatatatatctatcggtccatcaaacattaagttcaagtttgatctacacaacattgagaaaaaaaaaagaagataaatttaaacgtaaacaatatacactattcatatgctggattttttttttatatctcaacgtatgggttaagtttggacctaagattttgtgaagttttatacttccgccgttttacaatgtaagtcattctaacatttcccatattcatagtgatgttaatgaatctagatagatatatatgtctagattcattaacataaatatgaatatgaaaaatgctagaatggcttacattgtgaaacagagggagtagatatatgttgtataagtgtttttcaatttttttccagaattttttaccgtttgaatggttttttttaagtaaatgagtgaatattttctcgagggataaaaaatatatacacgacgatatatataaattcgtgttggtgcgaatcgtttcaaaaatatatacacacaacggaatatgattgggaaggagtgcaagaaaggaagacacggaaacgcatgtggtatagcgtggtgtttttagttcggggtcaaatgatgagttgtcttcatacgtaaatctagttcaaagcgtgtgttaagaggtcaagagagactcaagacacatacgagcgtaattaccctcgtatagttcttaaatggctaaatgctccttcagctcttagacgtttaaaatagggttcgggcatactaccttttgttttttttaatataggataccgttaatttttttataaacatttaatcattcatcttattattttttttacaaactaataatatttaaaccatacataaataatatttgatgataaatcaaatcacagtaaaatcagttagtagcagttagcagaggagattcaacggaagtcaggtcatattggcgggtccagatgggcgtgggtcggcacacgagtaatgaaatcagttttcggtacttcggtagtagtcccccttccaaaatataaggcacaactaccattaacccaaagaccaagaaacaattattattatcttctagtttagatcaccctaataaatgtaatgcatgcatccaatagaattagaaatcttgaggatggatgatttaaaaaagcaataatttaatggagaagatgtcctaattaattatatgcatgcatgcatgccttatattatggaacatccaaagaaaaatagttatgccttatattatggaacggagggagtatgttacagagaagggataaaaagtccataacaaatctctgagctagtgtaaacttttaatgacatatagtggaccctctcttaattcatccagcgacattatttgcgcggttttgaacgactcgcataagacggtgcgaagttatattgatagaacagaagaaaaaatacaagattacaggttgtaaccaggaaaaaggaaaaaatataccaccacccatacaccgacaacgccaaaacattgaaccaggagaaggctagcacgggacaggccgccactaagcgtgaccgactgccgctaggccaacaaagaaaacacagccgggatcgcccaaaacccaacccttacaatcaacacaaagtcccgctctatccaagtcttcaggagttagggaaagagggtgagagagaagaatgaaactcctcttccccttaggcctctgacgtggctaacttgtagagactaggacgccgccacaagaggatgaaatctacagtgagcttacaccaattggttgggtggtttcggctaggggatgcctaaacgacgtctccaagtagagaagcgacggaaagcactgccgccgccgtccgtcaaggtctaaaagagagccaagactgagctttcgcccggcatctacacaagagggatgagactgcacgacaacgccatcaggaggggaatgacgcttcaagcgtcatcattgccggcccggctgaggccgggctggattttcacacgccgctcaccacctgcgaatccatgctggcgccccgatgctctaccactatccaacctctgctgacatatgggaccactgcaccggtgccccccgccggccagccttcgtgcgccgtagtccgcaccgcacccgccggcagctcctcctcctcgcattgtgcccgcctccgtcaccgccggccacgcctcgtcgcgccgtgccagcctcctcgctgccggttgcgcatcactgcgccaagccagcctcgtccaccgctggccgcgcctcaccacaccaagccggtctcccgtcgccggccgcgtctcctcgtgccaaaccaacctccaccgccgccggccgcgcctcctatttgtgaggttttgaattttgcaaaaccttcttcctctagtaagctgcatttactctctcaattcaaaagtgttaaatgtattacttttgacacaaagatcaaatagaaattaacttattctgtatgtaacaaagattaagtagtgtatgcgctgcatgcacttaataagtattaagatttaaaactcatagaacaagatttaaaatatcagaagtggtcaatatatatgctgctacttataaaaaaactgggattgttagttctggaagcatttttcgtcccatcttattacccttcacagaaatgctagtttgagtttatttttgagtgatgactgccaataatgcctcttatcttgaagtagttgaactgcagagcggtttgtaatggcaaaacatacgctatgttaaagtacgtacatatttccttttttttcactgtgcaagtttctcgattaggtagtaaagattttcacatcactcagttgagtaatcccgcttattttgcttgtttttttagaccttttggttaagatttgaacaatatatatcttttgttggaatatgaagtggatctgtgaaatacatgtagcgcgttccaaggaaaagctgaagttgaatcactagacaggattctttcagggctgttaaaactgaataaaaacaaggccaattgatcatatgtttaaccatccattcagctgtatttaattgataattaaccatccattccgcagtactccctccatttacttttgatagtcatattttcaaatctgaaatttttatttttgatagtcatatttcaatccaacaacttatcatcttaatggctttcttagatttaatgcgtgactcttcattcttccaaacaagattggctacatgggcatcgagaaatgtaaatattaatgaatcgcttgtttacgaggaatgaccagtactctctccatttctaattgatcttcatatatgatttgtgcatcaataccaagacaatcctgcggagcacttaatcagcatcgaaaacatgcattagcgtttcgtatccgtgaatgtagcgccatcaattttgcatactgtattgctggccaatcagttgtgagcgtattaaatccatgcatgcagcggctcctaattagttttgcatgccgcatagcctgaccaatcagatgcatgcagtgttcgttaggaagtgtcattaacgtccttcacaggattttcatcgcctctccaccgtaatgcgaatatcaaaatggaattatcatttttttcaatacgatgatcaaaagggaacggagggagtattccaaattgatctacatatttcataggtacactaagaccaagaaaagctaataactctctcatactatatttactctagcaacaaactcaatgcatgcaccatccccactatttcctagctaatagcaaatcaagatattgcatgtggattataaatgcttgtgatgcatgcatcaatgtcaatttactccaatgcacaaataacgaatagacctaatgaataaacacaaatatgtactaaaaaacgagtagatcatttagaaataacctaaaaaaaactatatatagatcaatttagaatggagggagtatttaaatggataataagtagaatcacttatccttggtctgtgtgtcaagatgaaatatgactatcaaaagtagatggagggagtatcttttatagtactggtttccgtgtctaacgtttgactgttcgtcttatttgaaaaagttatgaaaaaatttaaaaagataagtcatgcataaagtgttattcatgttttatcatctaacaataatgaaaatattaatcataaaaaaatttcatataagacaggtgatcaaacgttgaacaccaaaacctaggaatttagtctttttgggacggagagagtatcagataaccagaacattagtcaaacgggccaacagtcattcagtcaaacgacaatgggaataaaattctggaaaaacattcttgactttgctctctaaatttcatttttttttgacgaggaatttatgcatggtcgttgctcatctcagtaaaaatacattcttgactttgctccctaaacctcaatttttttgttaatctaatactctttctatctagcgaggaatttatcatgatcaccggcagtggaaagaaattctttctttgctctaaatttcaaatttatggcaagtgcaaaaagagttctgactttgctctagattttgctaagagtaaattgcactttgcacccgataaagcacgcttagtttcactttacaataggtttagcgtatacatgttgccttcaaataagtttcgcttagaaccaggatatacatcatcaaatctatagaaatttcataaaatcaaattttataagatatggatgaaactttgtgaaaacatggtctttatttttttaaaaaaatcgtaaggttcactcatgatttataagattttgctttagttatatgacacaatctagtgcaaattgaaaattattttgatatgtcctgatacaaagtgaaaattgtcagggtcatgggtaaggtataccctctacccttggatgtatgttgtatactgatatggtatgcctgcacgtatacggatgtttcctatatacgttaaggaaattcatcatgtaacagaaacggagtccacggatggaaggagtcctactcggacagagctgggtcgttactgtatcgtgtgaggtccgatgtctctgagttctacttaaaaccaattgacctgcggtataaaagggaccccccgagaggacctaaggcatcgaatctcacagtcaacacatccaccacagcctacgaagtcggagcctacaggagccaagtcgccgggtgatctagtcgaaccaactcgactacggtctcgtcggtatcatcgagttctgctattccctttgtaatatgtggtttccattatataatctcatatcaactagattagggctattacctattaaggggcctgaaccagtataatccttgttccctgtttgcttgatgtcgtactacgtagatcctcatatcagcgtatcccaataccctctatatccggtctacgggtatctcccgtcgacaaaaatatatactactccctccatctacttttgatagctatatttccaaatctgaaaaatttatttttgataggcatatttcaatctaacaacctatcattttaatgactttatcggatgtttatcggatttaatgcgtgactcttcattcttccacataagattggctagatgggcatcgggaaatgtaaatattaatggatcgctggtttacgagaaataactagtagcatatttaaatggatgataagtagaattacttatccttggtctgtatgtcaagatgaaatatgactatcaaaagtagatgggtggagtatttttttaaggaaaacagcgtaagagtgcctttcattgacccctaggtgtgtaaatcgaaaaagagagaagtcaaactgaaaatacatagtaaacccaatgcaaaatagaacacccagtgcaaagtgtaattcactcctccgcgataagttcacctgacatccctcacgtttacatcaagtctgttaagatccccaattcccaataccataaatctctaccccttaattatttaaaaccgtccaaagttagtcccaagacagtaaacattaaaatttttcttggtttcactgatgtggtatatgtcaggccccacatgtcagtgtaccagtgagacgttattagacggagaaggctctcctggtacagcaagacgatacttcctccgtcccataatataagggattttgagtttttgctttcaacatttgaccactcgtcttattcaaaattctttgaaattattatttattttatttgtgatttactttattatctacagtattttaagcacaacttttcattttttacatttgcaaaaaaaatttaaataagacgagtgatcaaacgttgcaagtaaaaacttaaaatccttatattgggggccggagggagtacgattgaatttcttgttgacctgaccgctactgcaaacttcattgttcagattggagattcgatccacaaatgatctgaagctacgtacccctncagtatgaagctggtctggataatcttcagtcatgtcagcacgtaacttgtgcggttttgcctacaaaaagcatttgctgtaacttgagctttaatccgtgcacaataggacggcatactccctccgtccataaatatttgataccgttgattttttttaacatatttaaccgtttgtcttattcaaaaaatttaagtaattattaattattttccaatcatttgattcattgttaaatatacttttatgtatacatatagttttatatatttcataaaagtttttaataagacgagcagtcaaacatatttaaaaaatcaacggcgttaaatatctagggacggtgggagggagtggtaaatatcattatgtgtgcacaatttgctgtaacaagctgcagcctgcatcccaaccagctgcatattctagattagttaatcatggcacaaattttgataatttgactctttgtaaaaactaattttacaattaaaccgtggccaaaacttatttaaaaaatgacccttctatttagcgttaaatcgtatgacgctgaatttagacacctcagcgtcaaatagcacggcgctgaatgcacgttggcacgccgactcagcctcccatccgcagtggcacggtattcagcgtcagttgacgtgacgctgaggtatctaagttcagcgccatacaatttggtgctgaacaaaagtgtcatttctaaaataagttttagtcacggtttatttgtaaaattaatttttgcaaagagtcaaattgtcgtaatcatggcccgtcgagctccgcgagcattttgccaaccggcatggccacttgctcgccgctctctgaccttatgcctttggctttccacataaggtcgtcgtgtgggtggaagccgggtgacgagatgtcggcgttccaaggcgtaacggagcctcgcgagagacctcttcgacaggcgcatgaacatatgggccccgactataccacatcagcgaaaccaagaaaaagttagaataaattcatctgaggtctcttaacttgtcaacaaatccgattttcatccttcaaccggaaaactagatacaacggtcactcaactgtcaaagccggtacaatataggtcccatggcggtttggacggtggtttttgctgacacaatataggtcccatggcggtttggacagcggttttcgctgacatggtgtctaggtggctactttgactcagtgttcacattacgtgatgcttaggtggtaatttgatttgggaaatattaaaaataggtgacatggcgcacggggaggtgttcatctgtagcttcttctcatctccctgtcccgctgctgctggcacatgctgatgcagcgtgccacctttgaagtgaaatgcaaaatcaaagataatttacatgtccctccatcgacccgtacttttttaaaaatgtttgaccgttcgtcttatttaaaaatttaagtaattattaattattttctaatcatttgatttattgttaaatatacttttatgtatacatatatagttttacacatttcacaaaatttttttaataagataaacggtaaaaaatatttaaaaaaaagtcaacggcgtcaaatatttaggaaagaagagagtaataaatattagatcgatcactttccctgtaaatatacactagacttcctcggaaggatcgagcacatgtcctgcgaagacgatggattgcaacctctcctcgacgatgaagaaggcgaacagatggtcggcaacgaagtccaccagcttcagcggcggcgggtagtaaccatcgtacagcgagaacccgagatcatcgtcggactcctgcccacggggacgcactccggcgggaggtggtcgtcgacgaactccggcgaggaggtgatcctgtcgagcaggtccgatagaccggccgtcgcggtcgtcggggaggaagacgagcatggcgaacgacgggaggctgtcgcggagcttgaggtcgttgtgggtgtcgccgccttgtacggcaggcggagcaccttgaagccgtcgtggcacgcgacgtggtggtagcaccccgccggccgctgcatgaaggacacctcgacggagctcccgtcgtcgaggcggcggaactcgcgctccagcgcgatgtcgtcgatggcttccacccggcccacctccacggagcgctcggcgacgccggactccgccagtgacggcctgatgagcacgtaccaccgcctcctcctcgccggccacgctcgtggtacgtccggtctccatgtctcggtaagagcagctcacttcgaacaggtgggtgacgtcatcccaggcgggggctctcgggacgacgatgaacagcaggaagcttctctcctcgtcggcgacggagaggaggccaacgatgcactgcgcgaacccgtcctggatggccgcctcgttcgccgccgcgtcgtggtccttgtcgaagccgaacgtgtggaccggcggggagcggccgccgccgtcggtgcgcacgaagtacaggcggcacgagctccgcacccgcactcgcccaccgccgctcccgctcctctctccctctctctctctctctctctcgtcggatcagattgaatcgaggggattgaggttctctggggacggcggcgatggagattggagagccgagatggacttgtggggcccacgtggtcccaccatctttattctttttactgacatgcgggtccacgtgggctccaccctttttattaatttatgtgtaaactgacatgtgggtcccacgaagtttattattttccagatcgaattaccaagtaagcgcacgtcaatgccacaccagatgaagaccaagtcaaattagccatgaagacgccacgttagtaaaaccgatgtcaaaaccggtaagggatccgttgtatcttttttcggttgaagaacgaaaatcggattcgtggaacctcagatgaacttattccaaaaaaaaaattagtccatactactttgggatcaactttgaacggatttgaatagttgagggtttctattaggccttgttcggttactaaggattaaatccccaaggggaagcaaaccagggagggattgagtcccatgtcactcaaaccctatggggagtaaatcccttgtttcttccaatccctctcttagaaaccctgtgttcgttttgacagggaatatactggctattggcagcgaatatagcagcatattgctagctcactttatgatctactagtattagtactattagtacatttagttaccactgtttacctgaaagcagtactgctagtaccctgtgacagcagcacaggagcaagatcaaaaataccatcggtccatttaagagaaaattagaaaacatatacatgcttgttacaacttcctgatcaagaaagttgatgccaatgcagtgccagccaaaagtacaggagatatttatacagtataataagaagattgttctgattccattcccttacactcagcaagttgaatccatctgccgacaacttggatgattaattagtccaaatgcacatcaaaatccaaacttctcccaacatccccaaaatgacacatcagtagaccattcattggatggttaattagtctaaatgacaccatcagaaaactgctaccatcaaaaaaattctatggaacatcctaccagtcaatttcaaggagcctacaaggaaaatcaattagtagacatcagtttacctatctcagaaatagagaagaaacaaaactacaaccatccaattattcttttttcttctaccagacataatgcaatgaacattataatgcgcaaagttccaaactcaagtgtataacatatgtgaatcttgagttgcctgaattttaagaggatgcagaaatcatatatagtggatagacagatatatggtgaatgtagaaaagaatgaccacctcaaccttcttctagtttctctctttgaaaattagaatgtatggaagcacaattcagccttgacaaaacacaggaataatgaagcacatagctagagccacatggcacctcaaaaaacattctttcatcaggtcattcccaacccatgacactagacatagtttccatagactccacatcatcaagaaactagtactaaacactaatcttccaatgcaaacacaactattctatacttaaatttaatgttacttatctcacatgatgtcttggatgttgtgtagaaaccatgtctcatgcaagacatggtttccttctatttcctcatttattcacttgccacatcatttttcatcctaggtggcagcttatttaatgctatagacaccatcctagtcattgggttgggaatggcctcaggttcatcacctatcgaaatatccataaagacaattgggttcttcttctttgccatcttcctgaagcacagcactatcctaggaaggagagggtacaaggtcccaggaaggaggaggtgcacgtgcaatctacaaaacaaacacaatttatacacatcactgacaattcaaattcaggatccaagattatatatccggaactagagctagagttacataaaacccagaactagagctagctaccatcaaagtaggagctgttgtttttcaatcaaatagaaggatctgttgtttttcaatcaaatagaaggatctcatcatcaaatacagtataacatgggtacagaattaatcacctaatcagctcatttaacactagacatattagtgcttgaatagctacgataaacatgtttttatacaagtatcatgttgaggaaaacaaatctgttagtctaatgagactaaaagctactgttgttagtttaaaataaatcagttaagtatacattactgtatataccactgcattttgttgttagtttgcttgtgaaacaatgacgacagatttagtttacaattcagaaatgttaaactaattacaaagtacctccatatctctacaatcctcaaaatcaggacacccaacccttgtaatttccaaacagaaatataaccaaccaccacaagttgggacaccggaagcaccaagatccgagtacttcactgtaaaaacttgtatagtcaattttacaagacatgctcaggcaagcatcgatcacaacatcagtcacactaagcaaaactaatcaaggcaaacatgtttccatagccaccgtacagctctcactctcgccatctggtgcctcaaagccaccgtgaatcaagaactcaaatcaagaactagagttgggcggtgcggcggcggcggcaaatcaagaactcatccccacccaaccaagaaaaaaaagctccacgcccaaatcaagaactcaccagatcgagcaggatacgaggaggacgacgacgaatcgctgagcgctcacacactagatcgaatcacggcgagacgagagatggtggcaacgacgggaaagggagaagagaagaaaaccctaaccctagctttggaagaggaggcgagaggtagaaaggcagcgtgctcaccggagataatatggcggccggaggagagcgccgtgccgtcgccatcgcctccgggtcgcgccgcccccgccgtcgcgtcttcgctgcaccgccgcctcctcgaggaaaacttccacgccgcctcaggagatgatttattcccgggcctagagaagagggaaaccccgtggtgggccgggctaaaatcagcggcagtgcttaaccgaacgcacaatttcgcatgggccgggatttttttcctcgccggggtgatccacggggattgggacccgatcccggccgggaacggcccaaccgaacaaggccttactggggggattggggatcagacgtaaaattgaggaatgtcaggtgaacttattccttctccacgtgcacacacggtccatggtggactaatccaccgatgggtaggcccaagtctatcggtccaggacgggttcgcgcagtgcattggtggcctcctttccgtccccgtgcaggagctccacttcgacgccgagacatggagaggaccggacggaccacgagcgtggctggcaacgaggaggcggagtccggcgtcgccgagcgctccgtggaggtggaccgggagctggtccgggtggaagccatcgacgacatcgcgctggagcagggattagttatcgttttttctgtttcggtagtagaagagatcgagcagggatcggatcgtgggatggcatggttagtccttgatctggcaagatcgcgcatgtaacaacctcctgtgtggagaagaataaaaggaagaagagaactcagaaaagctgcgcagttttgcagcaccaaaacgttgttattctctggttttctgcattgtcgtttttcgtcagacaagctaggatagcgactgaaatcgcgtgtgtttgctgacaactccgtcgtggtctccttcatgcagcggctggcggggagctaccaccacgtcgcctgccacgacggcttcaaggtgctccacctgccgtagaaggcggcaacgagcggcgacacccacaacgacctctagctccgccgccgtgggcaggagttcgacgatgatctcgggttcacgctgtgcaacgattactactcgccgccgctgaagttggtggacttcgtcgccgaccatccgttcgcctccttctagctactccacgccacgaccccttcccctgcggccgctcctcggcgctgctgcgaccggccgcctcgccgcgcgacgccctgcgaagacgaaggattgcgacctctcctcgacgatgaagccctgcgagggcgaggagctcgcccgccgccgctcctcctctgctccgctagcccgctctgcccgctcgtccacgcctcgctgccgaggtgctgtcctgctcgtcggcctccacgcgcgctcgtcggcctccctccgtcgcctggagagaaaagagaggagagagagatgaagagaggggagatggggagagatgaggaagaagaggaggggtgaggatgaaatgtggggcccacgtgggccccaccattttttattaatttgtgtgtgaaactggcatgtgggtcccatgggttttattatttttttcgatcgaattgccacgtaggcgccatgtcaatgccacgccagatgaagaccgagtcaaattagccatgtaggcgtcacgttagccaaaaccaccctcaaaaccgtcgagggacctaatctgcaccggttttgatagttaagggacacattgtatctggtttttcggttgagggacgaaaatcggattcgtttacaagttaagagacctcagatgaacttattcctcgtacaagtatgggcggtcgttgaggcccatacaggccttgtgtaacaaataggcaccacgcaacacaacacgtgtaccagtagaggtaatacaaggaagtgtttgttgtaaaaaaaacgtgatcactcgcataatttccaatcttgaaatcacctactgttttttctttttgaaacaaacccgaactttcattactccattagctgagatatcctcggcaaccaaatttgtaatacaagatggcatagaaacaagcaccggctcagaatctgtcaagcacaacgatcccagctcagcaagtgtatgggctactctatttccttctcttggcttataattaacccagaaagagataaaatttgaagacaacaaatgcttcagttcccatatcatgttgagttgtgatccaaattcatttgcacttaataaatgccagcttctaccgtagtggagcggaggcccatcgccgggaggcttgggttccactatatatataccttttgtaagccgccgtgcggcgtcgtaacctcaccccagatatagtgaagatattttgctggctggcgcccgtggttttttctctcctactttgggagggttttccacgttaaatctcgtgtcttctgtgattgatctattgttatttatcatttgttcgcttatcgtttcctaacatatcacaacatatcacagtgttatagtcgggaccattgttgcatcagactccaaaatgagctcaggatatagcaaagagagctgacaatcggatacactttggaaagaggcaacaatacatgatatataccactggaattatgtgcacaaggttcataatcatgagactaagatcaagaaccgcttacccactcatgagcgatatcttcggatttcacaaaaaccattaatgaaccaatgaaatctgaacagatcctgtgacaaatttaaaataaagtttgattttctttttaaaaaaagattcaccaaacaaccgagcggtttgtgttttttacccagtcaaccggcatcgtaaaccatggtgtaggactatcgggggaagaagaaaaaaaacacttgtacgtggatggagtaatttacagggcaacttatcaacagctcggattccctaatacaactgcagaaccaagtgatgaaccaatggtgactagagtgtcctatatttcactggaaacagttaactagaaaagcgagccgattcttctgcttctaatgctttctcgctaactccacaaacaatttcttcaggggcctcctctacaaactacaacatgaaagaaatgcatggttaaatggatagttgccatgcagaagaaatatctgcgtacactttctgaaatgagatgggccagcaacggcatcatactatggatttctggctgcatctcaagaaaggcgcttggagagccggttggagaataacgtatcattaagtcggttgtcgcgcagggatccaggataagagatatcagccaaattaccctcaaaatatcaaaatatccggtagatataggccttcagaccctcatcagcaacaaaattgtgaccgattgatttgcatcacctggaattatcaaaagtagtcaagtagataattggttggcaaaatgcatcaaggaagatcgtgtctgaacaatttatggcaagaacatgggggtgattcacttacacatggggattggaggggtgaatacctgagatgtggtcgatcggcaggattcgcacccgcggcagaggtagatgcagacgtttggaggaggaagaagatgatgagcaccggacttgacctgaatccccttcttcatggacatctccgagcagtgtcaatactgtaatccgaaacgaacactggtagaattatccattttttaaatagatgtcgtcggtaacttttttattaggcgtcgtttcattaagaaaatacataatttctaatttattttctaagttgttttatcacttaaagtaccttaggcaggcatggttatatcttatacttttgtataaaattttggatgattatgtaaatatcacttaaagtaccttaggcaggcaggcatggttatatcttatactacctctgttttttaatagatgacgccgttgatttttcttacatgtttgaccattcgtcttattcaaaaattttatgcgaatgtataaaatataaatcacacttaaagtactatgagtgataaaacaactcataacaaaataaattataattacgtaaattttttgaataagacaagtggtcaaacatgtgagaaaaagtcaacggcgtcatctattaaaaaatggagggagtacttttatataaaattttggatgattctgtaaatatcacttaaagcaccttaggcaggcatggttgtatatcttatacttttgtattttgtatttcaagctagaacggtgtacttctgtttcagtattacagccatgattgctgacaaaacaggggtgcataatatgatgctgacaatagcccaatcatgcattcatcgtcaggttccgaaaccttccctaacacagcatagatacgaaaaggtactctcaaggtaggaagtaggaacctactccctccgtcccataaagaatatgactcctcctaagttgatgtatgtggacataggggtgtccacatacattgtcctcctaggttgattttttttttttgacggaaagagtaagttgctctgagcatgacccaatctaaaaaatgaacggatgaagaacacgattatctcagcgcaactccatttagtttgatatactccaatccaaggcaagggggtggaaatcaatcatgagttcacgatggaccaccgaatacctgcaatacgataaatcaagtcaaagcattggtggataaatcagaatctaaatctgattaaggctgcaaacttactccggttaaaatgtcttttggaagctttggtttagttttggcgtctgtatcctcaactagtttattttccggaattgggcgaccaattttttcttctcgaacttcactgaatttggttccttccgtcttctgtttctgctttcaggatctcagaaagttcatagaaattcccgtactaaagtttaaaagtataataacataagaaaaatgcttaatgctcaatatagtttgtattatgtacaataatagtaaaaaaatatagaaggatgtagtaatattgttgtaaaagtacagtaacacgtcacgttactgtagaacacataggacattactgcacttttggcagtaacgtcgtagtaaaattgtagtagaccaggaatctaaacaaaaatatatgggttaaagcctcacatactaaccatatacttgttaatgtacaaaagtaagaatgttactacataatagatgcatgttaccacttccaagtagctatgttactacacgataatcgtagttttactacgtcatttttatgagatgaagatcgaataggtgggctataggtaaagtctgtaggtggctttgagtgaggtctgattgatgtaggagtgttttgaacaattttatgcatttggtaaaactatgttactgcatgtatatacccatgttactgcaaattacatattctgttaggagtgttaaagttcaaaatgccaatatttgaaaagcaatatctcacaagatatgtattattttctaaaaccattttcacaatgatactaaagtgttactacatgtggaggatagaacttcaaaatgcatctacatactcctctactcaagaaaccgttcttcctccctcttcttaagaaaaccggtcttctccctctaatatagtgttactgcatgcatgtatatgatgttactacacttttggcagtaatattgtggtgaattgcagtaaatcaggaattgaaacaaaaatatatgggtacaaagtctcaaatgctaaccgtatatttgttactgcacaaaagtaaaagtgttactgcacggcagatacacgttaccacctaacatttacacattaccgcatatttatgcagtaacactatcaagaactgcagtaaaaactttgttactgtaaaacaaatagatcgttactgcaccattggtagtaacatcgtggtgaaattatagtaaaccagaaatcaaaagaaaaatatgggttaaaagtctcacatgctaaatatacttgttaccgcacaaagtggaagtgttactacatagcaggtacacgttaccacatgtttatgcagtaacactattcaaaaattgcagtaagacgcattgttactataaaacttatggtctttactgcacacttacagtaacgtcgcgatgagattatagtaacgcatgacagatggtagtaacgagtagtaatgctatctagtattactacttgtggagagttaagatccaaaaaaacccaagcttcgaataacaatatctctcatgtgatatatgatttttttaaaccgtttacaccatgatgttagaaaaaaagtgcttatcaaaagtagatctgtcatgactatatttcaactaaatttgaatgttgttactgcacgtaagacacaacgttactgcacgatggctgtcgcgttactgcactgtttcgcaagacgagagttgagaagaggtgggtggtgggggagttggtaggcagtttgaccaggctttgaccgacgtgggggtgctttgactgacctttgactaaggtgggaggtgggtttggaccttgggactattctatacccgggtgtagaataatttttctatatatatatatatatatatatatatatatatatatatatgttcttggtgaattaaaagccaatgctgaaaaagaaactacattaaaaatatcttaaatcaatcttaaaattaaatttaaaaatttaaaaatttgtttttttctttggctgattagaccatccaatgagatcaatgttattgaactggtgaattcgccgactcactagtttgaccacggttcaaaagtaataacaaatatacccctgcgcaagtataatcatttcgtcaccttaaaaaaacaaaaaaaaggtaatttgactatttaaaaaatatcattataattcatctatttataaccgtgtcattaacattttacaaaattagaatcatgccggtctctagtcgtggtagggttattttgctttcaagaagtcaaagtagtctatccaggtagtataagagcatcccaacagctcatccaaattttatctttcatatacctactaaatggtaaaaaaaaaattctctctatatcttttttactttaacagatcatccatactacatccttctatatttttttactattatcttctaactaaccatataaaatgtatgtattattgtttaagggctattatttgaacaaataaattgccatatgctttatttttttttctcacgttaattgctatgcagcgccatctgcctattaaaaaagaaacgagaagaaaatcaggcaaatcggcacacggccctgaaaatcaaccagcacacgacgcaactcaagcggtggtataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggtcgttcggggcacggcggcccgtgaaggcaggccgccagcctgcagtgcacagtgttttttttttaaaaaaaagcaaaggaaatgtataaggaaaaaaaaaattaaaaatggaaataaaatgtttaaaaaaagtaataatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttgtaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcctaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccatcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaataatacttacatctttccaaccgcgagctcttcaaacctgtgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttataggggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccggcccgctacagtagccgtgccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctaagcggtggcggcagtaggcgctggcgacggcgggcaggggcgacgacagtcatcaagatctggtaagcccctcctctccaacctcacttctccacggtttcaccctccctctctgagaggggggggggggggggaatcattgagtgatgactgccctatccctgagcagacgagccccaggcggcggccggcgacctagccccacgccaccgatccggctgtccgttgccggcggcgctatgcctgcctcttgctgaaagttgactatcggttcagtgttcgtttcggattagagttggaggtcaagtcggtgctcatcatcttctaatatatatatatatatatatatatatacaaatcatcatcttcttcttcatccaaacggctgcgccgccgcttccgtgctctgcatcttcctctgccgcgggtacgaatcctgccgatcgaccaaatctcaggtattcacccccccccccctcccaaccccttcaaaatttcttcttttgcccgtacagggaatttgcatcttccagagacagtacccgatcgatctagaacagggcaatcaatcgatccctgcatcagatgcgctttctttttcttgcttacatccgactgttatttggtttccggcgaacaagcctcatagtagttcctaagattcaagccattaattttgttactagctaggtcaacgtgttggtgttgctgctgtgggcagcagtttggtggctacgagaaagacaaaacgaagcttgaaacggattggaactaatacaaccaaaaaagaagaagacatggatgatgctactacgaccaaaaggaaaagaccagtgattcgtttcaatgacctacctacggtatgatcaattgataattcattcatcaacaacatgctgatttgtttgtacagttgacaccattgttctcctcgttgcaggatatattgattggtatcatatcccggctgccgataaaagaggcggcaaggacgagtatattatcaagccactggaaaaaaatctggtgttcccatgtaaacttggaattctccttctactcgatgtcgccaagattagcttcgacctcacatgatgcacggcttaggatgaaaatgttcatcgagagagtcagtcaagtctttgcgcaacacagtggtctaagtgttcagaaaatagcaatccaaggtaagttggataatgaacatgcagaccacataaacagatggctcagctttgttagtgctactaaaacgaaagatcttacttttgatttcaaatcccggtatcctagagaggggccctatgatttcccttttaagtttttcggtgctatggacagttcatatttgctgtccatgaggcttagtgctgtttctctgaacccgcctgtggatttcaaagcctttctgaaccttaaaaggctcaagttagaacacacaaatattactgatgaaaacatgcagattttgatctccaactgcaatgccttggagtttcttggtatcgttgattgtgggaagctcacaagattgtcgacatcgcacctttggaaccagcttaaacatttgcatgtcgagagctgccatctgcttaaagagatagagttgaatcttggcctgacgaaacttgggtacaagggcacactgataccgttgtcacctcctgggccattgctgctaacgaatgtctgcatgaagctgcaacacgctcgttcctctcttggatatatcttcaccaatcttccaagcacgctgctccatctcgagacgctgagtttgcaatgttcagaactcgaggtttggtcatgaactcagttcttctgcattcaaatattcttgctcatcattccctatgtgagattgattgtgttatgtctcttctcttcttgtgcgtatcagagggctattttgccagaaaatcatatcaaatttatgtatctaaagcatttgaggttgcaattgagacaccctgtgacggaaaagaagattgatcttcttgactttgcctgcctactggaagctgctcctttactgcaaaagtttgaattacatgtaagtctgtcttttggagatttggattacgcaattcacttatgtaaaccgatcaatcttcttcaaactgaatactgtcttagtggcttttacatgagatttttttcgttatgtgggtacagatggtcactcactttatattgtttattgaacactattttctgtttctagcagaactgcttttatattatgttagattatatctgcttggacatttcctttacttgcttgactctgacttcagtttcaactgaaacacaaccacacaacctaatcctgttttggactaaagtccatactatgaacattcttctgagcaacaaaataatatagttctgatagagcttttaactctcttattatgcaacacttttttacttttgtatagatctagagtggcatgcatgtaacttgcaattacagtgagaaatgagctaatcgttaatattctagctagtctgaaaaaaagccccatcctatatatacaattaaaccaccaaatcagtagtgctggcctgagttaaatggcctgccttgcctatatgctttctgttctctatattcatgtagatatacctataataacaccaccatgtttcccacaatgctgatatttatcattttttatgctgatatttatcatttttctaaaaagacgcgaatattagggaatgacctaaaatcaaataattagaaggggtgagacttacgcccacaaccttgtggagctatccggaagacccctggacgtttctcatttatcattttttttctagatgtggatgccccttcaccatcaacggtatcgcgaagaagctcatggcgagctacggagtcttccaccgcagcctcatgcccatctcaggcttgtacacataagtggattcatcggcatgaaagaccaattggagctgtcactgcacattctcagaaattccgccatgatcagggcgatgaaggtcgaccccaagccgctcttcgcccttccttgtatatcgatgctgtcacccttggaagggtttcagtatcttgatgggtatgaggtcgccattgaatatctctgcagagaagaccacaacaatgttgtcgatgtttctgaaattcgtcgcgaggaggtcgaaacgctctcggtttgtgagctggtttatccagattgtgttcgccttacccgtaaggccaattcctcttcctgattaagatttgagccactctgaaggtattgttcatgccagtcaagctctacacaatttggacgactttggagtttggagcagctaagtcagccctgattagtttggttttggtttttggacaacttaggattgtgaatttgaagaacaactcgtatgtgttttagttccttgacggtaacttatttaacttccttttctgtatgatggttgcttcagaaaatttcatcactggaaagtgtttttgtgattggaaatggtggtcgttcaggttaacgtcctggttttttcagttcagacttcagaatgattttcttcctggagctgcttaatgcatcatttataagaaaatagaactgtgaattttggttttccttagtttggacttcaaagcttatttggaaatgtcagcaatttcatgtgggcaaattaattaattccagaataaaatccctgtgaggaaggcaccttgagtgcttggatggacgctacgataaagtaacatgtttagaacccttttgaaggaaaataaaaataatgtatcacatcatgttttctctattttatttatcgaattcttctatcatacaaatgatagtttttatcttcttcatttgtttaaatgtatgatattgttgactatagtcggtcaaactttaaaactttcaccatcaatagctctttaatataataaaagaaaatcatatgggtagatttttctttataaatatttttacatcattataattttgcaattttgttatatcatagtagaaaaatattggcataagttacacatcaaagatcaaataagtcatcagtgttaaaacatgttaacagaaattgaggtgatctatgtacaaagctcatgtatgtgttctttctcacactttctcaacctgttaattggtaatattttataggacaattgctttttaaaatcatagtaatcaatttccaaattttattaagctaatctttaattaaacatacgttaattcaccgcatgatttagcgtgccggttccccccagccctatgcaccgaacacaaccgaaagccagcagagtagacaaagcgatatactcgccacgtgtccaccaccttcccctgccacgtacaccccgcatccgacggcgcaaatccatccatacccttaccactcccacccacgaccgtccaccacccctccacaccactgccaccgggccccactcaaccgtgggccccacgtgtcatggacacgagccccgtgatttttccttttatataagctcgagagtggaagaggaaaagagagcgaaagcgagagccgcgagctcacctcacctcactcctcgcctcctcgcttccattccccgatcgattccggccgccgggagcatgatctgaccccggattccggcgattcgatccgcggagagcaagatcggtggtcctttcgccggaattggcgatgtcgtcgtcgccgttggtgcttactgtcctcttgtttgcgtcgctgacctggctggtggttcttgccccgcgctcctcgtcgccgccggcgacggcgacgccgtcgccgcctgtggtgggtgatggggtgggtggaggtggggaggatggtgatctcgcgctgttccggcgagccacgctggacggcggcgagggggcggcggcgatggcggtggcggagcctaaggtggcgttcttgttcctcaccaactcggagctcacgttcgcgccgctgtgggagaggttcttcgaggggcatggcgagaggctgaacgtgtacgtgcacgccgacccggcggcgcggctgatgatgccgccgacgaggtcgttcaaggggcggttcgtggcggcggggccgacgaagcgcgccgacgcgacgctgatcgccgcggcgcgccgcctgctcgccgccgcgctggtggacgacgccgcgaacgcctacttcgcgctgctgtcgcagcactgcatccccgtccactc

SEQ ID NO: 8682 - DNA, 10958 bp, Oryza sativa
ttccgccacctccacgcgacgctgttcccgccccccgccgcggcggccgcggcggcgcgccgccaacgccgcctcccgagctacatcgaggtgctcgacggcgagccgcagatggcgtcgcggtacgcggcgcgcggcgagggcgccatgcttcccgaggtcccgttcgaccggttccgcgtgggctcccagttcttcacactcgcgcggcgccacgccgcgctcgttgtcggcgagcgccgcctctgggacaagttccggcagccgtgcctggaccagaacgcgtgctacccggaggagcactacttcccgacgctgctcgacatggccgaccccgccggcgtcgcgcggtacacgctgacgcacgtcaactgggccggcagcgtgcacggccacccgcacacgtacacggcggcggaggtgtcggcggagctcgtcgccgacctccgccgccccaagaagaacaccacccacgactacatgttcgcgcgcaagttctcgccggattgcctcgccccgctcatggacatcgccgacgccatcctcttcaacgattgatctccattgctgctgctctgctcatcaaaggtaatattcagaaatattcagagattaaagatttattactaattcttgatcatgttcatgaactattcatgatggaatgatgcatgccattttaattaagccataaattttgcaattacgagagcatgaaaatcggcaattagtggagcactattcaaatctgcaatcacaaattcactaagtgaaccaaggcgtcaaagcctcgaatttattttcaaatttggaaaaataaatgcttgaattaagttttgtttgctttcacgcgacagatttgtcagctccgttatcaatccacgtatatatacaaaaaagaaattaagtctgttgcttctgtgatttacaaatgaaaaggacatgtcgattagtcttagcttggtcctgcatttgggcagaaaattatgtacctttctcgcccaaaaaatagaaaaaagaatttaaaagtctctacattttgtaactacatagtccttactctatgagatcatggtacttgcgtgtcaatgtttgacaatgatatcctaacctctacttgatcagagtccttgctaatgctacgcattgtcttccattttgactaataccagttgattttttttgtttcaatcctatccatccatgcaagttttaggttaggtttatgactggttgcttgcacatttgcacagttgcataatcaatcaacctcaacagatctaatgagcctaaattatacacctttttttttccttttgcaggagttgattttgcagaagaagtggcctctgttatttctcccggtgtctgaaacctgagaagttcagagtttcagagtttcagtcccttcctcttctgttcttgccatgatacttggtgtaatcgtctgtagattagaaaaaagaaagcaagtgagcaacaacctaatgcgaagcagcaggtgttgcctggatcatctcatcagataacatgatgatctcatgatccatctatataatcatccaatgcatttgcctagagctagcagcctaaggctgcctgtgcctgaatgcattagctgatgaagtgtcaaatgtcaattagtgttcagtaatcagtactagtatactgcaattaataaacctcttgcaaagctactactacttgtcagctcctgtgcataagaagtaattaagcagacaggtttttgtagcaagtttcatgtgatgacttttgagcagaaataaaataaagaaaatggcagaatcaagcagctggagagagaagagtagcactgcatgcatgaacagatgtgcaaagttaatttacatattaagcgatgcaaagtgtgtgtgattaggggtgcaaatggtgagttgaccccgccagttgcggatcaaggggcttaatgctactatactgtattatctttcacgtcttcacctgaagaaagcaaacgcatttgcatctgattaagcaacatatatattatgcttttgttaatgtttatgtagactgtattgtactactacgttccttcttgcagatgcatatggcaggatccatcctaattaagttacagaagcatgaggtagcatcacagttaagtaggaggattattaggaacaaaagaattttaggggattttgtggagttgatgttaatccgttccgaatgagctaccaatgatccttaattttgcttatacggtgtatgaaatgactgggggctactagctggcgcgtgcgcgccagcagcgagcacctcacctccctaattatctatagtactattagttaacatccatttaactactaatgacgagtaattagggaagattctcaagatttttttttttgggagattgttgtaccaacagattaaaaatttttaagtcagttttgaaaacttttgatttaagatttaaatttaaaagtcaaattttgaaaactttccattcgaatttgaaaactttcaactcagatttgaaaactttcaacttagatttgaaaactttcaacttgagattcgaaaactttcatgtccagatttaaaaaaattgaaaactttcaacttgagattcgaaaactttcaacttagattcgaaaactttcaagtcaagatttgaaaaaattgaaaactttcaacttgagatttgaaaattttcaactcgatatttaaaaactttcaagtccagatttgaaatatttaaaaactttcaacttgagattagaaaattttcaacttgagatttaaaaaatttcaagtccaaattttaaaattttaaagttaagattttaaaaaatactagtaaactaatcactagtaaaaaagactaatctaaactaattacgttacgtacggtacggtagaaacagcgaaaaagaaaaaaaaaagagaaagaaacagcgaaaaaaaggtaccagcgagaaagaaaaaaaaagagagaaactacccagcgaagaaaaggagagagagagtgcgggccgcgtgggccgaaaatgctcgttggcgcgcgcgccaactagcttttccggaaatgactgacccggtcgtaacaggagggttgtacggttatattcattatatattttgataatgtagtatattaataaattccacaaagtactaatattttgaccaaactaatgtaaaactatagatttaattggcaattatatcataaaaatttaacatcaaaattatcataaaagcacatgtttaatatatagtattgcagaattatagatttaacactaattgaactaggggtgagaatggatcgggtagatccactccaaatccattggaaacaaggatatggtatgagattttagaaatctgacggatatggatgcaaatgtggatagtatgatgtggatgcagatgaggatatgatatggtatctctaaaatctgataggccgtttgccggataatgtaaaattatcaacacatgtaacataagttacggtcgggtcagtcatttcatacacatgtaactattgatttcatacacacgtaacatccgataaatttaatctgtttttaaccgattccgcaccatttttgatatccgaaacaatcctcgtctgtattcgcatccgtacactatccgcacttgctccgaatctgctccgttttcacccctaaatttaactcaaaactgcagctagtgtaactccacactaatgtgcatctaaactttaaaatatgtagttttctgttaacttttttacccattagtttttgacttcaccttaaatctacaggttcggaacaaatttagtaaaaaaactatattttgttatatattgtattaaatcagctgttttgtgaaattaagatgtatgtagtcttgtaaaatttaaatatttatcttactcaaatttgaatatccttacttttagtactttatccaatttaatagtagtactacatgtactatgtagaaaacggacaggtgtactcagctaaagcaatagatatagagcaggataataaaccctccatttcgtacttttctctttttaaagtttaatcaagtttataaaaaaatataatagtatttttagtataaaataaatatattattaaaatatactcaatgctagattgaaactaatttgagaatttagatatcggcatatcgctaaattttcctatatttttttttcaaactaaacaaagtttaacaaaagtgttaaacgacgtataatatgaaacgaagggattaatgagcaataactataagcaaccatgttaggtaggtgctcgcacagtctcttgcaagcttagttggggaaaatttttaagtttagttatcacatcagatatacggacacacatttaaagtattaaacgtagtctaataataaaataaattacagattttgctagaaaattgggagacgaatttattaagcctaattaatcatcattaataaatatttactgtagcattaaattgttacattatagcgtaattaggcttaaaaattcacctcgcaacttatatccaatctgtttaattggttatttttatatttaatatttcaggtaggtattaaatatttgatgtgacagcttttgagaatttgccggccgcatacgaggagaatacacctgcgttttcgaatgcaggtgtcgcacgggcacacgtacgtgtgcggcatgcagggagcgacgtatgccacgtggacggcaacgctgcgtttgctggcgcggatgcaccgtgatccgtgggtttgacctgtacgcttgcacatgcgctcgatgcattgagattcggcgagaagaagatgcacatgcgttgtgtgtgtgcacgcctgcatcgttcatgttgttggcactatgtagtattatttacctcatccatcctaaaataacaatgtttcatactaatatataaggttaattattgccagtgagagggagatattatttttatgttttcagtgatgccgacataagaaacaacacattcatttacacatttaattgatgattaaaataactcatataatccattgttctcatttttgttgtttcatacgtattatatgtaagacaaactatattataaacaaaatatgctgacttagataaatatcattacaattcgtctattcgtaaccgtatcactgaaatcttacaaaatagggaccgtgccattgtcgttacgttttgcatccatctccttccttcttcgtatgttctttctctcttcccatcttcttgcattgagatggcagcggtagtagtgcgagcggtgggggtgtcaacgaggccgggaatgaagcaggagtgttggccgagccagcaatgacgacgccgtgcttgtccaccggcacaacgccagacctccgagtagcaagccctttgctctgccccagtttgcatgctcggttgcgtcctcatgctccatccagcactcttgtcctccatagtgctgccctcgccgcaccggtcgcgtgcttggcgatgctgctaatgcgccctcgtctccgctcctccgcatgctcaccgtgtgctcggtgacaccgcccttgccacgacggctgcgtgcctaacagcgctcccaccggcccgctcctctgcagcggaaggactgctcgcactcggcgaagatgggccgctcatcctccccagccgtgcgctcgaggacggcgacgtacggcaaggccccgaggatgcggacgacgattgtgagaggtgccgctccgctacccctctcatgatgatggcgaggggttctcgctatgcagccgcgcgcaggaggacaacgaagatgaggtgctcgtggtcgttgcttctccctcactcccgttctcgcgctctgcaagggtaagcctcatatgttccccatccatgctctcgagaacggcgatgagaggtctgccatggcgtccgcgaccgctgagctcgtgctgccctcgccccagagatctggttgcagctgctcgtgaaaggaagaagatgaatttgacgggtaggtcccacgtgcagatggggggagaagatgaaaaaagtgacggtgatagtatggttctgatttatgtgattttgaatggtatggatactcataaaagaattatagtaatatttatctgaatcaatatatttacattggcatggatccaattaaccctagaggcctagagacaacatatgcatgaattcatctagatgtggcttattttgtcttccacttcattaatttctgcacatcattaaaaatactgacatggcatcctatttaatgggaataaaactcctattggttgtggcctaagacacatatgcatatatacaattaattagcatcttcctttccttttaattcttttttaaaaccttcattcttaatatctctaattttattatatgtatgtattgtatttattagaatgattagatgtgataataatatttttttacttttgcgttagagatagttacgccttatattactaaaattaatcgctacttcctccgtttcataatgttaaactttctaacactgctcatattcgtatagatattaatgaatctaaacatatatgtgtctagattcattaatatttatatgaatgtagataatgctagaaagtcttacattgtgaaacgtagggagtaaatactaaaaattgctacatttctaatactaaataatggattatcctcaacaagaagtttatttttgaaatgaacaagaaattaaaatagtaaaactgcaatcatgaaagctcaaattctagaccaacacacatggatgtgccggatttgggctatcgaaatgaggcctaatttattccaagttcttggatcacatttacgaattacgaccttgttctttgggccttcagtcccagctcatctagtacaaattcctggcctatgtacccggtcctcatcgtttggcttatttcctaataagccaaaacggcttattaggaaataaaaataaatttatgggtaaaacttttataaatgtattctttgtgacttaaaagctaatgttgaaaaagaaattacgttgaaaatatctcaaaatcaatcttaaaattaagcttgaaaatttaaaatttggctttttctttggcttattaggccatcctatgggagcctggctggaattaggcccatctgagacagaaatgggccggtatttgggctttatctaaccagccacatatgtcaattttgcttctctttgggaagcaagcagtccccaattttttctctgttatgaaaatgatttgcgtaagacctaatattggtaaaagtaaagtagtatatataagaaattttattactaagtagtactagtagatgtataacaacaactatttaattgcatcgaattcatcgttagcaagataactataagtagcttccctgtatatgatcgagatctatagttaaaaatacttatatttaggatgaagagagtatttaataacatgccactctttagttgccagaggctatggttctctaaatattatccagatttatagttaaaaatatttacattttaggacacgtacgtgcagtgtcgctcttttgttaccagatcgaggttgcgcttctctaaatgtcatccagatcgaggttgcttatattttgaattaatgacgtgccaatctttagttacgagaggttgcgcttctctgaatctctctccaaacagtggaagattgaaaccctttcaattattttgttttgattccagaccaccactgtatagcgcggcggcggcccagatgacgacgtcgacgaggaggacccagatgacgacgtcgacgaggcggcggctcggcagcgagccaggcgcggcagcggcaacgagcgaccgattcgctttttttattattatttttggtatttttgatttcgtgcggttggtataacacaaccgcatgggataatcgattatcccgtgtggttgaaccgtcctgacacgaaaatgctgattttttcagataattggctctaggcgggccagacaaccacatggaaaaatcaaaatgcccgtttggaaaaatcttgaatgtagttgtgagcgtttctctctcatgatttcagttaaacactagagatggaagcacattgtgacacactgacaacgacaatattgaatcatgattactaacagttattttttcaataaaacataaaaaaaggcatgggtagttttcctgctttttttttgttgacatggttcattaaagaaacccgggtgatctttccccgaaaaaaaaaaagaaacccgggtcttagaagttagaaaatgttaatatggatgaaaataggaaaagctggaatttagaaaccttaaatatactttctcggtaacagtaaaatttcttatagttggaatccttaactaacgctttggtgtctctatgtgatcagttcgttcttctctcaatcgatctccagttttaatcgtttgctagatctccaaaacagagctagagagcatatatagctaactatatagctatatataagccatttctgcaatgctttcgacaacatctgatcgatgtgagcatatccatgcagggccggtcctatgattttgagggccctaagcgaactcatcgcgatgggccctctaaactatatataaaattttataatatatagataataattttacttgcaaaacgataacaaatatatccatatattaaatttaacatgtctggtaattatgaagaaataaaaataacaatatatttgtaacttggaactaatatcattattcattaacttaatgaagaacaaaaccccatcatatcctttgctcccatgaaaagatatttcttcgggcatttcttgatgcaaaatcatcaataacggtattaagatcaatagtgttcaagatatccttctcaattgagcacatacccaagccatttaacctttcttgtgacatagttgatcttaaatagttcttcaaaacttcaagtttgagaaacttctttcagctgaagctaccgtcataggtacagttaagagatttcgataggcaactaaaatatttggatagcaatctgcatccataacgaacttcagaatctcaggcgcgaacatcgaagaatcacacctttaattctgaataaagatcattgatctcaacatcggatgaggtactagactactagtattaggtgttggcccctccaccatcatagacccccggcggtcacctcggctgcatagggccagggccggccctgtatccatgcatgatctgctgtgttcatctgctgtacattctgcatatggcgacaccacctgacgcaacagtgatcttctgctaaaaccactgtatactgccgttgctgctgcctctacctcgtccgtcctgcaataataatgctgcaggatcatgatcatgctccagcttaattagccatattggcagcactgcctcgtcgtcgatatatggaagaaattgtgagagcaacagagctagtacgatcgatttatgtttcagtgttgcagagatcggtcgatcgatggatcaatagtgcatgtacagtactattgatgggagtacgaggaagctgttggccggtgatctgtccatgcatccatctctagctgtattaatatttacgtactctttccgtccaataataataataataataataataataataataataataataataataataataataataataataataatcctacagacgtattccttccgtcctaaaaaagctaacttctggctatgtatctggagcctatatctggatacatagggatagagagagtatctggatatgcagatatattattagaattagatttttgttaggacatggaagtatatatatattgctacacaagagttaattggacatgtttgtgtaattaagtgtctgtactgtgtactggcaaacagtgcatgtctatgcaagcatcatcagtgtgtgagagagatgtagcagctgccagcaaatattgctagctctccaacatagttaacttctgtttgatcctgagcattatgtcattaataacagttcatgcctgcatgtatagtatatgaagaaatattcaatatagttattagatatcctctttgatcatatggatgggtattatttatctcttatatatacgtgtagtcgaaattaactaccgcctcctcctccatgtcagaatataacaattttaactataaatctggataagttcatatcctaattcttagctaaaaattaatagtatattttataacggaagaagtaattagctctagatttgctagaattaattagagaagtcagagttagctaggaatctaagctacatgcacgcccatcttattcatctcatcatatttgttcactaacttctaaaactcactagtaattattatctagagtattttaaatatcatacaaacatgatatatcatttacaattttgttgtattttagaaactcaatatgcaagcaatataaaagcattatctccacatcatttaaacatatatatttaccatttctataatatataatatgtattcatccacatatcctgcaacaaagtaaggcgtatcaacttagtgcacactgaattgaatatccaattgtatgagtgacggctaagatcagattaaccagatgtataataaataagcactccaagttgaagaaattctggaccatgcattcctccacgcatgcatttaatcttcagttcaatttacaactccaaatggttaatttataaattctaaacccttaatcgatgacgcacaagtactagcactactgttcttcgtcgtcgtaattaattagtactccctccgtattttaatgtatgacaccgttgactttttaatcaacgtttgaccatttgtcttattcaaat

SEQ ID NO: 8683 - DNA, 1124 bp, Oryza sativa
aagtgatgaatctgtgtcaacctttatattctcagtgaaagtgcgtcacatatatatatatatatatatatatatatatatatatatatatatatatatatatatatatatatatatatatgtattagttgggtatatctgcagggtttgaaccctgatagatagaaaattcacaaccacatcaaactaatgaaggtggtttgcgagacccacagttaagtttatttaatttgaagcttacccattaagcatgcatgtactgttcgtacgtcacggttaccgtagtaaaacattagtcaactaatagttgatgttaccaaaacccaacagtttgaaccatatgcatgtcttattatcagctacatatatagatgcatgcatgttgtctatactacatctgctaataattaagaatagaaggtacaaatataggctcaacgaaaacgttcttaattaattggtcatatttggctctacatgcatcccatcgatccttgcattaggtcaaacacatgcattataagtagactagatggtgtgcttagtggagacagtcaccttaaattgtagtagcagacgaatattagcattaattgcattgctaatgtacaaaagttcaaaagacaactagctaaaattaaagaaaaatatttcaatttgagatatgtcaacctttattaatttgaagatgagttcggttgaaaaagaaaataaggtgttcgacttcttaatttaactatttactcgtaaagatactctataggtttttaacgtttgatgccgttaactttttaatatatgtttgataatttgttctattcaagatttgtttttacaatcaatatgtaaaaaatataaaagtataagtcatatttaaagtacacatgatgataaaacaaattaaacaaataaatgataattatgtaagtttttaaaaagacatatggtgaaacgtgcgcctaaaaatcaacagctttaaacattaaaaaccgaaggaagtataatataatattttttgagatatcgttggtataattaatctacaaattaatggcatttctgtatgaaaattcattatgctttcatgtaaaataaagaccatactgatactcattatgcgagta

SEQ ID NO: 8684 - DNA, 411 bp, Oryza sativa
acctggccatggcccgcgcgcgcacccagcgcgcgcaggccctggtccaggcactgcacgccgccaacggcccgcaggccaccctgggggtggacgcttcgcgccagcgctacaccgccaacgggctggtgccaccgcccgtggcaggccattggtggacagcgcctcggtgcaggcgggcttggcgtggtcgcccgacttttttggccagcacgccgctgaacagctcggcctgggccaagcccagccgcgcaggccgacgccgccgccgccgaaacgctgctggcgctgcaggtggcccgtggctacgtggcactggcgcgcacgctggcgcaacaagacttggcccgccgcaccttggcgcagcgccaggaaatccgcgacatcacgcaccagcgcctgggcgctggc

SEQ ID NO: 8685 - DNA, 641 bp, Oryza sativa
cctgcagcccactgagttaacacatgcaggtaatgagtttcgaccattttgtaaaagaagtagaagagagctggagtgcccattatgaccgtcatgtccacctttcggcagtagacgcaattttgcaaagggcaagtctagatcatcatacatctgcagagaataaaaaatgaatgaagaatcaaaatagcaatctgttaaaaaaaacagcaaccagaaactcgaggatagcactttaccacaagaacttgattaagtggtatcttgaaatatgagaccaactgccccacctgtataactcgatttgtcaaacgaaaaaggtaaaaaaaagaaggaacaactagtagtgaaggttgttttggaatcagtatacttacagactcaccacttgcattcataaaagtttgtggcttggccagcatgataggggcatctccaatacgacctaaatattattttctgttatgaatgtttgatagcactaccttcagaatttcaaataagtatatgcacctgctcatgtttaatattcaagcatagagtatcttaaacaaatagcatttgtttataggtaatatttatgaaaaccgcataaatattgttagagttgaaaaagtaatgtgcaagacttgaggaacaaa

SEQ ID NO: 8686 - DNA, 890 bp, Oryza sativa
tcctgcagcccgttggattggagcatttgagcctgaagatgaggcattgggcccatgagaatttatgctcaattccagtatctagtgtagcaggtaaagagaattaaatgtttctaaatgaaaacataatcatcattcacttttactgtttataacttcatggttaacggttattatcaggtgaaaaacgctgaccatatatcagacagcaagcatgtcgatgcatgcgaatatgaagagtactgaactgaaaatttgtagttacaaacaaagaggcaagagggagtgaaaacagaacagggacgaaacagtgttccgccttcaacttatgaatcatagccaaatttaaattttagaattaatttagatgtttcatcattttctattttctggccttaatttttgtggaagtacaaaaactttaccctaaaatcaattttggttgcttcatttatttttctcagcttataagccgtagcccaaacaattagaatattttccagagaaaggccaaaagcatagttgtattattggtctcttgtgcatttgccaaaaaaacaaacaaacaaaacaaaacagagacaatcatctatttatgtgcagtacagactacagataaacagttcactcttgctcatggcagctacagtgcagaggtcctaagcaattcattgcctggacccttagttgtattacaacacaaggtacaaactgcacattagccatttgctgctcaactacctcaacagaccatgcactgcattgcaaaagggactctatggagactcttcctaaaatctcggccattgattattgacatatactaaatctgaacaatgtaatttcctatctgaaaagtctgatgaaatttgcaggcttccctttctttt

SEQ ID NO: 8687 - DNA, 1958 bp, Oryza sativa
tggatatcggccaacctgtagcgcgacataagtcaaaattattatataactcaacaagtattcacattaatttcaaatagaatagtcatggcaaccctctgtgaaaatggatcaagatggttcatgagatatccatgtcttgctgcttattgatgaaaagggaagagaagaagagaaaacaacatatgatcctcaaagagaattgcatattcactaaatatatgcatgggattccatcagcaggaaatcatcggtgaccataaccgcagggcatcaacacagtaagtccagtataacagcatcacagtgatcatcagcacacatgcttgaaataaatcgattgtgatggtacatcgcggaggtaatatttgagaatttcaaactaaccatcgaagcgagtgttcaaataagttaaggtaagaaaatggtactcacaggaaaaagcagatccagtgtattccaggctgcatgccttactgctcgtgtagggtaggtaggacctccaggagaagtgaagctgtaaaggcaagccttcagtctagtgcttgtactcatcctcaattccaatcctggatgattttttttttcagaatgaagaatttacatttcagtggagaaacagatgcaaaaagtcttggattacttttggaatgtgtctgaaatctgaataactataccttgaaggatggtcaagccgggagaggtaatgcagaagcacaggttcaacttttagtttctggagctgaaaaacaaagaacacacgatttagtttgaggtgaagttttagcatgtcatgagaacaccgaagatacttcacttagagaacaacctgatcagtgagttcaattacatagtaatctgcagggccaccaaccaagaaagaatttggaaaagtaggaaaatgctcaaggaaacttgcaagcaagtgatctgcacatgcaaacttggatcacttcaatagcaaacaattgggaccaagaacgtggagaaaaataacataccttgatcatagaacagcataaatctcgagaggaggaggaaaagacctctaccagcctgttcaaaacatcaaattaatgacaacaaatactatcgtacatgcttattaggaaaactcatagcagagttcaatgtcaatagggagtgacctgtactgatatcttactcagttgatctgggactaaagcaacctcttcaaggagatactgtttaataaagcaagcatgttttgattttactaaaacacatacatcacagtttcaacgaaatttgagcaactgaaaccaaatatatccttacattatataatgagagaaagtgtcttgtattggtttggatgtcaatcctgtcaaaaagtaattccatcagatctatggaagtttcaggcaagaaaaaaaggaacatcagtgcaataatccctctgttagcagaaatattttgcagtaataactttctcagtcaacagatcaaatttatgggtgccatcataccaaaaaacattagtagctccttggacaagagcagagctgtatctcagtgatacttccttcccatcaagagggacttcgaataactgcaaatgatgaactagtaattcaccaaactgaaatagagatgaaggctaatacaatccggagcattcttgtatgcaagatcgaataagcgaattacagctagcatttacagaattctgtacttagcttgtttaactagctatttgcagtaaatggtggccagaacaatgggcagtataagcttgatgctgggatacaaattccccagtaagattatctttccttttgagatcatatatacattactcaaaagtgaaaacttaaaaccaccaagacattagctcattcagaggaacatatagcaaggagtaaaaggtaaaaggcacattcactgaggtactggttaaacaaattccttaaacgttactggaaatggaaaacatg

SEQ ID NO: 8688 - DNA, 22325 bp, Oryza sativa
cttccctagttagcaagtgcatgccaaaacagccaacttttttagacacttcaatctacagatgcatataaaataaacaattaagatggattcctagaataaaaatgaagtaatgccaatcttggtaaacgatttttgaaaagcaaaatatagtgaaagtgacaagggaaagaactagtttttaactcttggctgacatcaatgaattgttagttctccgccaaaaacgttaaacaagggaatggatataaaccatagtacaaaggaaggcaatgcttttgccttccttcaaaaaaaaaaaaatagtacaaaggttcaaactctaggtaaaactaccacaaacttggtgccaatctcatgattactgtccacaaatacacacatgacgaaaaagcattagtttgattaacatctgaagctatgaaagaaatggcacctcgagcgcggtcatccaccttcaatgcgatgtcagcaaacaactgctgcagcagctgaagacgttgcgaattggagttgagagcctacacgcaagcaacaaccagtgaaacagtgccacctgccctatccaaaccactcaaattatcagtatcgtttcgagatcatataaagtaatctttaattcggtagagaatttgagaaaagaaaacgggagaaccaatttcgattctgtaactgcggtaattgccatcgacttagcgccattcgaaaaggggaaattctgggattacgaaacaggcccaaatttctctaactgatacgtggaaaacaaatcaaaatcgtatattcttcaacactgaaaactcccaacagaacaacagtctcgaaaaaaaccattgattcagaaaaaacaatccaaacaaaaaaaaacaccttcctcactccaaaccgaaattaatcgcaaagaacccaaaaaggtggccaagaaatgctcaataatcaacagaaacaggccaggacaccaccagcacgaatcaacccaaccctcccggaaatcaatgaaagaacgagacgatgaggggggggggggggggggggcaggaaccggaatgcggaaaggaaggggcaggatataaccttctgcagcttgcgctcgatctccagggagagcgcctcgaggtggtcggcggctcgggcccgcatctttcgccgtccccgtcgccggcggggggcgctcgccgtggacgctgggtcgagtagcgtcgcttcgcttctccaacgattcgtctcgtcgttgttctctttgctcctctcccctcttctgactcgtggtagggcggtccaatcagagccgtacacgtggcgggccggcgacgctggcgagtaaccgcgagttcagcggtggtggcaggataggcatcaccgtgattttgatattgcaaatggatgagaagagatgattctgattctggtcgcatttgatcggcttttccaacgaaataattttgccaaatatttttttttggactgttttgtgtaggccgtgtttagtttctctttattcccaactttttatcatatcatatcacattaaaaatttacatatacttgtaaatttttaactttttttccaaactctcaactttctttaaactttcaactttttttagaaactaaacaaacctgtaaagtttgtcaaatttttgtgttccaaacatgtgtctgattatcaggttgtactccacaatagtctgtctgtctgcgtgtttcagacatgcactgtaagcattttttttcttaatattaacagtgaattgattgtgtgattctttgctttcaatagaagcagggctgcaaagccttttctctaaaaaaaaatttgattgtgtgaaatgattgccgatttcttcttatcccacgctattgcgtgccgtctgctgtgctccaccattttcgccgcgtagctgacgtgtaccaacctttatcttggctcgaggacagcacgacagctgcatgcagcgacacgtggaaaaagcctactccacgggatcttctgcaccagctcggatcggtcactcttcactcaattcaaatcatacaatttttttgcagaatttttcatataaacatgttcactttttcacatgaatcttgtgagaattttcggtggtttaaaaggaggcctaataggcgccgtgacacgtcatgcatgcgtcatcacatcccggcaggtctcccgtctttcctcgggtcgctgacggcggtgagcatcccgtggaagacattctcgtcgccggcggcggcgaccggcgtcagcaagtcctgcacgatgaactggcagacggcgccggagtccgtgctcgtcagccggtggcccctccgccgcaggaactccctcgcctcgccgctgagctcgaacacctcgccgtcgaccaccgtcacgttctcgtacaccacctcatttggcaccagctacatatacataccaccatagtgtaattaattaattgctccttccgtttttatcatattataagttatttttattttttttaattatattattttgaagtttaacaaaatttatataaaaaatagcagtacttttaattaaaaaaatatattactccatccgtttcagattataaaacttttttactttgatcaaaattaaattattttaaggttgactaagtttatagacaaataaagtaatatttataatatcaaattagtttcattaaattaataattaaatatattttcataataaatttgtcttgagttgaaaatgttattattttttctataacttagttaaatttgatacaatttgactttaagtagagttaaaatatcttgtaacctgaaacggagggagtattaaaatatatttaatgaacctaatttgatattgtagatgcattaaatttttttgtaaaattggttaaacctaaataaatttaattaaaaaatctaagcagcttatactctgtttagggagtactggttaatcaaagagattaggtctaatcgattaactgatgcttgccttgtggtagaccctgggattcaggacggcggcgagcgggtgcatgccgacgatgaagtggttcacgaacacctggaccaccgtcgctatgatgaacggcccgccgctgccgccgacgacgccggcgagctgtccgtcctgcacaaagccacaaacagtaatggtggtcgtcagcaccggcgacggtgagctcgatcagcgtgacagcgtcgtcagccaaattgttagtaactacatgccttgagaatgatcgtcggcgtcatggaggagagcggccgtttgcccggagcgatgaagttcgccggcgccggcgggaggttgtccggcggcggcgtcccctccgccggcacggagaagtcgtccatctggttgttcaccacgatgcccgtcgacggcgacagcaggtgcgccccgaagaggtggttctccgtggtcgtcatcgccaccgcgttccggtcgccgtcgacgacgcacaggtggctcgtcccgtggtcatccagctggctccatctgatgatcaagatgtaatatcatcaatccaaatgtttcctggtatgatctctgcaagaacaagaacgtgtacattttctgagatcagttgtactttgggaagtagtagctgggagggaacgtggtgttgtcgacgatcctctgccggagtttgtcggcgaacgccggcgagagcatctccgagacgttgccggtgatgttgacgtagtcagggtcgccgagatccatccggatggccagcatgtgcttgaacgcctcgatgaaccggtgcaagccaagaaatcctttcaagaactcgagtgatttgtatccgctcaagatgttcaaaatctggaattaatcatattcaagtttggtttggatggatcgaggaatgaacagatgatcagaattaactgggacgaatttggatactgaccagagccaccccgacgccgccgctggacggcggcggcatgccgaggaaggtgtagcccatggcgtcggagcgcatggcgtcgctcacctcgaccttgtacgccctcaggtcgtccaccttcgcgatgccgccggcgcgccgcacgtcggcgacgaacctctcgccgacggcgccgccgtagaacgcctcgacgccgccgctggcgatggcctcgagcgtgtcggcgagcgccgggttgcggcacacctcgccggcggcgaggatcctcccctccggcgccagcacggcgcggaggcccgggtccgcgagcacgtcgcgctccgtcttcttgagcgcgatctcgaggtacggcaccaccgtgaagccgtcgcgcgccagcttgatcgccggcgcgaagaggtccttccacggcagcctgccgtagcgggaccacgcggcgtggaggccggcgagctcgccggggatgcccatggcgagcgcgcccttgtacttggaggtcgggttgcccgcgtacatgtcctgtcagacacaaaaaccaccatttcagcttgtcatgtttgggaattcaaatgtaacaaattcatatatattttgaattttgattcgagcatcctttttcggatgcctctcacttcgatcgaattaagaacataatctacctttatttggaccagcaaactcagctagcagcaagtttacacaattgagaaacgtccagaggttttccggctagctctacaaggtggtaggctaaataacctagattcgaagcctcaccccttttaattatttgatattagatcattccctaatattcgcgtcttttttcttagcaagtttacacaagcaaattcagtgtaaccataagaactgcccaaataatggcaaattcagatgctctcagattttgcttcataatgctatcgatagaattagcacttgcaacgcgcgcatggtgcattatcaaaaaatgttttgcttcataaacacttgcaaatgtgctatcgacaaaatgcgttgttattgtggaactgatctgttcagttcttttaatgcaaattctcacttgaaagaaatttcctaatggacaatttcagctctggttcacacaaatcccccaaggtgttgctatctctgtttcaaattactgttccaggtttgttctaagttaaacatgtttatccttaaccattaatttttaagaatccgtgaaagttaacaaataacaatatatgaattctatattataaaaatattcttatggtgaatccaaaaatataaatttttgatgtttagctacacaactttatataaatttatagtcaatgattaaagtgtttaacttagaacaaatttaaaatgacaaataatttgaaacgggaagagtatatagttaatgttatgcaagttgttgtaccgaattacaccaattttacaagatcatacatcatgagcacaactattttctttaagtaatttcagatattttttcccaaatctattggtttcctatccttttagctatggttttcaaaagaagaaaaaacatcatacatggtttcctcgtaaaactacagctttgtattagtaacatgatcattgctatatatcaaaggtgctatgtccctccaaggctccaaaagtccaaataatgacagggaccatagaaagtactaaacaatggagttgatgaaccatattataacaaactatacacaaatggcgaccttatactgttatatataccgaaaacatttcccggagatatgctagttctaatgggcgatcgatcaccctacctacctagtagcgatcaggtagccccctccacctggtttccttttttggcaccgcattattttcctattttaataaatttatgcatctaaagtttatacatctcaagtttacacatctaaagtttagagaccaaaagtttataagtcaaaagtttatatatccgattcaaatttgaatttgaattcaaatattttttatatatatagtatttctatacatataaagtttatatacctaaagtttatagaactaaagtttataagtcaaaaatttatatatctgattcaaatttgaatttaaattcaaatatttttcatatatagtatttctatacatttaaagtttatacacctaaagtttatagacctaaagtttatatacccgattcaaatttgaatttgaattcaaatattttctatatatatagtatttatatacatataaagtttatacacctaaagtttatagatccaaagtttataagtcaaaagtttacatgcccaattcaaatttgaatttaaattcaatttatatatatatatatatatatatatatatatatatatatatatatagagagagagagagagagagtatttctatacataaattgttctaacttttgttttttaaaaaaaattgtgtggtgtactttggtagaaagagaagaaagggaggaggaagggggggagaggagggaggagtacatagtataggagagaggcaggggggtgatcgctgggcggatggaggagcgatcacccgcctaataggaattaccaacgcgtgaaacatgtgagaagaagaaaattataaatctagatcgaatctggacaaatttcatcttttttattcagtgtgaacaactgaacccatattttattatcttaaagaaactgaactcattttcccaaactggcaactgcagtatggtaatcgcgaagtgcagaaaaactataaagaccaccttgaagcaaccaatgaattagcccatgctgattgcacgtgtgaaatagagagtcttacagaaatggacattttctgaagcgatctacaattatttcaataatataatcaatgtccatttctgaatagttctgaagactgaagcagagttgtagcttgaataattctgaattacaaaatcacagcttgattaaaaaaagagtaaagtgtattagcgattcttaaacttgtagggttgtgttatataggttcctaaactctcaaaatgcatattcaggtcctagaatttatcaaagtgtatcatataggtcccaaatcggcacatcccctctaagatcctacgtgatgctgatgtggcatgccacatggacgtgacgtgtcattttcattttcttttcttcttttctttttctttttctttttcttcgttttcttctcattcttctttttttcctttcttctgctcgggtcacagagaaaggagaagaaagggaaaaaaagagaagaaaaaaaagaaaagttttaaatgtgacccatttgtcagtcaaaatgatgtcacgtcattccgtgtgacatatcacgtcaacgccatgtaagatcctgaaggggttgtggcgatttgaggcctaaatgacaccctgtaataagttctgtaatttggatatgcattttaagagtttagggacttagatgacacacaactacaaatttaacatacactttactctaaaaaaaaaaaggactacctactaagcgacctacaatgtgttgtttttgtttaatgtggttttaggatcatggaccacggggtagtcgacaatgcacatcgcacgcttgtacagtggcatgcctctccatgaatggaatggaatttgcaatgagccaaaaaaaaaaatcaaagtcaaatgccaatcatgtttctagatatggtgacttacatgctgttgctaaactaaatgaagcggggttcaatttaggttgtgttattttgtgcaagtcaccaacttcttatttatcgtttttaaaaaaatatataaaaaaattgctttacaaaatcatactaatcatttttaagctctttatagctaatacataataaattataggctaaaatgtttcatcgttttgcgtgtcatacctccaaacacagccttaatagctgtcaaatgccatcacaaaataaacaagttacggagacaacctttctaaatgaaaaaaacaatagctctattcagaaaaagaaataatgcagtggctactgaggcgaagaagaaagaaaagaaggaagaagatgaaaacatgagagaacgattctaactttgtaaaattttagtgatattcagctgatattatgaatagtaatattttttaaaaaaaattggtaaacttgtaataacatgatccaattaacccctttttgaaagttgcaatgtagacatttcgaattcttttttcaaaatttactgatagggatacttcgaattgctgatgtgaaatttttctgctgttcttttacagccccgtcttttcacttatgcttatcaaccaaaatttaaaatttcaaccttaaatttagagttgatttggagttttctcatcaaagtttattttacagcatttgcttttagatcactaagaacacgtatataaaagttttattcataaattatttttcgtttgtaaatataccgtttcacttattccggatggggccgttagttggtgagcagaatcacgtgcctatcatttgcgtaggcaggtgtggcccaccagacagtgacatgcgcagaccaccgaatcgctttaaatccctaatattataagagcaggtatagatatattttaattttaatgaaataaaaggtgaaaaaaaagagcagcgggttatagatctgtagccagctgcagtacagactccaagagatagtgggtgtatgataggtgagaccgtatattaatagtatataaagaaactattgtataaattggctattagactataatataatatatacatatacatatatatatatatatacatacatacatatatatatatatatatatatatatatatatatatatatatatattggagctagtagtgagctgtactattcaacttgctctaacggaggtctcgttgccggccacgtggcgcgtggccacacacgtcatccgctcaaaatttccgggaaaaagttttttttttttgtttttactgcgtgctctagttggtgacgagtagtaacgggtaacgcactcaccggcgtggccgcggccggcgcggtctcgcgggcgtcgaaggcgacggcgtcgccggaggcggcgtccctggcgacgatgaacgcgccgccgccgacgccgctcgacatcgggtgcaccacgccgaggcagagcgtcgccgccacggccgcgtccaccgcgtgcccgccggcgcgcagcgccgcggcgcccacctccgagcaccgcccgtcgtccgtcgccaccgcgcccaccccggcctccacctcgtgcgggctcagtctcacacccccgccgccgccggacaccaccctgctccgatcatcgccgcccgagctcaggtgcagcacgacgcacgccgccagggcgagcagcgccgcggcggcgatggcgagcgcggtgcacggacggcggcgccgactgtccggagaagaaaccgcgccgccgccgaggagagggttctctaggccgcctcgcgcggccatggccgccggatcgccggagattgtagtggcgatcggcaggtaggtcgtcaggaaggggagggattcttggatggcgagagcttgtcacactgtgcgtttgttggcttgtcaatgagacgcttgatttttataatgatcgtgtgtctaactgggcaatgattctacagatcctattgtacttgatattttcactattttcttaattatactcccttcgtacaaaaagaaaatatataacagttatagagcgggacacatcggtagggctgtcaaaaaagctcgagactcgcgagctgctcgagctcggcttgtcctaggctcgattcgagctcagctcgagctcctgacgagccgagccctagcctctctataagctcgcgagctttgtcgagccgagcttgagcttccaacgagcttagtaatatatgatttttgttattatttaataaattaggagatcaaatatgttatttgtatggcttatattgacatcatatatttattttattcttttttcctcttatattaatatgatgaactaaaaattaattatatttttaaagattatctttcaaatatatgttgttttacttaaaaatcaagctcggcagtcgagctcgagccgagcctatcagaaagcttgaacattttataggctcggctcgagcttgtatcgagctcgagcctaggcagacaagctcgctcgagctcggctcgttgacaaccctacacatcggtattaaaaaagtgagtggatattgaggaaaagttatgattcgtgaggagaaaaaaatataggtagagataaaatggagaatactccattttgggacaagttgagaagtgatagaaatagctttagagctaatcaaatgacttgtgacttgtgatttggttaagatgggagaataggtggaaaatagttttattttaggataagtttaagtgatagaaatagttttattttagaacagagagatctaatcaaatgaaaattcagaatttgaatgtttgacgcaattgtactgattcaatggcgtgattctaactcatcaaaagcaataacccatcagatttttttttaaaataatatttcgatttagtgctacttgttgttgggatatcactttccaaattaagccgcaggaattacctttttcttgtaagtaaagaagaaacagagtacacagcagattgacaggtctacagatgtgtatactattgtcagatttatgagatcacaaaatttaaattctgacagttgatcttcttaagagtgacaaaatatcagataattttttttgcaagaaagaaatagagaaaataatctgcacctgcaaagaatattatggtgtggacagtgtggcaagcagtggactgcgtagccgcagcggcagcttgatcacagaatcagctgggaaaacaaccattggcagaatcaggagctctgatctttcagagttgtgacaaactgattttttttaaaaaaaaattgatcacgtcattataaattttgcaattttacaatttggcattactatttgcctatatacatgttgaaattgaaaaatatgacactaacattgaaaactgaaatatcccttggctgtatttttcaatttttgggaccaaaatacccaatcttctccgttcatcctctcatgtacctccagtcatcttctccaccaaaccacccatggctgccccgtgctcgagcgccacagccggccgttccactgctgtacaaattttgaagaatttccatataaacttgttcagctttcacatgaatcgtgtaagaatttcggctgtctaaacgggggcctaatcgatgccgtggcgcgccatgcatgcgccatcacattccggcaggtctgccgcctttcctcgggtcgctgacggcggtgagcatcccgtggaagacgttcccgccgccgtgctgccgacggtcggcggccgagccgaccggcgccagcaagtcctgcacgatgaactggcagacggcgccggagcccgtgctcctcagccggtggcccctccgccgcaggaactccctcgcctcgccgctgagctcgatcacctcgccgccgaccaccgtctcgttctcgtacaccaccacgttcggcaccagctgcattatatataccaccgaccagacagtaattatgagattgatttttgtgcatgtccgttcgaaaagttataaaaaaatttaaaagaatttgtcaagatagatcaatatacaatatatcttttcacaaatatgtgaattaaaattcgacatatacaattcgaaaaaaataaaaataattaccataatgtgttctatttatagtcaaatttgttatttttttttaattgtataagttaaatttgaatttgtattatttgtgaggtgacatattatataacgatctatttctactaatttttttaaatttttttgataactttttaaagcgacatgtaaaagtgagagatatcctaattgagtttcccagtaattaattaattgctgtttattaatcgacgagattaaggtaattaattgatgcatgcgtgcttgccttgtggtagactctgggatgctggacggcggcgagcgggtgcatgccgacgatgaaatggttcacgaacacctgggccgccgtcgcgatgatgttcgtcccgccactgccgccgactactccggcgagctgtccgttctgcacagatagcactgcagtggtcagcatcggcgagctcgtcagcgtcagcgaaatggttagtagttactactatatgcttgcctttagtatgatcgtcggcgtcatggaggagagaggccgttttcccggagcgatgaagttcgccggcgccggcgggaggtggtccggcgtccgctccgccggcacggagaagtcgtccatctcgttgttcagcacgatgcccgtcgacggcgacagcacgtgcgccccgaagtaagagttcaccgtcgtcgtcatcgccaccgcgttccggtcgccgtcgacgacgcagaggtggctcgtcccgtggtcattcagctggctccatctgatcacacaaaaaccaaaatctcatcactaaaactgctctagctaacttctgaaagaaacgttcatttctgagatgagaattactttgggaagtagtaactgggagggaacgtagtgttgtcgacgatccgctgccggattttgtcggcgaacgccggcgagagcatctgggagacgttgccggcgacgttgacgtagtcagggtcgccgagagccatcctgatggccagcatgtgcttcagcgcctcgatgaaccggtgcacgccaagaaaccctttcaagaactcgagcgatttgtatccatccaagatgttcaaaacctgcgattaatcatgtcaagtttgatatggatcgatcgagggatgaacaaataatcgaaattgactgggaatttgatactgaccagagccattccgactgtgccgctggaaggcggcggcatgccgaggaaagtgtatcccatggcgtcggcgcgcatggcgtcgctcacctcgaccttgtacgccctcaggtcgtccaccgtcgcgatgcccccggcgcgccgcacgtcggcgacgaacctctcgccgatggcgccgccgtagaacgcctcgacgccgccgctggcgacggcctcaagcgtgtccgcgagcgccgggttgcggcacacctcgccggcggcgaggatcctcccctgcggcgcgaacacggcgcggaggcccgggtcggcgagcacgtcccgctccgcctccttgagcgcgccggcgacgggcggcaccaccgtgaagccgtcccgcgctagcttgatcgccggcgcgaagaggtccttccacggcagcctgccgtagcgggaccacgcggcgtggaggccggcgagctcgccggggacgcccatggcgagcgcgcccttgtacttggaggtcgggttgcccgcgtacatgtcctgtcagacacaaaaaccaccatttcagcatgtcattttgggaaatcaaatgtaacaatttcctatttttgaattttggctcgaacatcctttttgagtgcctctcagtttgatcgaattaagaacataatttatcttaaattttgagttttaatgctgaaatttggagtccatggtcatgcgaattttcaccaacttcagatggagatttacaaatagaattgaataaaatgtatttctccttttactactatattggagtgttagacttttgtctaatcatagttagcttctatgagctcaatgttgagtgaacaatatttgtaataattggttgtagcatcttttgaagtaacgaccagatgttattttcattatctaaaaaaatatgtatgagcataattaaaatttaattttccactttttaattatgctcttcacaaaaaacatcatacttgaaaatagaaaggtctaaggttgcatttgtatgtgtaacttgcttgagcttttcacctgtacgtaaaactgagaagaggaattagagtataattaattaagtattaattattaaaaaaagtagagagttgattttttttattttttaagaaactttgatgtataaagttttcaaaaaacacattgtttagcctgtttagcagttcaggaaatgcaccaacgaaaaataagaaagttgttgtatagagttgctcaaaagaacgcaacataaataatgaagatgaaccataccatactaaactatttgtatgaaattgtggcgatggaatctacactgttacaccataaacatttccctacatgccaaccaactcgtgaagcatgtgaggagatgaaaatgacaaatctagatcgagtctgaacaaattctgtcttttttattcaacccgaacaactgaacctgtattttattattatctaaaaaatctgaacctttcttcccaactggcaaccgcaatggggtaactggtaggagtatcgcaaagtgcagaaaaaaaaaagaccaatgttgaagcaaccaaatcaattagaccatgctgattgcccatgtgaaacacagtgtcttacagaaaatgaccatttttttgggatcagatcacggatcatgctgtagttgataatgcaatgcacattgcacacttgcacagaggcatgcctctcagtgaaatgaatttgcaatgagctaaaaaaaactcaaagtcaaatgctgattatgtcttctagctatggtgacgttttacacgagacatgccgttcgctaaacaaaatgaaacaatgtggtgtaatacggaaatattagggagggtcagcttagataccgagtgaaccatagttaatcaggagtaaaaaagataagtacagtggtttttgtgcaaactgcaatataaagccattcggaaaagaacaggattgctgattggacttggagaggaacgtcaggtgcctatcatttgcgtaagcaagcgtggcccaccagacagtgacctgtacccaaccagcgcatcgcactaggccgtgggccccacatgtcatgcactcaggattgcagtaaaaaaagttttgctttttctttttttttttaatttttactgcggcgctctagttggtgacgaggagtaacgtactcaccggcgtggccgcggccggcgcggtctcgcgggcgtcgaaggcgacggcgtcgccggaggcggcgtccctggtgacgatgaacgcgccgccgccgacgccgctcgacatcgggtgcaccacgccgaggcagagcgccgccgccacggccgcgtccgccgcgtgcccgccggcgcgcagcgccgcggcgcccacctccgagcacctcccgtcgtccgccgccaccgcgcccaccccggcctccacctcgtgcgggctcagccccacgcccccgccgccgccgccggacaccaccctgctccgatcaccgccttgctccgctccccccgagctcaggagcagcagcacgacgcacgccacggcgagcagcgccacggcgatggcgagcgcggtccacgggcggcggcgccgactgccctgagaagaaaccgggccgccgccgaggagggggttctccaggccgccgcgcgcggccatggctgggtagctgccgccggatagccggagatcctggtggggattccaaggtaggacagagaggggagggatttcttggatagcgacttggcgagagcttgtcgcactgtggtgttgggtggcttgtgtgcttgagacacttggatatttatatttagtgactgtctgtccagctggccaatgattctatagagcttgttctaacttggattgtttctagtactatatttttaacgactcaaagctggagtagtaattacttatcagatggaaattcagaagttgaatgcttgacgcaactgtactgattggatggcaagagtaattctaacacattagagtgaatctggacataccttacgttcagattggtttattttagaacggagggactatggataaaaaaaaatttgaactctgaccattaatctgcttgagtgtcaaaacatcaagttctcaaatgtgtactactagtattatttttgttgcaaggaagaaacagagaaaagaatatgcagatgcaaagaatattgtggcgtggtgtgtgtgagatggtgcagcaaccattggcagaatcaggaaaacagattctttcagagttgtgacggactgatatttattacgtttatttatgcttagaaaacccagcatctgaatatctgataagcaccttggatctccgtctggctatcactattttagcctttaatttcatttccctattttttaataaatgaaacttttattgatctcaaacagttctccgcaaaaaaatattaaaggctaaaatatactacccattacaaaatatagcaacttttagctataaatatacctcatcccacaatataataatttttagctacgaattagacatgccatttgagcggagcgaccaaccaacttggcgaggcgagtgagacgaccagagtcggtgtaatcgcgtctcagcaatttgtcgctgtcaagtgtcaactactccggtccaggggcatgacttgttggtaatccatgcgtctcagcttctctttgctgcaccttctgtcattttctaattaaacggttgatatgtgttattccttaatttatgggttagttattactaacatagtacggagtactccgtaagtagtactagtatttatggtttttgcgaattgcaagcagatttctggatttttcacattttggtccttttaaaaaacttatttcgcaaatagacccctaaaaaaacttattctaaaaatggtcctttttaggcgccagaatagctggctcccccccccccggccgaaattttttatttttgttttatttgtttgatatttttttcacgcttagggacacacaaaaaccaaccatagaaaaattgaactcaaatggacgtaatatgtgacctgtagaatttttccactcctctcctctctctccaaaccagtgcaaaggagagatgtgcaacttttttatttttatttttattttttgatatttttttcacacttaggaactcacaggaatcaaccatgtaaaaaataaactcaaacggacgaaatatgtggcatgtggaattttccaaagttctaccgaaaaacttctcctcgaaaacacaatcttacaagcggaatttggaggttttaatatcgccgaacccggcaaagcggggagaatcggatgtaatattttctgtagatgtccgtgcatatattatttgcctgattccgagttcgtatgagaaagttacgcctattttaatagatgacatattttgtccgtttcgatagagttttggaaaattctacaagtcacatattttgtccgtttgagtttattttttatacggttggttcctatgttctcctaagtgtgaaaaaaatatcaaaaaaatgaaataaaaataaaaaaaattgcatctttatgtactgtttaacttatatatgtcatttcatgtggttatattttgaattagattaagtaatttcatatagtggtagagtgtattatgtttaacatgctgatcaaagggttttactaaaggaattatggtctaattttagtgaaggtgcaaagtagactaagtggtatgctagctattttcagacttagttaagtggtagttcgagtttaaattttttttgtggttggttgtatcgtgatcctaagtgtgaaaaaacatccgaaaaaataaaataaaaatgacaccgttgcaactccatacagagaaacaggaatggaggcggcggcgccagcaggctggcgccctcctcctgccacgtcggttcgcgtgccccacggtggcaggaggacggcgccagcctctctggcgccgtcccgttggatgacggcgccagccactctggcgcccaaaaaaggaccatttctgggataagttttttcaggggtctatttgcgaaataagttttttaaaaggaccaaaatgtgaaaaatccagagcagatttccagtgaacgacaccatggtttttgtaactttttttccttctgcatatatacgtaggttacacgaaggatttgcgacacagaactcaaattctgcgtgaaaattgcgtgccaaacttctagtttttgtttgttcctttctgtatcagactatgttcgttttgggcttgttaccaagctgggtaatgattaatgaaagttgcctgttgtcaaaattaaaaaaaatgcgtgccaaagcaacggtgtggaattgatcaatcgtgcacacaaagtttgcctcaaatgtgaaaagtgcaaacaaagtatggcacagacatctcaggcacaataattgtagccagcagattcgacaagctgcagttgagctaatgatatattgtctccaaccaaaccaaacacctcttcatcgaattattaggatttggccttattagtataattgctcagaatcacagaaattggctcaaagatttaaagtagacgtaagttcagcaatgtatttttttttcctcaccttttctaggcgactggattgttctaacttctgcaatatactccgcaaagaatgttattaggttacaagagggaaataaatgcatgtagagcatgaattatgcaattcctgcgtgagtttggtacccacattgcagagtagcacaagaataatttgtgtactactcttatgttgtagcacatactcaagccatgcctatcctctcaaacctattgtagtgtactgaactattttcatcttgctgtgtgccagcaaaacacctgtaccactggaatgtttcgtgtctgtcctgcacctgaagattagccttcccaactgatcatcaaaattgtgtccgagatcaactacacaaccgtactggccaactgaattaacctgtatttgtaaatgtacatgacattaacaccaattgatcaaggacatatgataagatagagtataaacctttcttttttgccacttaaaaaacatgaactccagaattcaaataagctagtgagcttctttataaaaaggtgtttgtgtgttcatagtacttaccagtaatgacaaaaatgaaatccaatcaggttctgtcacacctactgaaccatgcgcttcctctttgatcttttgcccttctttccggagtaatttggaagtttcttgttgctactggaattgtatctttcctcaggtcctccctgctgtccgttttacatcagtaattgaaatttgttatgattcacacggactattttaaggggaatagtgattttctaagatgactagcttgaactgtctactacacagtgctccagcaggacaaatgaatggtaaaaaaagattgagtacctcttcagtagtctcatcatccgactcttcatcctctgatgttgaggctgaaagatctgaatctcctgcagcaagcgctttgttgccttttctcttgctctcctcttctttcagctgtttaaatctattcaagatatttttgtaaaaatcaaaaccagaatataatagggttaaaagccatgtgaggttcaaaagcacctttcaccaggttgggctggttgagcactcgtacgttttgctcgtcctgcagtaattatcccactacccccctgattgacaacaggctttgctcctcccagtttccgtaaccaaacttgctgggctgtgctgaggatattatttgtgaacctgatagcaaacatggagtcaatacacatattggatttgatcaattgcaagaagttaatgagcagtggaggagtcccacaatctctatgaggcatagcactatagcatggaacatgactgaaacactcatacaactaatagcaaatgcacataccaataaatggacaaccctgacggcactgacaaagagaaccaccctatcataaatggaagaaatttcaaaacaagcagtgtgttcttctgcgatggatcatcagtctgcagaaaaaaaggatcaaattgccagccactcatagcttgtatagtggcaatatgacagatgatatagtaatttagagcaccgctcgtctgctcacctggggtggcttcatgatttccatagagacaaactgagaagcaacaagtagcacaggcaacacaagataacatatcgtgtcatgccagcctaatggaggatggccatcctgcacaattcatttaagttgtaagtatgatttaccatctcaatattatgcaagtacatgagtaatatgctgttttactatcatgtctctacaggactataaattggtatgccacgccatttatttcaaccagagttctaaataataggcaacaaaatgcgaggtgcaaatagctaagcttcttgttgcttgattgcttaaatgactatgggcagaaacgtgacactaatctaacttgacgggtatgtcaaagtcaaataaggggggaaaatgaggttaaattcgctcaagtgcactataaacctgattttcctagatcagcaatgaaattgttgatatatgttaacgtgtgatcaattttattaccacaaaaggcaagagccaagaaatgccagcaccactttgccgagcagcaattgttgtagggcctcccaaagatggaatccagaaaaatccttctgtcagtaatcccttcagagaaatataagccacttagaacaaaatcctcttaatgaagcaaatattaggaagcaggatttgagttttacctcgtttgctacatttgaaagggcttggtagaggccaatccagacaggtattgttgccaaagttggaaaacatcctggaagagaaaccataatatcaaaacactatatcacaaaagcaatctcacttaaaactttaaaaagccaacaattggttttgcaagcacatgatggcaatagatgcattatgtcgagaaatagaaaatatgatcaactaataaataacaaactcatacaaaaaagatgcaatggaacaattcaactatcaaagttaataggctaaagaatggagaagtaagcgacctgccagagggttgactccagcttgcttgtataaccgagcagtctcaagctgtatcctttcctaataagagttatgtaggagtgatagatcagaaatgcccaaagatatgtgcttgaaaatataaaacacaacagtgaaataagaacattttttgggaagatagttctaccttctatcgttaaaatatgcaaaacatatatccagaaacaaacctcagtgttcctactttaatatccatggcgtgcgtaaaagataaacaaaacaaacctgatttcctgcatatctctgttgaattgctttgatctgtggctgtaaattctgcatagccagagttgattcgacctaaaaaaagagaggaaaaacagcacaactctcaacccaccatatccatgttactcattaattaaaaaatagaccagattttatcatttacctgttgtttcgttaaaggtaatgttgcagccttcacaataacagtgagaagaatgatggcgaatccataagagtacggcacatgaacagctgacaggccatccttcagcacctgtatggtgatactcacatagtatcagcattccggagccgatgaatgctatgcaataaaatcctaacagttcttgaattgtaacatttcatatcaaaacctgtggataggaaaatgctaaacaatgcacgcctggtcataactagatataagttacttaaaaataaccatgccgggttgccgtctgctcaatgtttagtaagtttcagagcatggaggcgtcataattaagtgcatgcacatctactcctgcactctccacgaacttacatgactccaaatctccaattccccaaccaattcaccagaccaacttttgcaactcagggatatatccattaaccaatcttagcaatcctgaacctgaactcctaaagtgacttggattcctataggtttgggagaagacggcggcgcttaccttaagcacgacctccaaggcctcggagatgaacccgaaccaccccccgttcttctgcgccaccgacgccgccgcttcaccgccaccaccaccgccaccccctcctcctcccgccgccgcgtccgccgcgacgacagcggcgtcggcgagcgtgtagagcgccgcctcggcgcgctccagcgcggcgtggaggtcgagccccgcgatcgagtcgagcccgtggaggctcgccctcaccctgcacgccgacgcgcggcggcccccgtgcctccgcagcgaaggcagcgtcagcataggcagcctcgcggcggcggcgcggggctgcagcgaggggagcagcgactaggagaggagcgccttggccatcgcggggggtgcgggagggag

SEQ ID NO: 8689 - DNA, 6142 bp, Oryza sativa
  unsure (1)..(6142): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagggtggtgagtggtggtggtgcgagaggaggaagaagaggtagtcgttggaggggaagaggcggaggtgggggatgctttatcttcttcctcctttccgcgctcttttgctgtggactcggtgcacaactccacttcgccacttcatcaaagcggctcactactacagtgtacgtaatactccctctgtcctaaatgaaactaaaactgtatgtaatattttctattataatatagagtctattatgatacattatacttgaaaacgtcccatccaattttatattctaatattttagaataggtagtaatgatttttcgaggttttgacacgaataacgtttccgttccgtgtcgaaacctcgaaaaatttgtaagatggttttcgcctaagcaccggatcctgatccatgtggatataacggtttttgtcaatttttttataacttttcgtttaattttggtcaaattgactgtttcagatttgaaccattctaaatttcagtcataacactatcaaaacctcgaatttttgcggttttcaattggtttttatcgaaaacatgaatcctaatgtctacacttctgttcacttcagttcgattttagtgaaaagcctccttggggacaaaaataaattttgaaggaccttcgtatacaggaattacactgatctatgcagaaaccatttgaaaaaaaaaatgtatttcaaagaaaccccgagtatttcgcaaccaacctttttggcatattttttctttaaacatgcactatattcagattcaacgatgcaatcgtaatttcattacaatcataccctacatatcagttttctgaacgttattatcattttttttctaaacccattttgacaattgggtatagatcgaccaaatgtaaggccccgtttgaaacacgtgaactgtttccctgattcttgtgaatattttgtgtttcaaactttcagaatgtgaaatacaaactgaattgtgcagcattgaacaaagaccgcaccggtaatagtactactttgacagcacggtaacagatggtcaatgtctgctagtaacagcctggtttctgaatgatcggcccgggtgagaagagattgtttgcctgaagaaaatcgagtgtggtcaagggactatctgaagaattcgcgaacattgtatcagtgaaaaattattcaccattcgtcagaaagaaagaaaagcacacgacaaacaatgaaacaaacatcactggggttcagactttcagaacagaagctgtgattgtttcacgaccacacacaaccatcggtctcaagcacattacgctcctttctccatggctacacaaactacagaactcgtgagaagcaggccacggtagcatggctcattgctggccacacgcaagcccgaaaatatcatttgctacagtccaggtgaaaaaaagatctttgcttcaccatagcatccaggaaaggtgcaatttactgtagcaaaaaaaaaaaaaacagaaattttgatcacttcaattcaggattcagcaaacgggttcaccaaacggaattcgcataggagcatatcgatcatgaagttagtacagcaatgggatcgagtttttggtttcagttgaaagcgatccagccagtagtattgtagtacagcacattgaaatgattaagacagcgattacaaacaattgctgaaattgacaacacagttccgaacttctagtcgtaagtagctgtcgacattattatggagtaatgaaccgttgaacttgatcatcagatatatatacagaattttaactttgccatgttccatagaaatcaagatctccaatatagtggtgctagtgtaaaaagtacaggggagaatcaacaaagtggtaacttttttgcctaaatcaccaacactactgagaaaggaatttcagctaaatgtttagcagcaaaatatccatggcatcacttgttactttcctgcatatcatggcatgacacaggaagatctaaagactaaactgttttctgttctatgataaaagaagatcgttttcaccaaggtgtgggggcctcatgcaaacctggacttcatgctcttcgggtccaactcggtgcttggggaccatgatttccagtccagtgccagtctcgtcataatacgcttcgagctttgcatcttctggaatccttgtagccaaaggtatctctctcacaaattctccaggagggcagtgctcagggaaaggatcagtcaacttgaatgtcctgtcatgtctcttaacaaagggcattcgagcagtgctcacacacgatatcttcacaatgccatgtgtcaatgtgttcctccaagagaccttgacactgtgaggatcagagaagagcatgctcaccatgattaagtagccttcatcgtcctcatatattgtcttggcagccgtaacaggtccacttgcatgttttgctacaccagtgaactcatgcatccatgacggctcacctgtgtgaacttctatctcttgctctctgtcagaacaagaattatttgccatcacgcaatcctcatctgcaccatgagcaaagaagtccttccgtcgcttggcgcattttggtgaaaggtccatcccatcgtctgatgatggtggcgtagaaaggttaagacctgaaccattcagtgcctttttgtgactgtgagagccatgtgtaatctttgatgacagtggcagtggcctatcaagttcgaaatcagtgcttggaagattcctccatgattcaaagtcacttgcttcaggaggaattgagaaattaagttctcttcctgtaagttccgcccaccttttcatttcagcttcaggaacagctgacagatttggtgaactcacaatctctatcccatgaaggcattgtgggttggacagccctcgatagtgctttcgttgcatgcggtgtgaccttgcaaagcccttatctgcactgaatggaaaggatggctcaccatgcttggaatgcccattcatgaagctccggagctgcatcttcccgagggcattgtcaggccgttccttaaaaacccacatgtacatgttctccatgtcatgctgcaccaggaagacatcaaggcgaagatcagacttctcaaagcccgaaacgctcccagaagagtcccgtgtcaccttgcccttcggcttttccacaagtgcaggtttgaagtagtgattgaagaagaaccatgcaccccaaatgctgtcccccctcttggcacacttcctcgcaccgacgccaaccgcagtgttgccattgccagtcaactttggaagcgtgagcgcaacctcagactcataagtctgcgtgccgagaccgacatcaagcatgtcgaactggtcgataccccacgacggcggatgcggcggcggtggtggtgaggggtctgcagaaaggggcaggttaatgtccggtggtcctggatgcgcagattcacgccgcggaatgatgaacaattccctgtcaccaccgccaccaccaccaccaccaccggcaccggtgctgccgccacctccaccgccaccggaggagtcacccgaggccgcgtgcgacccggcgggatccatggagaggcgggtgcagggatggctgttggtgatccccagggacagggnggagaggaggggctctcccanggagagctccctcctctccttatccttcgtccttcctattctcacctacttctcttcgcttccacctcttgctcctcctctatctactgcctcttcacctcttgccccatgggaggagaactccatgggagcatcaaggatttcgcatagccttgccccataaaagatggagttttcaacccaccaaatccacccacagatcaagatttgcgatgggggatccttcctttggagcaaaattaagatcttcggagccaatccagcgctgcaagcctagaaaaatccagagacaaaaaaaaagaaaagcaatttatcagacttactaccaaattaacagcatgttgatgcacacatacctcgaaatacagatcaagtaaaaaaaaacacttcctttcgctaaaaaggccactcgatttccccacaatacctcactaaatttcgtcacgaaaacaacaatattttctccaatcaagccgtaccacacctcgaaaatcccattaaacacacaaagaatcctcgctggaaggtggaaacgaagacaaacgaggaagaaagaaagaagaaagagcagctgcccttgctctgatctaacctttgggggaggaagcagcaaggttctagaaggccccttgtcccttcggtgaggagctctcctgaaggttctggaggcttcgcctcgccggagcttctcgccggaagcgaggaggagaggggagagaaggggaggaggggaacaatggaggaagagagagaggagagaggagggcccaaagaaaagcgaaaacaggggtcgcgggtgtcaacgggttacggatccaaaagtcgtttgcgggtcgcagaatgcaaccgtgtccagtaattttagagatattggggtagtgtattggatccagggagttaactttagtccctatatttagacactaatttaaagtattaaatatagattacttacaaaactaattatataaatgaaagctaattcgtgagacaaatattttaagcctaattaatccataattagagattgtttaatgtagcatcacataagctaatcatggattaattaggctcaatagattcgtctcgcgaattagtccaagattatggatgtgttttattaatagtctacgtttaatatttataattagtgtccaaatatccgatgtgataggacttaaaagttttagtgccatctatacagggtctgaactactcccttcttccctaaatctctaaatgttcgacgccgttgacttttttaaacatgtttggccgtttggccgttcgtcttacttaaaaacttttgtgaaatgtgtaaaactatatgtatacataaaagtacatttaacaataaatcaaatgatagaaaaataattaataattacttaatttttttaaataagacgaacggtcaaacatttttaaaaaagtacggcgtcaaacattttaggatggagaaagtatatgccacttttagatgaactatttgccactgtaaccacatgttatagacacatgtggacccacatgtcattgagataggtgtggcaaatagttaattgctaaatctaaaagtggcaaataattaaaagccccgtaattttagcttcccttgggaaggggtttgtatgtaggtgtacttatgttttcgacgaaaaccgatcaaaattcgtgaaattttgatgtttcaacgttgaacgaaagaagatactaattgaaatgccaaaatggtctttcgagaattcaagtttgaaatagtggattcgacccaaattacttgaaatttgtcggaaaccgtaataccgttaggatttggatccgacgctcaatcagagaggtaaaccttgcttgagataatatttgtttgtttggaaacttttttgggaggaggggagcattggggggtttggtttactccacattatttttcttgacgtttaggctacaatggagacccacgatttagcttggttggtgagcaaattcaggtgccagaagctctccttctaatgaactttctttaaaaaaacaattggttggtgcaattatcttgagaggatctttaaaacacatgaattttataatatttttataggatttagctcaaatcatacacaagtcctgtaaaatcactccattcaaaagccaagttttacaatccggtgctatggactcactcaacccacaaaaccgcactcatttagacccacaattgagttaacaatagacaaaaccatagtattaatttgtacaaactcacactatttgggctgcagga

SEQ ID NO: 8690 - DNA, 6752 bp, Oryza sativa
  unsure (1)..(6752): unsure at all n locations
acatgcaatgaagcaaaaaacgatagatattggtctcttactacttcacacatatactctccgttccttaatataagagattttgacattttgcctgtttgactattcatcttatttaaaaaaaattgaaattattatttattttatttgtgatttatttttttatccaaagtactttaagcacaccttttcattttttatatttgtataattttttttaataagacgagtagttaaacgttacaagaaaatagtgaatatcccttatattagggggatagaggtagtatatattctagatattcttctaaaaattcaattcttctctaatgctaagaggatggttggaggtgccgtttccattgtcggaagaagggaccgaggggctgacagagtggtggagataagtctggctagttcttcgaacgggctacagggacgccttcgacttgttgtatatgcttgtttgccgggtgatttagaaagaaaggaacaccaggatcttcgagcacaaaaactacacggcagcacaagtttaaagggctatccgagaggaagtcctggtttagagagaagactgttttcaaacaacgggagtaaagcttcaggaaggtttttttttttttttcgttttcgcttgaggcttttggctctcagctgatcgatccgtctccactgtttaaatttgagttcttctctatctccatttcacatttgtttagcgactgcatacatacttagttacataggatttttgtcaagcacaaaaatagacaattagacagtttaaaaagataacagaagataccatgaatcaatcaaaatatcacacaaatggtgataacacttagagactcaaacaaagaaaaggtaaaacaaacaaacaaataaacaaaatactccagtataattcaccagtcagcatgtcacgcgtaaagtgtaaacagaacagaagataagtatagtgataatagctgttaggatgatgcacacatactgccagttgagaaagcatgtggcatcaatgtaattatggtgccactaactagatggcgaggacaatctggaaaggcaacacggagctgatgagagaaaagtacaccaggcgaaaaagaaaagcatcactttggcaacttttcagcaactggatggactgatgaaagggagaggtggaagaaaggcacagcttaccaactgcagagggcaaaatctaggtatggagagatgcaattggcttattggctccctttcaactgatcttcctctcacttcatgtcatcctttttcagatgagaacagtaactacacatcgacctaaagcaaatgacggtactagtatccttctgggttcttgacaagcacaacatcgaaatataaaagatcacccagagtttaagtacaagaccagtacattttatgttaggaacggagaagctagtcattggtacaacatactattagcaagccattagctgcatccagaaacaacactagataatggataatcggatctacaaagctcatgagcatattatgcaatttttgcttttgagaaggccttcttcctttgggccacaatatagcagaacatcagaacatcaggccatggaaatcctgcagtcattcaaatagaacaacaacatggtgtcttcaatttatcaaattttatgttatatacgctagtatatattataattattagtgtgttatactatacaagctaatttttaggctattaggtgtatgaacaatttttttttacccctgtcatttcgaatatacaagttcaaaaagctaggcccacaatttagaagttcaaaaagctgaacccgccatttagaagttcgggaagcatgcacattcatccatttatccgtttaagtgttaagcagaaaagaacagggccatctgcatactcgtattatataaaaacataaggggcattatttgcatacttctttattgtgagagaacagggggcacaatgccccgataacagatctattgtgtcccaataacagatctacattcttcagacaagatatgatgcttcattgcttttgctgctatacatcggaaggccaatctcatgcaacaaccaactatatctttgacaatctgcaaaggcttaaacattttagcatttggatgattcacgatatcaatgtgacaatgtcagatgcaattggctcctttcattgatccacccctactttcatgaaataatattcagaaacagttacagggcaccaacatgaatcaaatggtgatagtaaccttcttcatccttgaaaagcagaaaatctacacatcattttttggcatcgatacggagtgcaattttatttacatatggaaaagccaaagtttggtacaacacaccattaattagcaaatcatgaaaatggtactcgtgtacatttttatttaccaagggaaaagatagtccatgtatttcggcatttccattctaatacacttttacttatttgctgaagaaacggtagcaacctgagctgtagctgcgagcagaaatcagattagatagctcttcagtagttatgtggttttgcttttgccaaggccttcttccgcagggcgatcaagtagcgaaacaagactggatatactgcactcatccaaatgaaacaacactgcagtgtgttaacaaatcctacttgttttcctttataaaattcctacaactaccttttcttaaaaaaaaaaactaggttatagcatcgattactaaatgaagtacaatcccatggaaatactacctgtggcaaacgaagccatgaaaaagagattggcatagaagtagttgaaggagaaactccatttgtcggatttctcagatgcctgatattgttgagcctgatattgctcatgcaaaagaaaagagcatttaaacaagattcattatgaaatggaggcgttgatcttcctttctaagttattcaagttaccttcatctccatgaaaggaagagcaatgtagattaggacaacctcacaaaccataccaacaggaaagcatactatgaaggtgctgtacctgcaaagaaatcagtacggaagtaacagcaacatatttttaagagaattcgctgatcagataacgagtttcatttgaagtttatgctacatnatatgatttgtttacgactagaaccaacctaagccaaaagagccaggaaggtgtaaatccaaatgactccttcatgccatggaaagaatatctggtaacctgaaggaattaataattcacttcactctccgaagtgaagaaaatttcataatnatttgttcaactaagctcaacacaggaactttaaagttttttttgggaatacgcaaggagcacattttttccattaagagaaataaaggttatttacaatgaaatgaagagcagcaggggactgaaacaggactcaaagtacaaaatcaaaggtttatctctcacggtctgttttggctaccgaagtcccttctgaggatcagagcagggatggctgaattcgcttggcgccagagtgccgtctctgccgccattcccttcacgatgtccacccaggtcctttgttgctgattgaaaacccggccgttgcattctttccaaatcgtccatgccactagcgtgaccaccgtgtcaaaaccccgacgcaatggctctcgaatgatcattcggctgctgcatagccattggtgaaatgagagttcatttactgacagacactcaggatgtccaattgcccccaacgtccaccaccatagctattagctgcctggactccagacaaccaacaagaagaagcgccgactgttttctctgatgaagcttctttgcagattggcgaacaagcatgaaattgtcatggatgcaccgttttttgatgaacgagctctggttctgtgcgaccaaggagttcagaatgggggctagccggcgggagaggatcttcgtaaatagtttcgcaacgctatgcaccagactgatggggtgaaaatccttcaatttcctggcgtcttgtgttttaggcaacaacgtgaggagagccgtgttcacctttccaaaactggacccgtccatgcgatggagctgctgcaacgctgccataacatcctcgcagatgatcaactagcaggtttggtagaattgtcctgtgaaaccatccggccccggcgctttgtcacgcgatgtatcttttacagcaacccacacttcctcatctgagaacggggcttccaactggggtagaggtttccccctctcgactagaaaatcaaggatgagagcaaaggatcttgaaggagaggagtcgagcaaatgcaagaaccagcacggccttctcgtcaggtgaggttgctacctgaccgttgtgttctagttgttggatgaagttgcgccgtcgatgggacgtcgcatgctggtgaaagaagcgtgtacatgttggcatcaccttcctgcagccacgaaatccgagagtgctgacgggccatcgttcgctccaaggaggccagcgcaaggtatttcaactttaagctcttgtgaaagtatctctccgaaggggacagggcaaacattcctctactctatcaaatctgccaatcagttctcttgccatttccatttgcaatttcatatttccgacctttttgtcgctccaactccttagttttttggccgttgttctcagcttgctgtcaagcctgctgatcgggtcggcaatgtggcaaggcaatgaccaggcatcttgtataacctcatggaatttaatccttcaagcgtgcaccaaaaactctcaaagtggaaccgacctcctctagggtgcgaaagggaaggtggatagaaaaagcgggcaatgatccgagaccgtggacgggagagctttaaggaagcattggggaaatacatcctcctagtcggttgtgtagaacaccctgtcaaggcgttccagcgttgggttcaaccaaccattcgaccaggtgaaggagcgaccattcgggtgaagctcatggagagatagatcattgatggccctgcgaaaatgacccatcaaacgcctgtttaagtttgcattgctcttgtcctgatcttggtaaatcaggttaaagtctccgaccaccacccacggtcccgaatggctgcttcggattgatcgtaactctagtaggaaccgcagtttgtcggcctcgagttaccagtaaggaaatagagtgcgagctaccatcaataaaagaaagatgtgcagtaagggagaattctcccatcgtggggctgtcacaactgacgaccgagctgtcccacgcaaatagagaaagtctgatagattagcacttaggaattaattgtgtagcatcaagttcagacacacgaccgaacaacgagcatctacaatcaccgaccgaacagcatcccggtgtgcgcggtcgtttaaacccatgcacattccagacaaggaagttgaagttgaaactcgtcatgggacgcgattgatgcgacctgacaacgaagctctcaagcggcctgcaccacggacgccggcgccatcagcgcgctagctggcctgcgggccccggcaagctgatgtctaagagatggtcgatactgagctcattgtcaaagatctccgtatactgctggagtgcattattggtcggctgtggaggaagaggcggtacatcgtctgcatcaacctcaagctttttcgccaaaaccacctggcaccttgacattaatattgttggagctccatggagtgcttgaaccacctgccgctcactccggcgaggcgtgaagggggtagcaggcatgaccgatgcaggcggcgttggcagcggcgggagaagtggggcagggatcgccttctaatcttggtgcgcctagagaaggtgatcaatggatccggttgcggagagcccggcggggttggcgtcgcagcgacttgatcagggggcgcctcggtggttggcacgtgaacaccaccatgctgggccggctccagtgcgacttgtcatccgagcaggccgcctccaaccgctggcccaaaggaaggaacgaccacttcatgctgggctggttcagaggcctcagccgcttggtccagtagggtgttgggctgtcccgagcccaaatcatcctggactggtgaactgggcctgactgggctaggcacaaccactggagaaaggcgatctggcccggcccagaccgcatctcccttggaagccttagcctcgactagggatggcaattgtgcccatttgcccgtttacctgtgggtaaaaaccctattagggttgggtttgttctccattttatacccgtgggtatcttattgggtcaaaagttatgcccgatgggtaaatgggcatgggtataggtaatcactacccatgcccgctttgcccgtttacccgcgaaatctaacttacatgtaggctaggagcaaaatccactagaatatataagccacgttctttgttttctacggtttcccttttattccccttattatttctctccccttactctatcgccgccagaggagagacccgacaccgaggcggagaatatttgatgttttaagttcgattcgaacttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8691 - DNA, 25716 bp, Oryza sativa
  unsure (1)..(25716): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggccaaaataagtgaaactatatatttacaaacgaaaaataatttatgaataaaatttttatatacgttttcttaactatctaaaaacaaatactgaaaaataaactttgataagaaaacgttaaaatcagctctaaatttaaggctgaaaattcaaattctagctgataagtataaacttaagcgaaaagatgagactcttagaatatccttgtggcaggaacaagattgtgtgaagattggagggagcattatgaggttgttaaaacgttagatatgaaaaggctttcatatcgatgtgtagtaagagaggagtgagtgttcgctgggaatcggcgcgcaccaccgcagaccctgcccactgcactaggcgcgattctcacgtgtatactttacatgttttaaacaattttttcctacaaaatttatttgatctacaattcagttacaccatcatatttggtacaagtaaatcttatatataggctgttacaccatccataattcgattacaggatgtcacatgattatatattttttaaaaaaaatatatccgtacttaaaaaatatataccatatactccctccgtcccataatgtaaggaattttgagtatttgcttccactatttgaccacttgtcttattcaaaaaattttggaattattatttatttttttgtgacttactttattatccaaagtactttaagcacaacttttcattttttatatttgcataaattttttgaataagatgagtggtcaaacactagaagcaaaaacttaaaatcccttatattatgggacggagggagtatgaaatatcaagttaaaacgaatgaaacattataaaaatacttcctgaaacatccagagaagctttgttcggaagttggttactgccggctggcagcagcagcttgaacaatatttttgctgctgattcagttgttgcaggcttgtagtacagcgttgtggctgcacaggaattgttgccgaacacaggccactatatacaattttcacaaataaaactagtgaaacatcgtaaaatacttattgaaacatccaaataataccatcagaaatatttaaaaagattcattgcaacgtaaaacttaaatgtgcaacggaattgaattttggttgaaacattgtttccaatacgcaaaacatcaattttcactaattgaaacatatgtattttatatgaaatcttgatgtagagttttaattataacgaatagaacaatataatcgaatcacatatttgataaataatttagaagaaaaatcattttgaagattgctaggtaaacaattaatgcatattacatgaaatatgcatactcctttatggagagacagtgaatgagcactttccgtggagaggaaagaataaagaacaactcgcgtacaatgtttttccctttgcattcccccaattattttggttgttcaggagcggacactgtgtaggttataggaattcacccaaacttttttctcttgaaaagaaatactatatgtaaatactagaagatataatgatactgcataagtaaatactttgctgggcctaatacctcgttcttaggcctaatactctgctgggcctcctcccgactcaccggcccaataactgcccaggacgcttcctccctaatcgtcatctcctcccggtccccgtcccccgatccccaatcattcctcccctgacgccgcgccgcaactcgccgccactccccgtcgccgccgccgccgcttgtcgaagctggtttgggggattcggggatttgacggattagaggtgactgaactctcgctctcctgctgaaatcataccgtatttttgtgatgatttatggggaggaacctaggttttgatgagagaggcgaacactgatttgattcatccaacgcgttatattcacatcctaacatccagcctttgcgcctacgcatcaggaatcgcagtcgcagatggaggccatggacgacatggcggctctgacggaggacatcctcctccagatcttctcccgcgtgggcagcatcaaggacctcttcaagttcgccgtgacatgccggcggtggctgcgccgcttcaccgacccggccttcctccgcgggctgtgcctggacagcggcgagggccaccgcgcgcgcctcctcggcttcttcttccagcagacgagattctatcgctgcgaaaagatgatcaagatgcgggtgacgcagcagagctcggtctgtccgcccaccttcctgccggcgccgtggtcgccgctcggcctcacggatcgcaccctcacctccttcctcgccgccgacgacgacaccttcaactacgccgagcccctcgcagcgcgctgcggcattgtcctgatgcggcttgtcccccgcaccgcgctgatgatagcgtgcagccacctcctcggcgtctgcaacccgatcaccggggaatgccacgttctcccgcctctgaatctctccggcctccatcgctacttgaccagctacgccatcatcacgtccaccgacagcgacctagatgggaagcagccgccatcatcatcatcgtcagggcgctccacgttctcgcagctgtacctcgtcgtccaacacaagaaagactgtaacgagtacttctactcctactctgctgctacgtgcagctggagcgctcccaccatgtgcgtggacggccgccgcttctccctggtgggtgagagatccgccgtcgttcacaagggcgcggcgcactggctgtttattgatcgtgtatctagcgcaacccaagatgacatactgtacaaactcaccgcggcggtggacacctcagaaatctccttgacaaggctcccctttggtgctggaggctcaccgctcctctgcgtcagtggagacggcaaactttcggtcgcttgcgtgtttcccatccacatgagagtttggactcagcaagatgacacccctgcaacgtggctccgcactgtgatcaggataccattggcggtgccttacccagactattcccatatatgtcagccccgcgagaagtggtttaacttcaacaggggatcaatgctcgtgctgtacaggagcaacggcgtcttcatcctcgacctcgagaagaaggtgatggaaaaggtcatggactgcttactgcccctattcagtgataaactgaacaggacggctgtggcgtatgagatggacttggttgagttctttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtagcacggcattgtcattttgatatggtttgacctttactggtttccactgtaacatcccttcactggaaaaacaaattctcttgatcttacagttcacaactacgcaggtggcatttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaaatgtgagagtttgcgtgctcagtgatgtcctgaagagtatgtgtaacacaaagatgcataacagaagactagttatgatcacgccgttgccaaaggttatcatcaagttccttgtatgttgtccactatgacttattttggtgtatccctactttttaatctctagatataaaactatggccaatatattgatagaacacagctgtaactaaatgttgcgtttctgactgcaggatacatatggaaattgagtttgttggtgatcacagttacaggtctggtaagatagttattgagtttaacgattgaacaaggtgtctggaaataccaccaggtgcttcaatctttgagcaagatttttctgcgctctccattgttttgtgttgtgtttgtttgcagtctgaaccatgaaagaggaaggagaaagaatgtgagaggaaatgttcttggatttttctctagcagagagatttatcttgtacgacaataaatgtttgctgaattcttagtgtcatctcaaaattcgatttgtctaaacaggaaaaactgacctattaatcaaaatatatagagtttaccctgtttttaattattattttcttcttatttacatgctgtttatggttacagactccatggcaaaaagcccaaaacctgaacccaaagaaagaacagcccaccaccacagcgctccaaaaacggggcccactgcacatttttctttgcaacgtcagcgatccgcacggaaacgcatcgcagccgtctaaccgaaaaggcaccggacgtcacacattcatccacgtcatcgatccgcgggacaagcctctccaccaatcagcgcccacttttacccactataaactcaccgcacccgtgtcctccttccacaccgcaatctcgcaacacatcagcacacaccgctccaaagcaaaacccacggacccgcttcccctccccgagaagaagagagaagcatccatggcgcccaaggcggagaagaagccggccgcgaagaagcccgcggaggaggagcccgcggcagagaaggccgagaaggcccccgcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggttcaccccgacatcggcatctcctccaaggccatgtccatcatgaactccttcatcaacgacatcttcgagaagctcgccggggagtccgccaagctcgcccgctacaacaagaagcccaccatcacctcccgggagattcagacctccgtccgcctcgtcctccccggcgagctcgccaagcacgccgtctccgagggcacgaaggccgtcaccaagtttacttccgcttaggctgcatgccttcctctagtttgttagtagtagtagtagcagtagattgatctgtttatgtggtagtttaagtggaaatgatgattgcaaatgaagaattgtgcggggcttcttttggggaactcactgatctggaatagtaatgctttttatgtcatgtgaacatatctctggttgccaattgattttttgttttgtagaattgattacatcgttgatgtttgcatcgtcttgaaaatactctgcttgtgactggaatatgattttcggaacatctgtctgtactccctctcccaaaatttgaactggaaatttagctaggactccatttttggtactgctcaagtacccattggctcaatgtattttgtaggtttgatggaagggaagcttgatggccattttggttcatgatgttgcatttggaacataaaaactgtgtactattttgagctgataactttgaaatctgaaagtaagttttgcttcagcttcatttggtactgtttcaaatcgaaatatagaagttgaaatagtaactgaaacgccatatgtcttcgcttactgtttcaggagaatgctgttctctttactccttcctgttctgaatgtccgaatgggtgctttttctttgttactgattcgcttgtatgctagtaactgggaaacatgaggtatgcatctcatctctactgccacatcttctatcatgcttgctgttgtggtgcctgcagccctgcagtacataccatgcctgaaaaatgtgaccaaactcttgtgggttctacttgtaaattgtaatgttatcctttctattctctgtccagcatggttgtttgaggtgtactcaggttctactggaagattctcttgtagcagcatttttggcacgctcatataaaagcttcggtagctactgtggaatgtgatagaaataatgggtctgatgtttttgggaactctccttcatttctatttggttaactgtttgagcatttaagcgtttatctttttcgatagcataaattgttatggatttgatattctgtgtttaatctgtataattgcaatatttgttgctgtgtcgtatatgttgaatctgagtcagggagttagaaattctgcaactatggatgtgtaggaattggcaatgaaatcttactcacattgtgtaagaagccaaaactctcgtacttctacatcgtgcaatcaacattattgcattctgtatgcatctcttacactgacatgcatctaagcttaatataatgctataacaccttgtgtacctctgattatttcccaatgcaatcatcaactctacatgtggacctcacgtcctcacccaacatttagctcaagtactttactgttcatttcttaaccacctgagacagaagatattcatctctgattgcatgcatctttgacacagcatctgctaacaacattcgatctttggcttgttgctttgagcaggatatgccaagtctaaggacagaaaccaagcagtcttgaacaatacttcgtgttatgcttgcatctgttatatctttattttttgcttcttcatgtagccagattgttcgatcagctatatctaggactcggccaggaaatgctgctgatgcaaatttgtgcagatccaccgaatccttgaacatgtcatcagtagggctccttccggtaaatatctcaagcaataatatgcctaagctgtaaatatcacctagtctggagactgcagaaccttctccgtactctgcaatattttcaatttcagttaatatttaagtatacctctaaatgacataaatttccaattcggaatggcccaagttgatcccccacccattagggtggagggagactaggaagtgggaataaaggcagaatgcaatatttggaactacctggtggaatataaccaatggaacctctgattccaactatgctgtctgaatgttgcagtgctttaactatactttcagggaggattcttgatatgccgaaatctccaaccttagcgctcatgtcttctgcaagaagaatattacttggtttcaggtcgcaatggatgatcggtggctgacaatggttgtgaagataatccagtgcatccaagatatcaactgcaatgccgagtctctgcgaaaggctcagtgtgttgctagaagtgggattgcctgacacgggatgaagccaaccatctaagcttccattgggcatgtactcaaaaactaatgccttgaactcgtgaccctgtggattgatacttgagcaacaggtgatgatctttataagacaacgatgtcgtactcttctcaaagcctcacattcaacctcaaaactcttggcagatcctgattgtcgaaggttgaacacttttacagccacaattgcaccttcatcttctaaagtacatctatagacggaaccataacttcctttgccaagcaaattagcttctgaaaattcattacttcctctggctaatgcataatatgaaactctatgatagtgttcatcagtacctgggattgttgctcgactattttgtctccgtttaagcttcctgcagaactgaattagaacagtagctgaaactaacagcaagattgatcctgttattggcagggcgattttaagagacttatgccaccgtttgttgtttttgcttgcatcaataatgggacatggagccaagtgaagctgaggtattccaccacacaagttgtcgttccctgcaaccgatgcgtacgtaaggttcttgaaaactccctcatctggtacttctccttgcaaattattgaatgacacatctaatttccacaacattgtcaaattttgcagagttgctgggatgggtcctgaaaaattgttctgtgctagaaatagttgttgcagattgccaatcctaccaatggtatcggggatcctaccagataacttattcatggttaggttcaggatgttgagccctttcaggttggtcaaagattgaggtatgccgccttcaaatgagtttttatctagcagtagcgattccagcacctgacaatttcctatactgtcaggtatttgaccagacaactggtttcccgacagtatcaactggtttaggttagccaaggtagcaacttctattggaaggggtccagagagagaattgtatgacaagtccaagtaccaagagagtgaaggaagctccaagatttcctttgggattgacccattaagacggttggtcgataagtccagaacaaataacgtttttagcttcccaaggcttgcagggattggcccttccaaattggtgtagtatgcgtagagcctattcaaatttgtaagatttccaattgatgatggtatgaggcctgacaagctggtgttgtacagggcaacttcaaccaaatttgatagcttcccgatgctcgctggaatcactccagataaggaagtgaaccccagatccagcgtgtccaagccaatcaaattgccaatgtcctcaggtatgctcccagagatgctattattatctaagtagagcttatggagtgtggtcgacaagttgacaacagagtttggaagttgcccgctgaaagagttgtctgagataacaagctgttgcagctgactgcagttggttagtgaagtgataaattcccaacccttcctgttatttgcctcaagtcggttgccatacaagtataatcgccgaagagatttcaaccttcccacagtaggaggcacaaatccactgaatctattaccataaaggagcacaattgtgagtgatgaaagattgaagagagaagaaggtattactccactgaattggttatccgccaatccaaagtattgtatgccagggaacttgtcaccgatgttggcaggaatgcttccttgtagcatgttgtcatttgctgcaagcaccgtcagtgttgacaggttccacagagaggacggaaatatgccggagagactgttctgctgaaaactaaattcacgtagagctgcagctttgccgaggtccagcgggatcaggccctccaggttgttgttgtccatgtacagatactgaagcaatgacaggttcgctagcgatgccggaattggcccagtgaagctgttgttttgcagctgcagcttctggagttgtgtcaatgtgttgcccagctccaccgggatgcggccgccaagctggttaaaggcgaggcccagattcttcatgctgatgcaggaactcagattggcagggagctcaccggaaaacgagttgcctccaatgtccaggatctctagacgccggaggcggccaaggctcgggggaatttctccatacagctcgtttgagctcaagtttaggctctgcaagaagctgaggttcccgatgaccggagggagcccgccggcgagattgccggagggcagcgtcagcgccgccacccgcgccggcgtccgacggtcgcacgtgacgccctcccagctgcagaaactggtgctgctgttccaggaggcgagcgcacttgagctgctccccctgaacgctgccttgaaggcaagcaacgtggcctcatcgctgctgctgctgctgccaccaccagcgacggctgcaacgatcggcgtcaggatgaggacgagggataattcaagcctcaggctcatcatgatcgtcatgggacgtattgtgtttcttgattggtttgtgagagtggtagtgctatatcttagtaccaatggctgtccgtattatatggagagtatagatggtctttgaagcaaatttggagatgatgacagtttgttgattgcattcttttaattccttttttccatttctggaacacttcgtttgactttataatatagtactccctttgtttgtttgttctaaataccttccgttcaggatatgtatctggacaaccatatctagatgcatatcttacatccattatttatggacggaatagtacttgtcctgatacatcattcatactactaatattgctttggtcacttgtttttttttccctaaaaaattacaaatatttttaaaaaaatcatcattaccagtttaccacgagctgcttttgctcatcttagcattaacatttagttaataaaactactactgtcaaagctaaaacagtgctaaatcaagctaaaacagtgctaaatcaacaagaccgttctaaatcaacaaaggtcttggaccgaagtggcgaaagcaatggcgaaggagaccatgctttggaagtcggcttattaagggatccccgctgtttcgtctttacgaggtcgtggtagccaaatttagcacgagatattcctctagtttttcataatgtcctttatcggtccctgcttgttttccttttatccttataaataacttttatttctcttaatgaaaaaaatacgccccttgcgtattaaaaaaaatccacaatgaaaagtatttcgtgaacgagggaatatatacatttcgaacggtcaacgcggccaggtgcatgttgttagtattttcgttgagtcggagagaattgactttcagaacacggcgatttaggcggctaggcgatcgacggaaggcttgcatgatcaacgcactgttacataagcctacttgcagatggagatgggtttaggctagctgcctgcttgaagacgacgacgtcgttgtcgtctcactgggatgttgacgtgggcagattaccgaatacgtagcctaacaagtcgtggagtggctttcagagcaaagaaataggcccaattagcccataaacaaagacagcccgccaagaagcctgacaactaaattgggctggactgggctgtaggcgtacgccgaaggaaagctcaaactctaaaaattcgcccaccgacgcgcgccggaaaccgccttaactcctcccgttcccgctcacatttttcggcatcccaccaacccgtcgaccccggcatccaacgtcgtacatccctccacgtcatcgatccgcgccgcgtgctttccaccaatcaggttgcacatcccctcctctacaaaatcatctccccccgtctcctcctttccccacgccgcaatctcgcaaatcccaccgcttccctttcctctcctctccccgagaagaagagggcggcatccatggcgcccaaggcggagaagaagccggcggcgaagaagcccgcggaggaggagcccgcggcggagaaggccgagaaggccccggcggggaagaagcccaaggcggagaagcgcctccccgccggcaagggcgagaagggcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaatgatatcttcgagaagctcgccggagagtccgccaagctcgcgcgctacaacaagaagcccaccatcacctcccgggagatccagaccgccgtccgcctcgtcctccccggcgagctcgccaagcacgccgtctccgagggcaccaaggccgttaccaagttcacttcctcctaggctgtacgcctgcatctagtcctagtagtaatagtagtttttatatgtttatgtggtatattgtttaagtgatatccaagattggaaatggatgttaaattgttggtttggtagtcattggctgtaagaagaatggctttgggttgcttttgggaaacacttgcttcacggatcgggcataagtaaccatgcttttataacatgcgaatgtgtgctttctcttgtgccatcattgataagaatttaccttgtgccagtgttggtgatgccttcgtttaatgttgtggaattacatggttgctagtattttgtctcgtaaatttcttttcatgtcattggaatttgatttctgcagcatgtacattggtgttaggtactgctcttttgcgtgtgcctcttttgcgtgtgcctcatgtattgtttagagattttagaagcacacactttgggacaataccaaattgtttttagcctgacaagaaatttagtttcgtgctgtctgcatttgaaacaaaaagtttgtacacattgtttggtgcactagtacatgatataatctgtcctccattgctgttttattctgagattagaacttcgacaagtaagtttttcttcagcttttgtcaggtactgattttcaaagaaatatagcgacaaggaaatggtaactgaaacatcacattacaattattgatttttaagattatgttgtgcccgcatgttttctcattccgttctgaatttctgagtgctgctagcttatgagctaactgttaggtatgcatcttataccaaagttttcagtcaggctattgctctattcaagatatgcattgccttaaggcatatgtgttaagattagaccaaactcttgttgattctacttattgtaataatgtgtcttgtcctttgattcactctccagttaggtgattctccctccagcgaagttggaggtgaataagttacatccaaggttctacgtggaatattgtcctgaatttcggttgggcttgttccataatacattcgctgtcaaataactctaatttttatgacagcataaggattaatatggatgtatcataatttttactcatggaataatttcagttgctattatgaatttgcagtggttggaataacatgcccatattttgagagcaaatcccttggttctatctggttattggtttgagcacttgttcttttcttttcagacaacatgaattattattgatttggtattcagtgttagatctatttagatgcaacctatgttgatgctatgtttatgtgggtgggaatcgtggaactttgttttcttatggttgcaagggtatccctatcaggtaggactgtaggagtagttggttatattttttttattatggatcatggatgcgtagaagtttctgttggaagttgctaccatggtttcgtgtgtaagaagccatatggtcagctcttcagtattatttgatcagcatgattacattgacattctgtatacgtctttgcaatgacatgcatctgagctttatttgataaatataaatcatgcagccttgtattccaacgattatttctagtacaattaattgacactacatacatgtcttatccaacatttagttcaatgccaaccatccaagacctgagatattcatctctgatggcatgaatctctgatacagcatctgctaagagcactcggtctctgggttgttgctttgagcaggatatgccaagcctaagaacagccactaaacactgttgaataattcttctttttgtgcttgcatttgtcacatctgtctcatttgcttcttcatgcagccagattgtctgatcagctgtctaaggctctatcaagaaaagaagctgcaataaacttgtgcaaatccattgaatccctgaaaatgtcatcatagggcttcttccggtgaacatctcgagcaacaatattcctaaactgtaagtatcacccgctctggttactgcagaaccctccccatattctacaagatatgcagtcaaaattagtttctaactgtaccattagcatgtaagatatacaaagtgcacaatccgaccccacccatgagggaggaggtgggaggacttgtgggaataaatacaaaaataaaacttttaactacctggtgcaatatagccaatggagcctctgattccaattgagctttttgaattttgaagagttttagttgtgctgtttgggaggatttttgatatacctaaatctccaacttttgcactcttgtcttctgcaagaagaatattacttggtttcaggtcacaatggacgattggtggctgacagtggttgtgaagataatccagtgcatccaagatatcaacagcaatgctgagtctctgcggaaggctgagtgtattgctagtgagattgcttgacttgggatgatttcagccatccaagctaccattgggcatgaactcaaacaccagtgccttgaactcttgaccctgttggtcaatactcgaacaacaagtgatgatctttatgagacaacgatggcgtactcttctcaaagcctcacattcagcctcaaagctccttgaagatcctgacatttgaaggttgaacattttcacagccgtggttacacttgcaccctcatcttctaaagcacatctattaacagaaccataatcttcctttgccaagcaggttagcctctgagaattcattacttcctcttgataatgcatggtacgaagctctgatattgttcatcaataattagggatgtcgctcggctattttgtcttcatttgagcttccggtggagtaaacaatagaagcacaacaactgaaactaataccaagactgctcccgttgttgttagagccagtgtaagagacttaggccaccgattctttttctttcttacatcaaggattgggcatggagccaagtgaagctgaggcattccgctgcacaacttgtcatccccagcaattgatgcataagtcaagttcctgaaaacaccccattgagcatgtttccgatgttagaaggaatggtgccattgaacatgtttatatccaccgtgagcatgatcagtgatgacagattatacagcgacaccgggagtttgccggagaggtagtttctgttgaagagaagataccttaaacctgcgatgctgccgatgcctggcgggatcatcccctccaggtggttgccgttgatggcaatgcctgaagcggcgacaggttggctagcgacgcaggaattgaccctatgaaggtgttgttcgccagcgcgagcgtgggagccgtgtcagcgtgttgccaagctcaccgggaatgcggtcgccgagctggttgtattgaaggtacacggttgtcaatctgacgcaggtggtgaggttggtggggaactcgccggagaaggcgttgtggtccatgtcgagcacccggagtcgccggagccggctgacgctctgggggatctcgctgtggagatcgttggagctcaggttgagccgccggaggaaggtgaggtttccgatggctggtgagagcgtgccggcgagatcgctggacggcaggtccagcgccaccacggacgtcggcctccgccggtgactgcacgtgacgccctcccagctgcagaagctgttggcgctgctgttccatgaccatgaagcggcgctgccaacctgccggagctagccaccagcgcagccgccgctgcgtgtgatagagatcctaacctgcagaggtcatcaggctacggaggaccagagcggggggctggagatccaccccactgtgtgcaccgccatctcctcctattcttcattggtgatttctgcaggaccagcaccacaaccatcgtgtaatcaaatagcgcatccacccaaaccaaataaatcaaggtacaagcctgctctgattccagtgcatttgattaacactaacgtttctgtttgcaatgctgaaccaagcaacatctatgttagttgatcctatgtctgtgtgggagcctgagaactttggtgcctcatagctgcatcggtatctatatcagatagatggaaattttgctagtaaatatggttcatggttgcataggaatgtgttgaaatctgctagtaccatatatggtttcatgtgtttttctgaagtaaaaactacagcagttcaatattatttaacaaaccgattacattctctgtgtacatatcgagaaatttgatcaaattcctcgtatgtattttacaacggctaactgggtccttgttatggctttcaatagaagccgggtcttttgaccttctctaaaaaaaaaaatctgggaccttgtttacctccgattattccaggcaaaatgattgacactacatatgtatattatctagcatttagctctagtgctctattgctcgttgcccaaccacccgggacttgaaatattcatctctgatcgcatggatctttgacacggcatctgctaacaccattcgctctctgggttgttgctttgagcaggatatgccgagcccaaagagagacaccaaactctgttgaataattcctcttgtcatgcttgcatctgtagcatctgtataatttgtttcatgcagccagattgtttgatcagctatttccagggctctgtcaggaaaagcagcggtagcaaattcgtgcagattaagcgaatccttgaacatgtcatcagtagggcttgttcccgtaaacatctcaagcaatattatgcctaagctgtaaatgtcacctagtttggaggcagcagaaccttcaccgtactctgcaatatttgcaacacacacagttaaactttaagtgtaccttcaagacaaaaaaaaatacgaatacccctaattctacttctatctattagaagaggagggaaatgaaggaaataaggacagaattacaattttttttagctacctggagcaatatagccaatagaacctctgattccaattgagctttttgaatttagatgaattttagttatgcttttggggaggatttttgatatgccaaaatctccaaccttagcattcatgtcttctgcaaggagaatattgcttggcttcatatcacaatggatgattgatggctgacagtggttatggagataatccattgcttcaaagatatcaataacaatgttgagtctctgtgaaaagctgagtgtgttgctaggactgcatttgctcgatttgggatgaatccaaccatccaagctaccattaggcatgaactccaaaaccagtgccttgaactcctgaccctgtggatcaatactcgagcaacaagtgatgatctttatgaggcagcggtggcgtactcttctcaaagcctcacattcagcctcaaagctctttgaagatcctaattgttgaaggtcgaacacttttacggccactagtgcatcctcattgtctaaagtacatctataaacagaaccatatcttcctttgccgagcaggttggcttctgaaaaatcattacttcctcttgacaatgcataatatgaaaccctttgatactgttcctcaataaccagtgatgttgcttgtctgttttgtcttcgtttgagcttcctgttgtgtaacagaataagaacaataactgaaaccaacaccaacattgcacctgttgttggcagggctattgcaagagactttagatgctggttcttgttcttgcttacatcaagaatgggacatggaggcaagtgaagctggggtattccaccgcacaagttatcattccccacaaccgatgaaaaggtcaggtttctgaaaacacctttaactggtacttccccttgcaaattgttgaacgacacatctaattgcttcaatagtgtaaaattttgtagggctgctggtattggtcctgaaaaattgttatgtgctagacacaggtattgcagattgccaatgttactaatggcattggggatcctaccagataacttgttcacggttaggtttagtacgttgagccctttcagattggtcaaagattgaggcatgtctcctccgaatgagttattatctagcaagaggaattccaacacttcacaatttcctatactgtttggtatttggccagaaagctggtttcctgacagaattaactggtttaggttagctaaagtaccaacttctgatggaaggtgtccagagagggagttgtatgacaggtccaagatccaagctagagaaggcagctctagaatttccctgggaattgaaccgtttaggcgattgaatgacaaatccagattaaacagattttttagcctcccaatggttgctggaattggcccttccaaattggtgtggaatgcaagcagcctattcagtttggtaagatttccaatggttgacggtatgaggcctgacagaccagtgttgtatagggcaaggtcaaccaagtttgttagcttcccaatactttctggaattactccagatatgggattgaaccccaggtcgagtaatctcaagccaatcaaattgctaatgtcgtgagggatggtcccagagaagctgttattctctaaatcgagcatctgtaacgtcattgacagattcacaatcgatcttggcagctgcccaccaaagaagttgtgagagagcatcaattcttgcagctggctgcagtttgctagagaagttacaaattccgaaccctttccgttatctgcctcaagctggtttgttccgatgtatagatacttaagagaatgcaacatccccaaggtgggaggcacaaatccagtgaagttgttatctgcgaggtacaaatctgtgagccttgaaagattggacagagaagatggtatggccccatgaaaacgattctcatgcaatccaaagaagcgcatggcaggaaacttgtcaccaatgttggcaggaatgctcccttgtagcatgttgagccctactccgatcaccctcagtgccgacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagacgtatcgccatgtggatttttatttggtaagcgtctttggagcaaagtttagtttcaggctggagatatatcgctgctttctgattccatttttccccccggcccccttgttgtaagagttcacttgacctcattgacttcaagtcaccgggcaggaccagtgtaattgtagtactaggagcagtgtgttccacttccacctacttccttcttgtgataaaaaaaccaatctaatatgggatgttccgattcgttgcaatagaatgtgttatatccagttttatatatatatatatatatatatatatatatatatatatatatatatatatatatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttccacactgtttcacggtccaagagctagctatccacatcgtcttcaccgagttacctcgccgggattgctcgccatgccgtgaagagggccgacgtccgtggttttcgtcaccgacgacgttcgtccacaagcctcttgctggaaaccagaactcctcaaccatttttgtcaagccattacagcgcctgatgtccaagtgccttttcgctgccgtcgctggttgttcgtgagcttcggaacagacattattcaccagcgagctgcattacctgaaaggtatggatctcagtgtttatcactcacacatcttacattcacatgcagtccctgttatgtatagatgatttgccattcctcttctttttatctactaaactgagcacatgatgaatcacctggaacctaaatttatagattttttgttgaaatgcagttgaatttagattgttttaggtatataacatgcccgttcgaatatctttaattgcatccagtgaataaaatttaggtaggtagtgaaacagcagcaatgtctcttttacgtggacatctcaattataatctttgtaaatatagatttaattaattttaaattgaagtatatgacccgaagagaatcatattgcttgttttaataatggtagtttttaatagcatgccgcggcttccaaagtgtgcgagcgtgagaagaaatgtgaagcgtcgttccattcatgatgatgatgactttgtcactccacctacaaggaagaaggctgttcgtgttaaattcgtggcaccggtttcgcgttgtgtaccatcttccatcacacctatcatacagagatttagtgctgaaaagaaagagctggtagctgagatgggttttgaggggctgctgcatatgcccctcataacaaaccatcgtgacttcagctactggcttttgtcacgggtatccccaacacgttcggctatcgaactagaaagtggtgaggttttgccactgtctcctgaggatgttaagaaggtgcttgggattccttgcgtaggggaggagctgcaagcacccaatgttgagtttgtttctcatgtcaagaggttaattgctgaaagaatgaaagttgctagttttaaggacgttaacaaggaggtattggaggatgtattagataaacaccatagagggcaaatgtcaaaggctgagaaagaaagtttcaaaacagcattcctaatgcttgttatgatgaaatttcttgcgccacaatcaaatatggacaataaatgtccaagatatttttctgcactacttgaccccaatgaaatagcaaagttcaattggtctgggtatgtgttgaacgagatattggacgcagcggcaactgttcaaaagaagcacgctgatggcactaaatgtggttatatcactggttgctctatttatttgcaggtatatagactttttcccaatgcagtacatacactaaatgttataattatataatgatagtgagtacactaataaaatttttcatgcaaaggtccattatttggataacgtggactttggaggtgatctaaacttggagcataatatatttcctcgaattgcattatatgatcgtgatacaataaaggaaagatatcagctggacatcagcgaaaggaactattaccaggcaacacagtttggaaaattaaaggtactttacaaaaaaataattcatagtttatattgttctaacccttcacatgtctgatatacttgcactttatatcgatccagctacggcccaaaaatgaagtctgctacaaaagaacgtgcgaaagaacatctgtcactgacagcgggggaaatgaaaatgttcagattgagtctcaggtaagttattaaaaaaatttctaccaaacatgtttatttagtaaatatctagagatataaacttttaatatcaacatgcaacacagcatgctgctgaattaatacagaaggcccaagaattgaaaagtttttggatttcctgcattggcaaccttgataaggcaacagagagtctagttaaggtgacagaagcttcgaagaacatgcccagcgtgaccataccaatcagcgatgaagttgatgtttctaaaggttatacatgcacaactgtcaacgatgatgctgagaatggaatagaggtcaaccaaacaccatctttaggaaatgatgtagaagatgtgagtgcagctgctgccaattgtacaccgatggttcatactcacaacttgaaagaagaatcaatcgacttgaatcgcactgttccacacaggacttatactggtctggacttcgatcctccatcatttgatctaaatattgactactcaccatcaaataacacaggttattttcctacacgtatatgtttgctgcctgattttcatgtttcacatagtaagtacccttattgttcctttttttttccatggctggttgtgcatgctgacagtgaggcgagagaatcatggagtaagttgtcattcaaagttcaggtagacaaagatgaagaagattacaaatgtgtttgcaagtgtttgagcacatgggcatactgtgttgccacgttatcaaggtacgccagctttattttggtccttgtacttacatttttttacctctagagcatgcctctttcttcttaaattgttttacccatctaccataaatttgggtaagcgtatatgttgataagttaattcttgattcgattcatattctgtcagctttaatccagtgtatacatctgtagaaaaccatagttaccctaaaaaaaattagttttgatgtataagcagtttagtttatcatttccgtttttcattgttcatgtaggtaatgacacacataggctgcagaagcatcccagataagtacattctaagaagatggagtattagtgccagagaaggatctggcagcaaccttgagagcttcaggaatgacaaagatgctgcctcttccaggacacaccgccacacactgctctaccatgcatgtatagacttgtccaaacaaggtgacatatcggttgatgctttccaccttgctatgaaacatataactgacgcactggatgagattaaactagtggccggtaccaacgaatctcccatggggtacactgatcccccaaatgatgaacctgctggaccggatcaaggaggtgaacaaaatgaagaccccgcggctcatcaggccgtacaaagcttgccactgccacctgatcgtcgggcaaagcgtggccgacctaggtccaccaggctgaagtccccagtagatggtggagtccgaaaaaagcgcatttgttcgaactgtcatctgaaggggcactatagaactggatgccccacaaatccggagaacacatcgaagaacaaagtgatcaaggtgtgcacgaaatgcaagttagctggtcactatgcatcaacgtgtggtgttggtgtatagaagcaagtctatcgttgtttttaaatacaatcttgtaaaaatattcccatatcttgcgtgttgcacttggacaagtttttaattaaattcggatatgttttctatttcataattatgtcattcatcttgtgggatatacatgtatacgtgttcgctctgtcactcataaacctatgtgtacatgtacacctgtaaaagtacagattatgtcattaatcttgtggtattcagacgtgcattttttcactctctctctatcccgttgactatggccaattagtaccgaaatcactcgttggttactaaattaatcaattgatacccaattctgactggatcgatccatgttgacggtaacaaattatattatgtaacctatcggtcgtaatagctataaatattaccataaataagatctttatacttggtaatgatattaattttttcattccttccaacggagacacaattgcaacatataaagagcagaacaatacgactctgctcacttctggtgctctctctggttctcgccaacaacacatttctgttccaggtatggctccaacttatctg

SEQ ID NO: 8692 - DNA, 26572 bp, Oryza sativa
atatatttttggttcacgttcagctccagttctggatttgtcactcctgctcttaacattttccacttgtttttttttcgtaggagatagatacagaccgtaaagatgtcaagagggaggtggaggctcctaagttgatcatttctcgtcatagtgatgataaattctcatcctagtgatgagaaatgtgactcgcccaccgtctgaatagcaaacatgaggcaacatgcaagtaccagccgaaaatcaactctctgatggtgtgatatggttgccagccatcggtcaaataagcagccattcggtgtttttacatttatgaatcacaatcgtactgtaataataaactagttacatctatatttatagatcgtttttactttaattagcatatgtttcatttatattatgctaaactcctatgatatgtggatgagccaattcaccgatattttgtttcctttcagacttcacttaagagatctactctttcaattcagcatattaaacttctaaaagcgcatctaaaacactgtggaaagaaattgaatttaatctaaatcggcacatatggaaaaacatggtggaaatataatacacagtacacacatttaaattttagatatacttaaaatccatggtacaaaaatatacttggatttatttatattaaattttaattttagatatacttaaaatccatggtacaaaaatatacttggatttatttatattaaattttacatccggacgtaacgacttaaaatatacttgcttccaaatttaattaggaaataatgtactgtcagcctaggtaggcgagttttaaattctaataatctacagtacacagatttgaaatatagatatacttagaaaccatggtatttctatttacaacaatataagatgacaatcaattaacatataccgtgtacacaaattgtaaatttatatacgcttggattcataatataattaaattaacgtaatttaaaactttgtatacttaacaagttagctaagtatatagaaaaaataacccgtgtatacatagccattacattacataaatgagtaaacattttctgaatctggaaattgcaaaacgcactaatttagctaggtgtacataagcataccatatacttagcctccatatatacttatattccaattacatcgtccatggtgtacttagggtacctcggtttccttatataattattttcaaaataacagcaggataacatttccatatatactacatcgtagaagtatacttagattttcatataccctaataaaccgcattatatttgttgccaaataaaccgcaaatccatgattatggtgacaaatatttagaaaccaaataacggccgtgaactgttgatggaaaggtattaaatacgctaaattaatactcctaaatattttgcatgcatgcacacgctgtcaattaccaaacctaggtattaaagacgttactaaatattttgcatgcatgcacacgctgtcaatttccaaatcaaatgtacttaacgggtgaacccgttaatcaaatatacatgtaccgatcaactagatgagaatgtgatccaacggcagatgtcagtggtgcccgggcaccatggagtcctatctgggcgtcctatatatatatatatatatatatattccatcaaatgcaagtggtcagtcaagtgccagcatatgccgtcccgtgagaatcattgccgacagacaagatgtagcgtgcattgcagtgattgtggcgacaaagaaaggggttcacggggacgatgagtaagacatggtggcaaaattaaggtccgttcttttcttcgataagagttaaatgaagattaaaatttttgtggcacgttttttaaactgttaaacgatacgtttcgtgcgaaaactttctatatgaaagttgctttaaaatatcacattaatctatttttcaagtttgtaataattaaaactcaatcaatcatacgttaataccacatcgttttgcgtaaaaaacttaaatcttcattttcatattcaggataaaagaacaccacttaagctcacataagttttatttatcaattatcaggggcatgtctgaagagcagggtttcacttattgcgctgattatcacgcttaccgcggggtacggtaggggaaattggcgattgatttggatggattttgaccaaattcaaacttttggagaaaaaatgaaaaaaaaacatggatgtagttcttgatttataattgccaatggtgaagattttttaaaaaatagagtaaactaaattcaaatttgagggtaaaataaaaaatagtttacaaattgaaaaaaggaagacaatattgggccttaagtatcctacatattctttcaattattctcaatttctagttttctacacatattcaaccgtattttttattttttccctatttatttttcatttacatgatttcaactatacagaccgcaataaccgtgcaaatatcgcggttatcacggtaaaccgtgcggtaaccgcggtgaaaccgcgaaactgccgagttttgaattcgaatttttgaatgtgatttctgtacgattttagacaattatcgcggttatcgtgctaccgcgaggtggcggtaacctcggcccaaactctgttgaagatctttatttatcggcagaaataccttcttaagtgacagcttctaagcataaaccactacaatgacgtgcatctaagctttatttaagataaaataatgaatagtatcaactaagcaaccttgtattcctccaattattcctggtacaatcatgaacactacatatgtatcttgcgcaacgcttagctcacagtgctatgttcttcatggccaagcatccaagacctgagatattcatctctgatacagcttctgataacactattcgttctctggttgttgctttgagcacgatgtgccgagcctaaaaacagacaccaagcactgttgaataattattgttttatgcttgtgtgtttaacatctgaatcattttcttcttcttgcagccagattgttggatcagctattctagggggaattgagatcaatcccagccctttatttattgatccaatggtccaaattgtgagctacagtaaaattagagctgtacattttcttcttcatgcagctagattgttggatcagctattctagggggaattgagatctagtgcagttacacaatcccaaccctttatttattgatccaatggtttaaattgtgagatacagtaaaattagagctgcacattttttcattaaaaaacgctacactaatttgctacagtactaaagaggcatctaggccatccgttttaaatccaatgatactcttgtgactgcttaacttgacagtggccactgcactggaaccgaatccgtctaggggtcggtcaagaacacaagctacaacaaacttgtgcagatccattgaatccctgaaaatgtcattcgggtgaacatctcaagcaataatatacctaagctgtaagtatcacccaccttcgtgactacagaaccttccccgtactctgcaacatttgtagccaaaattagtatttaaccctaccctcaacatgtaaaaaatgaagcaccctcagtctgataggaaggggagagattaagggaataattgcccggacacctctcggtttgaccgccgcccattgtctggtctgaccggccactcagtgctgcactgttcactgacagaaaatattaattactatattttcaataaacactcgcatttaataattgctcatcacaaaaattgaccatcacatgattctagaggtgtgactccatctaatttgggaaaaaaagaaatagaggttcatgcgactggttcaattgctttatgctgtgataatgctattgacaaacaacaggtgttataccattttagcgattcaccgtggaaggccggacggttgatgaggtcatacgctaagacattaacatgtttgtatagactttagagcaaaaagaaatagtagtagctcgattagcccagaaacaagtaaacaggccactctcgtgggcctcgaatcgggaatagcccagtttccaagcctgcgacttttactgggccatgagctaaactctacgaaagaaagcccaactgcccaaccatgaaaactcgtaatccccgcgcgcgcgacggaaaccgcctactcctcccgttcccgcgtacactttccgcgccgaaacgcatctcagccgtccataggaaaacaacaccaatcgtgcgccacatgctcctccacgtcatcgatccgcggcgcaccccctccgccaatcagcgcccacctctcccctcctttaataccatcgccgccgcctccccttcaactccacaactcgcaaccgaattcccccaaattttcgtctcccctttcccttccccgagaagaagagagcggcatccatggcgcccaaggcggagaagaagccggcggcgaagaagcccgcggaggaggagcccgcggcggagaaggccgagaaggccctggcggggaagaagcccaaggcggagaagcgtctccccgccggcaaggccgagaagagcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaacgacatcttcgagaagctcgccggggagtccgccaagctcgcgcgctacaacaagaagcccaccatcacctcacgggagatccagacctccgtccgcctcgtcctccccggcgagctcgccaagcacgccgtctccgagggcaccaaggctgtgaccaagttcacctccgcttagattccatctattggtagtatttagttctgtctactatctggtagtggtagaaatggatgtcttattagtgtgtagttggcggttgtggcgctgcttttggtaaactgttgcttatttatctgagatattaacgatgctcttctagacttctatgtgcttcctgttttgtgattgctcgatttcttgtttgtggtgttcattctgtttgagattactacgatactgtgaaattttctggaacaaaattgatgttctggtatgcatacgtagcaactgaggacatggcaactcacttcaggaataatgctgctcctggcttgtttggtgttctacacttttactcatgcgttttatgtgtggacacaaacacaattgcttgaattggatagattcttgctgtttgctagttggtactagtggaagttggcgcttttgtactttgaactaacaatgtaaggtgaattttgggaaggaaccagtacagtaggagctctaccatttcaatcaagcaggaagaaggaaacaatgaaattaagcacgaaggaaacaattaggtgaattttacattaaattgtatgattctgatactctggcaaagaaatatagctctcagaagtgagaacaattgctaactgaaacactacatgtgactaaagttatttcaggattatttccaatgagcttggctattgtagctgttttcggtgtctcagtggaggcttttccttctgttctagtaatacctatgcaagctaattggcaaacatgaggtatacatctcttagtgcatgcatctctactgctacatctcttattgatgctcgctcttgaggctgttgctttgtgcaggatatgcctaacatgaagacagaaacgagacactcctggattctgctctgtataatgttatcccgtggttctacatgcagccagattgttgagtctgctatctccgaagttatgtctggaagagcatccttggtaaacttattcagatctaatgaatctctgaacacgtcatccgttggactctttcctgtaaacatctcaagcagtaatattccgagactatagaagtatagatatcaccaagagttgatatccagtacagctgtacaggcccaacatccagccgcgtttcggcctgcagcggcgaccttcacagcttgttttgcaactcgagggaagaggattgggagtttacacgagagaattgatggtgagattaagatgagaattttgatttttaatcaccagatttcaccctcctatacaatgcaatacatctactagatgcaatcgcggaggcctttgcacgtacgtacgtgcacacacccatggcggacaacgacatcatggcggcattgccggaggacgtcctcctccaggtcctctcccgcgtgggcaacgtcaagagcctcttcatgctggccgcaacatgccgccgcttcaccgatcgcgccttcctccgcgacctctggggcggccagcgcgccggcgacctcctcggcttcttcttccaccggcaacgcaactcggcctcgacattcggcttcctgccggcgccgccgcttcgcccccatcccctccagctacgacggcgagcccctgacggcgcgccgcggcatcctcctgatgcggctttccccctccaacgactggtcagaggcgaccagccacctcctcggcctcttcaaccctatcaccagcgagcaccacgttctcccgcatctgaagggcccctccaaccttggttccttcgccgtcaccagctgcgccatcatcttctccgacgacctcgccgggaagcagcagccgccatcttcaggccgcttcatgttctcgcagctgctcgtcaccaccaagcacaagagcatcaagaccgtgtacctccactcgtactccgccacgcgcagcagctgggccgcgcccgccgtgttcctggatctccgccgcttctccctggtgggcgagggatcatcgtcatccgccgtcgtccaccgcggcgcggcgcactggctgtgcaccgaccacgtcgcgagcgccacccgagacgactacctgtacaagagctcagcgtggaggtgggcggcacagccacggccacgccgcgcgtctccatgacgaagctccccgtcctcgacggcggcacgccgacgccgctgctctgcgtcggcggagacggcgagctcaccatcgtctgcgtgttcatcatgcacgtcagagtctggaagcagcagcgacgcggcgatggcgatggcgacggtgcggcggcgtggcgccgcgacgtgatttggatgccaacggaggtgtccaactaccccaaaagttacacgatggcgcatggattgggacgcaggggatcggtggccatgatgtacagtagcaccggcgctgtgttcgtcctcgacctcgacaagaaggtgatggagaaggccatggactgcttgctgcccctgcgaatggaccattcactggatcggccgcctgtgccgtacgagatggacttggtggagttctttctgctccagcttggtggtctatggctctatgcagcagaggtgatctacaggataatcaattaattaattgattgattgattacacatgtttatggccccgcgaaaattactcatgttatgcagtagaaaaacgagggttaattgtagaataggggtatgtgcgggaaaaaaaagtaagttttgatttaaggacaacagcatattattatcattgataaattcttcaagtgttattaaggtttggtaattggtgtcaccttttttttttccttttttttttgactgtctgatcctttgttcagcaatttttgttcattaacaatatggcattgtgcattatccaccctgatttatggtctggtcgtttgctcgttgcttacgcacaacctgatgaggtgagcgtgaccgtccgccggaaatgcgggattttataaggctcacgcagaatatgaaagttggccatgtcgaagggtataggaggaagaggtttcatttttctccctcacccatcttcctcgattctaaagatatggctagagtgaggtttagtgtcggttgttagaattgggttatgatcttttggacaaccttggctgtagtttcttcgttggcttagcgacggccgatctagtgatagttttctcttgggtttgtgtgttggtgggtgggtggtggttattttttcttcgtttttctagttacgatatcccagggttataattttataatttttttctactttattaagggcctatttggttctctaccctaccaattaattggtagtgctaaaatctagacaacttttagcactaccaattttttggtagggtaaagttagctagtctatgtttggtttaataccaatataaagctaaaatttagtatgagagtgaagaagattttagaatatagccaaattgagcgtaggcgctatcaattgtttggcttcaatctaaactagcacgtttactattaaaaaattttggtagggtctcaatccaaaacagccctaatattgaacttcgcagctcgatatttggtgatggcggtaggtatttagcgcgaaacccattaagccactggcccatctacgcgtcgtctccagaaacggcccaattttcatttcctaggcccaacatccagccatgtttcggcatgcttcgtcgaaccccccaccccccaaccacccccacccacacacactccccactacgctacgattcatattcagaaaagactttctcatctactagatgcaatcgcgggagatcatctaacgcctttgcacgtacgtacgtgcgcacacccatggcggacgacggcggcatcatcgcggcattgccggaggacgtcctcctccaggtcctctcccgcgtggccagcgtcaagagcctcttcatgctcgccgccacatgccgccgctggctgcgccgcttcaccgaccgcgccttcctcctcgacctctggggcggccagcgcgccggcgacctcctcggcttcttcttccacctgcagcgcatcaaggtctcgacattcggcttcctgccggtgccgagctcgccgctccgccccctcgcctcctccggctcctccaactccgtccagccactggcggcgcgccgcggcgtcctcctgatgcggcttcccatcacccgcctcctcttcctctccaaccccgtcaccggcgagcgccacgtggtcccgcgcctggaggagtactctgaccttggtccctacaaggtcaccagctacgccatcgtcgtctccgacgacctcgctgggaagccgcagcagccggcatcgtcaggccgcttcacgttctcgcagctgctcgtcaccaccaagcacgcgaacagcatcaccatgtacgtcaactcgtactccgccgccggcggctgggccgcgcccgccgagttcctggatctcctccgcttctcgctggcgggcagatcgacgccatccgccgtcgttcaccgcggcgcggcgcactggctgtgcaccgacgacgtcgcgagcgccacccgaggcgaccgcctgtacaagctcagcgtggaggtgggcgtgccggccgcagccacgccgcgcgtctccatgacgaatctccccgtccgcgccggcggcgcgacggccacgctgctctgcgtcggcggggacggcgagctcaccatcgcctgcgtgttccccatgcacgtcagaatctggaagcagcagcgacgcggcgatggcgacgacgatgcggcggcgtggcgccgcgacgtgatgtggatgacattgccggcgccttacccatactgcgtgccgctgatgcatggcttggacatgggatcggtggccatgatgtacaggagcagcggcgccgtgttcgtcgtcgacctcgacaagaaggtgatcgacagggccatggactgcttcctgcccctgcgaattggccgcgagatggatctgccgcctgtgccgtacgagatggacttggtggagttctttctgctccagcttggtggcctatgtggaggagggtctacatctacaggatgattacacatgttatgcagtggtaaaataatgagtaatataagcaccagcatatgaattgaaatgcatggaccatatgcaggaaagtttttgattgataaattcttcaagtgttgttatggtttggtaattggtaaaacagctcgaaacctgttctttccgtcccacaaaaacgtggcgcaatctcataatctgattttcatgtgtgattacaggtatgatttgaattttcattttgtacgaaaaggatgaacagtcaaaaatctttctgacagttctccacatagtagtattgccgtattggttgtaatgtacacatcggcagttactgaacgttctattagcttacattacatatagccatatgaactgacgcaaataaagactgactgatatgaaccacgaaggaaaatgctacatcttcagcgtctcagcttttgtttctcggaattctggcaagtcgccatcggcagctgagctgttaaaacattttccccagcaagcatatcttattcttgtacactcttcaggcctagttactcactgttgcttcaaatcgctgctaatttgtttcgtctcctcttccatgtccactgaaagagagccagaaaacatcaggtaagcgtcgtctctgatcgcatgcatcttcagggctgcatcttgtattggcattcgctctttgggttgatgctttgagcaggacaagccgaggccaatgactgaaatcaaacactcttgcattctgcttcttgtgatgctatcctcggcgtctacatgcacccagagcgtcggatcggctatctccaggattctgtcaggatgagcagcctctgagaaactgtgcaggtccaaggaatctctgaacatatcgtctgttgggctcattcctgtaaacatctcaagcagcaatatgcccagactataaacatcgccaagagttgagaccgcagagccttccccatactctacaaatattttggagttcattagattcaccggaatgttaaatttgtgtaagaactaggaggtaaaaagcaaagaaacaaagcataacaattcagttacctggagcaacatagccaatggaacctcttattccgattgtgttgcttgaattttgctgtgttttgctcgcgctttcagttaggattcttgatatgccgaaatctccaactcgggcactcatgtcttctgcaagaaggatgttgcttggcttgagatcacaatgaacgatcggcggctggcagtggatatgaagatattccagagcatccacaatatcaacagcaatgtccagcctttgagttaggctcaaagtattgtcagcaatgggcatatcagattttggatgaagccaaccatttaagctgccattgggcataaactcaaaaactagtgccttgaaatcttgaccttggttatttatgcttgaacagcaagtgatgatctttaggagacaacggtggcgcacacttctcagtgcgtcgcattctgccagaaaacttctagtagatccagaccgttcaaggttaaacacctttacagcgacaacaatttcctcatcaaacaaagtgcatttatagactacaccatagcttccttttccaagcaaactgttctgtgaaaatcccttggttccatttgacaattcctggtaagaaactctttcaaattgttcctccacaactggggttagggactggcccttcttcctatgtacaggctttctacgacgaattaacataataatcaccataactagagctaagaacaagaccacagctattgatgccagagctattttaagagaccttaaccaccctttgcttctctttctaacagcatgcatggagcatggaggtaagttaagatgagatattcccccacaaagctcactgtttccagctaaagacaagtaagataagttcttaaaaataccttcttttggcacttcaccttgcagatcattgaaggatagatccagcattgataacgatgtcaaattctgcagcactgctgggataggcccagacaagttgttatacgctagatacaactcttgcaggttgtggatgctaccaagggcatcaggaatcacaccagaaaacttgttcatggttaggttaagtacacggagccccttaatgtcccccagaaacacaggtatagttccttggaacgagttactgtccaataaaagtacagtgagcactatgcaattttttatactacttggtatctggccagacaattggtttcctgacagaatcaactcgttgaggctagtcaaactcccaacttcagaaggaaggggtccagagagggagttgtatgataaattcaagtactgtgaaatggaaggcagctccaatatttcctttggaatcgaaccattgaagtgatttcttgataaatcaagaacattcaggcttttcagcttaccaagattcgctgggattggtccttccaagttgttgccttgcatgaatagcttcatcagattggtaaggtttcctacagaagacggtacatggccagacaagctattgttattcaggtatagcgtagtcaagttttccagcttcccaatgctctctggaattacacctgatatgtcagtactaaacaggtataatgatcttagaccaaccaaattaccgaaatcagaggggatgcttccagaaatcctactgccacccaagtaaagtttttggagagtcttcgagaggtttgcgatcgaaatagggaactgcccagtgaaattgttgttactgagaactaaaatctctagcttactgcagtttgtcaatgactcaacaaattcccacccctttatgtcccctgcttcaagcatattaacacctagttgcagattctgcagagcattcaacctccctagattatgtggcacaaacccactaaatccgttcattgatagctgcagactcgtgaggttagtgagattggagaacgaggagggaatttccccgctgaactggttgttgaacactgcgaaagactgtaaatgaggaaacttttcatcgatatcagtagcaatgcttccatccagcttgttgtttcctgcatcaaaccccattagcgacgacagattgtacagggaagacgggagtgcaccactcaggttgttggagcagatgtcgaggaagtaaaggcgcggcatgttgctgccgaattcaggaggtattgtgccctcgagactgttcatcctgaggctgaggtatcccagggacgtcagattggccagtgaagctggccaatggccgacgaagctgttgttgtcgaggcctagcacctggagctgtgtcagcgtgttgccgagctccgaaggtatgtgcccggcgagcttgttgctgccgagggccaggtattccaagctggtgcaggatgtcagattgctggggacctcgccggagaaggtgttgaagcttaggtcgagttccctgaggcggtgcagctgaccgaggctcgcggggatgccaccgtgcagccagttgtaactcaggtcaagtttccgcaacgacgtcaggttgccgacggccggcgacagggtccccgagagatcatggccgggcaggctaagcgccaccacccgcccgtgccggccacacgccacgccctcccagctgcacggcccggcgctgccgttccacgacgcaagcacgccgttgccaccaccgttgcccaccgccacggccttgaaagcgagcaacgctgcggcgtcttctccgtctgctcctcgcactgccatgaagtgcaagaagatggacatgaagacggacagcagcagcagcaggaagctagcaagagccatcgccatggtggttgcaaacttgcaaggtacacaagtggagtgacaagcagtgccccagagcaccgtattttaaccccacgacgccatgatcccagagtgccattggcgagacggcgaggacaccgagtcaaaatcttgacttgtttagcggtctccgcgctcacagggagagagacaggagtggtaagataccatgtcgacttggagcagtgcatgttacctttttgactgttcccgccattcctttccacatcatttcccaactagatacttactgtaacatagtactggaaggatatggaaagcttggacgcatccaagctctcgtcgctgtcgccctcggccctcacacatgacttagctcgctccaattatgtcctcaccccttctctgttcgaccaaattcctgataatttcttcctgactgattccaacagagaatccattaggttggcagtccagagtgttaccttgtacagttgtacggccacccttttccacgcttgtatgcggagttccagacacacgaggaaaggtaaaagtcttgtggtgatccaggattagattcagcttgtgtagagcttccgtgaaagcatggacaactacagttgacgagcacaaaaacgaacaacaccgagcctcctgggaacaacgagaaatcgagaattacagcaggcacggccatgtctttccacatatgtacaaacttgaaaaggtccgtggcgtggaaaatttatggagattaaccaattggatgctcaccttagtcaaagggccagggacagtaagctcctcggaggagttctgtcgaacaggtaacgggcgcagactgagaactccgagtctctggagaattgttgtggctacagcgacgggagtctcgaagaagaaaaagtatacaggattgggcatcgtacgcgtcggagctgagcacggcttccagtgacggcgcattccggcggcggcggcgaggcggtgcccggaggtgagcacgagaccccggcggaagcgcgcgcgtgagcgatctgtccaacagtgaatggaccttgcggtggattagcattttggtgggcccacaataccagaaggaggcccacaagaaggttagcgcgcagcccatgatttgcaacgggctacaaccaagagagatacatttgggcccgtgtaaaggcccaaactattcgaggcaagcacgagatatggcccattatctgacaggctgagcaacaaagttgctcacttgctccccgtcgccgccgcttcaccgaacacttctcctctccgtcgtcctccatctccatcgccggtgaacgagttgacgcgatcttctgctcaggcgaagaacgtttatctgtctagccggtcaaggggaacgcagcttttcctgccgttttcctcacgcgatcgaccgcgctggcacgcagcagcgagatcatatcggtgatatgatatccaagtccagatccagtgactcaggctgtgtttagatccaaattttggatccaaacttcagtccttttctatcacatcaacctatcatacacacataacttttcagtcacattatcttcaatttcaaccaaaatccaaactttgcgctgaaataaacacagcctcatctaccatcctttcctccgaactgtcgtgttcctaatagtaatgtgtccataatagtgggtgtgtttagttcacactaaaattgaaagtttggttgaaattgaaatgatgtgacggaaacattggaaggttgtgtgtgtaggaaagctttgatgtgatggaaaagttagaagttttaaaaaaaactttggaactaaacacggcgaaaatttcttattagtccatttcaccagcaaattattgagcttcgttggttgggattgggaaattattgagcttcgcttgttgggattgggtagggaagaatgccattttcttctcttttttatggccttttgaatcgcaggattgaaaaaacggaggaataggaaaaacacaagattttgataggaatgaaagtgtaaaacagaggattgcaaaacacaggaaaaatataggaatgaccgtttgattagaccgcaagagcaggaatcagacgagagagatagactcaaggaaagttttccaagaggtcaaagtggatgttaactttcctacatttttgctctagaattgtaggaatagaaaagtttcctacgtttttccttttcttattccgacgaatcaacgacatgaatagtgtaggatttcaattcctttatttttcctccaattcaaagggggccttattttcgattacacgacagtggcacagtgcacatcggccaaatacgcctcctagcataagctcaaaaaaaaaaaaggaaagacaatggccctttcttaactcgctaaaatcctaatgagaacatattttcatgtgcataatattcataaacatcaggatttaggggtttggttggcatacccacattgtcaaaacttgccatacttcatttagctaacatatgcttaacatgtggccaacaaaattgaagccacacttcagccataggaaagcaagcctaccacacttttacgtgccaatgacatatgacccacattatgataaatgaatcttgccataagtgtggcacaaaccaaacagatgcctaacttaatcaaatttggctaactttagttgtgatatggtgaggtaaatcagttgatgatttcctcagctcttttcgactgtgacaataagagcgtcccgtcatccttggtgcgaacgcaactaggcaaattttcagatgccaaattaatctcaccccccccccccccccccccaaaacacacacacacacacacaaaagaacctatcgaggtccagtactccagtctgaaaattggactatgaaaaagaagaaaaagatatactttacatgctatgtagagtaatagcatactttgaaaaagtcacctctcttagtagttgtgctgatgcttgatgacgccattaggtccgaattatttgctgctatgtagagtaatagattgtgctgcggcagatgtttgtaaattagcagtgtataatataccttccattgtttaggttcctgcacatcaaatgaacaaaatcctaaagagcagctacaatttgcacaatcatcagttaattcagtaacagtccaaaacgttatttcagttaattttttttcccttcaattttgaggtttaccagtttgactataaaacctgatgcaaacaaggtgacaagaaaaggggggagtatgtcaggataccacatccatgtatcaagaaagatctaaaaataatgagaccaacgcatggatctctgttacttggatcaacataactgatggaacatctaattccaattgaactgattgcaaagttttgcttgtattttcagaaagaatttttgacacgctgaatccccaacatgtgtgctcatgtccactgaacaataatgttgcttggcttcagatcacagtggatgattggtagctgacagtggtggtaaagatactccagtgcatctgtggcgtcaacagtaatgccctgtctctgagctagacagagggtattgcctggagtcttgacacatttctgatgcaattacccaatttaccatgaggcatatacttaagactgctaggccagtgctgttgaatcattgaccttggaagtcaatgcttgagcaaaaagtgactatctttattaagtaacagcggcacaccctactcaatgcctcacattcagccatgaaactcctagaatatccaacaaattgacatcttcacagctgcataaacctgggctagctggacattcttaggctagatttggtcagcccataaacctaagcccccaactggagtataatctattgatgaactatttacgaacatggaatagtcttgaaattggatccaattttagattcttcctggtaagaggttcttccgtagcaggttcatctttcttcatacgtattgcttttaccaatagcttcgtccttgggtctggtgtcatccctctcgactccatcgttctataataatgcaaagcctcatccagtttatcgtgggaatggagtccatgaaccattatagtaaatgatcgttgatccgggcctgatccattcctctccatttcatcccatactagctgaacccctttctcataatcccaactgacataaaggttcaatattaagttatatgtatcagagtccagtctgcaaccagacttctccattctctgcatcaatgaaataacatctttgggtttctctgtcgtcttcagaatgtaggagtatgtcatattgtttggagagacgcccttaacctccatgtcatccaaaagctcatagactttctccatccgattaatcttacagaagtgttttatcaaagtgttgtaggtagcaacatcggcctgacaaccacgatcattcatctcaccaaaaatctcaagtgcttctggaatccttttcttgaagcacaattgatcgatgatacaattacaaattgccacatcaggattgatccctttctcccacatgcttgtaaatagttttactgcagtactaagtttgccagattttgtaagcgaatttatgaatgtaccataggtgaacaggtcaggcttaagcttagacgcaattatctcattccaaacccttttagcgtctgccaagcttcccttgacacaccaaccattaagaatgatgttccagctctttatgacaggagggaactcatctttcttttggagaaagagggcctctgcttcctcaacatgcttgtaccgacagagagacatcaaaagtatctggaatccaaccaagtcaagctcaaacccataatccttcctcttgtagaacatatctatcgcctcctgcaccttgtgcgcgcctgcataccggtttaacaggacagcaaacatcctgtttgtgaccactgactggcggctctccacaggaatctcatcaaacagttgtctcatgagcctgaccttcttcatcctcccaagaatgtcaagcatctccgtgtaggcccttgacccatggttatactggggcagaccagctgcccatttgaagaaagatagtgcgactttccaattggacctctgcttctggagcacctttagcacaacatcctcatccatctcgtctgcaaattgattgagaacttcggcgagctcactgtcgccatctctagacttgaggattttaacgatttcgctgacatggacatccttggaaccatccaaagcggtagaatgacaaagccgtagagatccaacaacgcagtgaattgggagaatgctctggtgaaagcgtggatataagcctgccccgggaagctccactgaggcattctgacgaacagttggcgtgcaggaaccaaggaagccgagcctcctaataactacgcatgaacaaagtttaaattagtaccccgcacttaaattcagagaacgaaacctcgttccacttcagtatatgcattcaaattcagataatgaaacagtgcgcggtgtgatggactcatcaagagatgatgaaaaaaatcagaaggggccaagagaaaaagaaaaaaaaaagaagaaggggagtcggtgcaggtggtgcctaccgaagagcgtcctgctggacctgcaggcggcggagaggatggcggacgcccgcggcggcggcatcgtaccggagatgagcacgagagcggcggagggaacgggtaccagagcgctctctctctctctccggtcgatgactaaatgggctactaataactaagttaagcgaagctattgggccgacttgaaagcccactatgtgttgaatgggttgtggccgacgtgcgggcccgtcatgtaaggctgggcttgtgatggacacaagcgaggcccacaatgtgcgtgtccggcctacattgaggcccaaaatattcggagcaatcatacagtccggcccagatagcaacagatatagaggcctgatataacctgcaacagaagtacagaactaaccaaacagcttttaacgtttcagcatgctgcaaatctgaaccaaccaaaatacaaacttaaattagtaagagtacccccactttgaggaacttagcccctctcttctaaacacccccttagtcgtgatggaaagattgattaactcaacaatttatttgttatagaaaaaaacaattaatttcgcatttcaaagagcgtagcaggtagtagcagctaatcttgcattgaaataaattacactttttaaaattacatctatataattcagttttaagagcaggtgagctgagtggagcagctcgaagcctcgaatagtttgaaatatactgagcactccacttcacttgacgaactgagctgaagtgtcaccgctcacctgctctcccgccaaatcctctcaacccaaaagccattgagctgagctgcctccttgtatatatccatggatccacctcgatctctgccatggcgttcccctccctctccgtctccggcattctcgcgcgccacccggtgctcttctacgcggccacctggacggccgtcgccaccgccgcggtgtccgtggccgcgttcgcgccggagctcgccttcgtctgggctgtcacgccgggcgccgcgccgctggcgtcgtcgacggccggctgcccgggcggcatcgtcctgccgctcgacgggccgccgtgggacgccgcctgcgtgcccgccgcgctgttcggcagggtcaccctcgacgtgctcgtgccgcccgtgttcgccgccgcggtggtgtccaccgctctctggttcaccaaggccgtcggcgtgtgggaggacgacgacgacgaagacgacagcgacgaagctacaatggtgtgactgagtgatgctgtaattttgtgacacttagacgccatgcttgctatgcatattagaatcttggagttcttgatcttaaatattaatggctctgatcaatatcatcgtcaactaagagtgacaaagcaattgaattaggctgaactttattgaagtatgtagacagttgaagctggttataattccctgtttctgtaacagaatgaagaggaatttgtttcatttcaaatagttcttattgaaagaaggaaggaggaaaatgaattgataagaacaataggtgaagcggaaaaccgaaaaagagcaataagtccttttgtttacaagtcttctttatatagaaattcgacctattgctctggatccccgtttactaggaagatatgaatcgaaaggatcgaactacctactcattattcggaggtgaatcatagaacactaaaagctgtggtatcttatagaactatctatttgtataatgttctccagttggacaaatgttcagtgaaggtttacactgacagcaaaattgacagtctttcatggccaaggtcagtgagtggcaagattgacttgaattccattatttcaagctgcatgtgcttcggtagtttcattgtatactcttaacacctgatatggtgcctcaaaatgcagcctgttatgcaactaaaatcatgcatacaagctaagcaaattcatgggcaatagctgcacatatgtagaacaatatctagccaggcagaatttcacaactgctgaacaactcatgtatttggcaaatatattaacaagagtacacaggttgatctcattctcagccatgaccgaaggaaacattagaaaagggttcagaatacttcaggttcctaatactactgctgctacacatatttatcaatcatcacatactagtatgccattaaaccaaacagtatcagaacacttcttttttctgctgatgatcctgctttgggctctcattttgaagaagacttgatcagcttttcgctgaattcccagagttgcttcgccagcgcgtcattcctcgcaaatctgctagttttctccacattgcagtcagcaaagtattgtccggtcactcccttgagctgagggttcagtcctacatagcaagtggtagctgctccctgaaaaaagaaacatttgttaagtgtgttgtttcagatgaatttgaatttcaagacaattcaatttgtctttcagcattgctgcagagaattcggacagaaagaagaacagagaagatattgggttccaaacctggggtacgctcttccacaagatgtaggtggcaaattgaagcacccctgcaagtgaaaacaaagtgtttttttcagaacattaaggaaaggaaacagcattctcttttcaatcgaagcctgaaggtccatagcaaaaactctagaacaatgactcagaaagagagaacttgcatatacgtactcataaggaaaaaggagtgcctcatcaaattggtcatgatcaatccaggatgaacacagttaatagtgatgttcgctccttcttcctgtttcatcaatggcacagatcaaacatgtattggtgaattagtgatggaaaatagacaaaattaaatgtgttttatagaaaaatgggaaatgcatagagttttcagctctgttaatctgaataaagacatcacaaataaaggtgagaatgagggaagaaaataccttcagccgtctagagagctctttcgcgtgaagtatgtttgccagcttagattgtccataagccatcttgtcatcgtatctgccaatacaaaattcttatttcaatctctaatccacataaattttccaacagaaaaacaacatgaaaacactcagcacatacgttttctcatcgttgagtttatcaaactcaattcccttcggatatgtatggaggtgagcaaccgatgacaagttcacaatacgaccttcaatacctgtggacttcgcggttgctttcatattatcaagaaggaggttggtcaacagaaagtgacctgattgagcataacacatcagacagatatcagtatcatccaagcactttttgcatgtttaaagtaaatagttgatagtggtagagagtgaataccaagatgattggtcgcgaactgcatctcaacaccatcttcagacaatccaaacggacagaacatcacaccggcattatttctgcatgacggaaaaaaaaagaatatatgagaccccttaattaactgaaatttaagcagaaccaaaggatctttgcatgttaaaaaaaggcaagtgtgctaagagtttgaagggagttacatcaggatgttcagaggaaggttcatcgagttgaactgatctgcaaaagctctaacagacttaagggagctgaggtcaagcttcagaacatcgatgtgagcttttgggttttcctcaatgattttcttcctcactacagatgcagcctctgtgttccttgctgcgatgatgacatgggctcctctcatcgcaaagactcgcgaggtctccagaccaatgccactcgctcctcctgtaagacaacagaatttacagatttccgtaaatttgcgaggatagatgtttatgaacagtttgcagtaactagctactgtgagtctgacacaacatgaaatttactcacaagaatacaagattgatgtttggtgaaaactgaattctatgacagattggttatggatgcactagaagactatgattaatgcttttatgagcaagtttaattgacaagacctaacacagaaaaagttactattatataatgggaaaatgtttatagtttaagaccacacagttccaagctcaaactcttattttccacacaaaaagaaaggaatatccaacatctccacatcaggaaagagagggtaaaaatcctcagcccattgtcagaatggaagaactgctatgcccttccgatgaattgattttccttcacacttctgtatatcaatctatgtttttgtttttttagtattatctaaaatacctgattgaattatgaattctctgtagtcaagaaagttccagaaatctaaaccacaaccacaagattgagcaggaaacagacaaactttcatcaaaacataataaactcttctggtccacaaaaaagctacttatgcataaatttctcatatacaattttttgaagagcgtagtattattttgatattatattaatcataacacaaaaggtggctgctttcataatcccaactctaagccacccttaccaccatccaaaacacacccaaaaaggaaaagagagaacaatttgagagagagagagagagagagagagagagagatgcagagactgcctatggtgagttggtgacgggtagagaattggagattattcacacgagtttctcacaaatctaacaaaaacatggcaagaaactaaccaaaaccattaaaaataaactgcattgatgttttcaagaacaggtttttgctggccacaacaacacattgcagagaaataaattccaagattcggaggtacggaagcaggcagctctgtctcttacctgtgacgatgacggtgaggccggtggcgtcgacgccggcggtgacctgctccgccgtggacccggagccgaacccgctcgcgccggccttcccggtgatgagcgacaagatgcccatctcaaaccacgccgccaagaaacccccaaactcacgatccaacactgcaccccccaaccccaaaacccaaacaagaacacgcaaagaagctcagccaccgcaacgcaactgaattcgacccccccccccccccccccaacaagaagtcgccgaaaagaacacgccaagaagcactcaccctcgccggacagatcgacgagttgttcaatgcgcgggcgcgggaggcgggagcgaggcggaaggggaggaggaggtggttatttatggttgggggcgccggtgcagagttggtcgcggagttagaatcgatgcaggaaggattaggaagaagacgagacagaaaggaatttggaatcgtcacagaaagaatcgaatcgacctggattcatccaaattttaagagaattttatacgtttgggttttgtaatttactgctagtccggtatatgaatatgaatatctcaaaaatgtccaaatgctacaccaaattggttcacaaagaggtctggttggtgtgtagcagcgcttcgtattcgattaaaattcaggggaagtaatttgctgtagattatgaactacgtagcgtgtcactgtcccgttgggtcccgttgtatacatgatgcattgatgcagtgctcctaatcacttcctgatttgccatctgtcactcgtataatctcgtactccctctgtctcagctatgatttttcgtgtccaactttaatcgtttatcccatttaatttttttttaaaaacaaaaacataagttatacataaagtactatttatgttttatcatctcataacaataaaaatactaattacaaaaaaaaataaataagacggacgatcaaagttgagcacagaaacttatagttgcacttaaaatgggacggagggagtatgttactgccagtgctagcaaccgtggcatactcgactctgtttgggacagttctagatttaagatttttctttaactaagtattcataactctagaaatctatacatctaaaattatgattatattgataatatttagatgaattgttgtttgtattttatgagaaatataaaattttaaatctcactatagtttatcttacaaactctaaatttagcaagtatctagaatcaacaccttgcttgcctgtgtttatatgagaggtttgattttctttctttttactagtattttacaaattaggctttaattattttacagcccatagttggtccgatgtgttactggaaattattttggtcactcgtctgcggtagcaaatggggccggcctactttgtataaccattggtccattgttgtctgatcatctgatgatgctgcatttgttgaagattaggtcgatgatgaccgaccggccggccggcatgaacgaacttgagatctcaattcatcatcctctgccaatttcgctaatctctttagttaatgtattaacccaaaagaattaagcttaattgataggagtagttaatatcttttgatctgtgtgaaacagtgaaagagatatggggttaacattaaccaacatatagttaattttgactatacaaaaaaatatattatactgagtagtgagcactgacacaaatcactccattgtgcaatataatactgacacatcttttttaaatggactgacacacaaacccctccaagataatagctcgagtcagctcgtgtgtaaattaccgaggtaattaaaaaaaaggctatgcataatgcatgcagattaaaaaaaagttactgaccattacaggattttgtggtacattattgaaggagcatgcaggaccagattatttgctgtaacagcaaggaatctgatggccatgctggtcctgatcacacagtgacattagattccatctcatttctacaatcttttgccccttttttttcccatttcatcatggagagttttcttcagatttttcagtaaggtaccagtgatccagactgccagtggatgcatggttggaagggagccaagcatcatggcgcagcgcagacacgggctcacccggtagtccccatttcatgcccactggtcctgaaatgcttatggacgatggattagggacgaaattgagttgatatg

SEQ ID NO: 8693 - DNA, 548 bp, Oryza sativa
tacggcggcgccgtcggcgagaggttcgtcgccgacgtgcggcgcgccggcggcatcgcgaaggtggacgacctgagggcgtacaaggtcgaggtgagcgacgccatgcgctccgacgccatgggctacaccttcctcggcatgccgccgccgtccagcggcggcgtcggggtggctctggtcagtatccaaattcgtcccagttaaattctgatcatctgttcattcctcgatccatccaaaccaaacttgaatatgattaattccagattttgaacatcttgagcggatacaaatcactcgagttcttgaaaggatttcttggcttgcaccggttcatcgaggcgttcaagcacatgctggccatccggatggatctcggcgaccctgactacgtcaacatcaccggcaacgtctcggagatgctctcgccggcgttcgccgacaaactccggcagaggatcgtcgacaacaccacgttccctcccagctactacttcccaaagtacaactgatctcagaaaatgtacacgttcttgttcttgcag

SEQ ID NO: 8694 - DNA, 710 bp, Oryza sativa
gcccgcacaagcacgaagtttggacgctggagctgcgggccttccaccggtggtgcaaggctgggatgcacagcagggcgtgcaatggatggacgaaagggcctgccggtggccgaggccgccacgcagcagtctgccgcactgcgccagagatccagtacaacgtgattgcccccatgcgctgggagtccgcgcacctcgatgtgctcaagcaaagcgcggccggtttgtggattcgcaagcaggatgcggtgtacgccgatgcgatcgtgctgcgcgatgactggccatcctccattaggctggcatgacacgatatgttatcttgtgttgcctgtgctacttgttgcttctcagtttgtctctatggaaatcatgaagccaccccaggtgagcagacgagcggtgctctaaattactatatcatctgtcatattgccactatacaagctatgagtggctggcaatttgatcctttttttctgcagactgatgatccatcgcagaagaacacactgcttgttttgaaatttcttccatttatgatagggtggttctctttgtcagtgccgtcagggttgtccatttattggtatgtgcatttgctattagttgtatgagtgtttcagtcatgttccatgctatagtgctatgcctcatagagattgtgggactcctccactgctcatttacttcttgcaattgatcaa

SEQ ID NO: 8695 - DNA, 756 bp, Oryza sativa
  unsure (1)..(756): unsure at all n locations
gttggaacaaatgaagaattttgtccatgtttcaaacatgccctgaactatgccaatctcttttcttaatgaaaacttgatgtacgcggtctagtttagcgctgcctgaagtagccttattggtgttttagcacgcaatgtgcatatgtttctaggttctcctgttatctgtattctgaaaattgattcatgttctgaatgacattccagagcaagatttatcgactatttggatgggaatacaggaggcctgaaagagccccgcctgcttgcccgtttaagcctgcggcaaagaacaatgaagtaagcttccatgctagtatttgctatacttatttctgccttaagtcgaccatttcattatgcaagatattaacacttagcatgcccccactgataatttacaaactctatagagacagctagcttttatgcatggtactgcatcatactagagccagtagggaattnnnnnnnnnnnnnnnnnnnnnnnggccattctgatgtgattggtttactccttttgctgtacagggtgcaagtgaatcaaaacctctagttgaaccccaaagcgctagtactactactaccacagcagaagataagaaagaggattaatgttgtcgagcagcggcgaacgtttcaaacaacagtgttaatgtttgtgaccgtagctattaagaaataattgttatatgaatgaatatactccccacatatgtttgggcagtgattgttgattcccccttccatcat

SEQ ID NO: 8696 - DNA, 1991 bp, Oryza sativa
tcttagttggacggagcgagtacattcggctatgttttatttctcttaaaacgataaaaacccaacagatcagtacaaagataaaccacgtgcgttttacaaacgacaaatgtcatacactgtatcgattagcacacggatcagagaaaaagaagatcataaaaaagttaaacagcgcatgcatgcataaggcaggcaaattaagcatgcgtaatgcatgcatattgtactgtgatcgatcaactcaacgcgacatgcacatttttgttttagataatgaacagcaatgcatgcacatgaagactgtgaagagctaactgtcggtaataatttgataaagtggtctacaattgcatgcgatagatctcggctggaataataatggatcagtttcacatttccatcgatcatgcatcttagttctgtctgtcccatcatttttcatgtcaccgggccttcttcacttttttcagatacaagcacacaccacatttatcatcaggtttattactgtaccccattcacaatttcagatcgatcaaccaccaagctacgtgcatgcttggctgcttgctctctgtttgaaaccacgtttagtttttgttttttttccgcatgcgaaacgagaaataatattaattactatatgatcgatcaggtattaactattataaattaaaaaatatataaaaagcttttgcaaagaacatgtcgtttaacagattaggaaacatactcacagtaaatgaggagctgcaaaagctaaacaagtgttcaaatggagccttagattggataggtttgataaaaaaaacatatggataaaactcttatacatgtgctattggtagtttaaaaattaaaagtgatagatcgatcacgatagaatataatcgaaatgaaccctaaaatttaatttcagaattgaagaattgatcgtggctgatcaacaaatgggcaatcaaaatttcagctctactctgcttctcaggtggacctaatccaaataccccttagaaatcacttgcatttctacttcccctactcatatgagtcaaattttcttcaaacttctgccatatccagttttcaactcgaaaagatggaggtctatgggacactagaaactgaaataactagggaaaatatatgaaaacgggatatcaggggaaagctagaagagaaattgacctggattgagttttgtgcatgaatttgagtggtaagggaaaatatagaaacaccagtgaattaagggggcatttggatttgcccctagtcttcctttttttggtctgaaagtgctatgggctaggccgaagacagtatgggccattctcgtcagcgccaaggtccagcccatcaacaggttactggccaactccgcgagagttaaaaaggcccactattggtttcgggctttaagcgttcaggcccgaaagaagcccagagagaagccctactactcatcgaatttttttcatttttaaatttttttcttttaatatttacagaaataatccatcggcaaaaaaaaaaaattacaaaaatagaccctcccgccctccactagagcggcaagctgacgtggtaaacgggggagggacgggcggtgatgacagacgggagagggagggttttttttgttagggcggcaaggggcctccatgcaaaaaagccagcccaggcctagtactttttggctggtactttttgcatttgggtcccttgccgctctctagtagggtggcaagggactcagatgaaaaaaaagtacgagccaaatgctctttagggctgcgaaaaatgcatttagccccttgccgctcggcaaggggctaaatgcaaatttcgacatcgtctgccacgtcagcttgcccctccattagggcggcagggtctatttttgtaattttttgtgccgatagattattttcgtaaatattaaaagaaaaaaatttaaaaatgaaaaaaaattcactactcatcag

SEQ ID NO: 8697 - DNA, 3706 bp, Oryza sativa
  unsure (1)..(3706): unsure at all n locations
gccgccgccatccgcttccgccccgccgacnccgcctccctcaacgccctcctctactcccactgccgcctccgcctgctccgccccgccatcgcgctcctccgctcctctcgcccgaccaccgtcgcctacaacatccttctcgccgccctctccgaccatgcccatgcccccgcggtgctcgccgaaatgtgcaagcgcggggtgccgttcgacggggtcaccgtcaacactttgctcgctgggctctgcaggaatggccaggtcgacgcggcggcggccctggccgacaggggcggagggatccacgccttggatgtcatcggctggaacactctcattgctggatattgcagggttggggacacgcccgcagcattgtccgtggccgacaggatgacggcacaggggctgccaatggatgtggtgggctacaataccttggttgccgggttctgccgcgccggccaggttgatgctgcgcggggcgtgctggacatgatgaaggaggcaggggttgatccgaatgtggcgacctacacacccttcattgtgtactactgcaggacgaaaggggtcgaggaggcattcgatttgtatgagggaatggtcaggaatggagtgctgctggatgtggtcacgcttagcgctctcgttgctggactttgtagggatggccgcttctcggaggcgtatgctcttttcagggagatggacaaggttggggctgcgccaaaccatgtcacctactgtacgcttattgactcgctggcgaaagctgggaggggcaaggagttgctcagcctgttgggggagatggtttctagaggcgtggtcatggatttggtcacctatactgctttgatggactggttgggtaaacaaggcaagactgatgaagtaaaggacacacttcgttttgctctttcagataatctctcccccaatggtgttacatacactgtattgatcgacgctctctgcaaagctcacaacgtcgatgaggcagagcaggtgttgctggaaatggaggagaaatcgatcagtccaaatgttgttacgttctcatcggtcatcaacggctttgttaaaagaggattgcttgacaaagcaactgagtataagaggatgatgaaggaaaggggcatcaatccaaatgtggtgacctacggaacacttattgatggtttcttcaagttccaagggcaagatgcagctcttgagggtaccatgacatgctatgtgagggtgtcaaggtaaataaattcattgttgattctctggtgaatggtttgagacagaacggaaaaatagaggaagccatggcattgttcaaagatgcgagtgggagtggcctgtcactagatcacgtaaactataccactttaatagatgggctcttcaaagcaggcgacatgcctactgcttttaagtttggtcaggagttaatggacagaaacatgttgcccgatgcagttgtttataatgtgtttatcaattgcctttgcatgcttgggaagtttaaggaagcaaaatccttcttgacagagatgagaaatatgggattaaaacctgatcaatcaacatataacactatgattgtttcgcattgcaggaaaggagagactgctaaagctctaaaactccttcatgaaatgaagatgagctccataaagcctaacctcatcacatacaacacactggttgctggtctctttgggactggggcagtggagaaggcaaagtatttgctaaatgagatggtctcagctggattctctccatcctctctgactcatcgacgggttttgcaagcatgttcacaaagcaggaggttggatgtgattctggatattcatgaatggatgatgaatgctgggcttcatgctgatatcaccgtatacaatacgcttttgcaagttctgtgttaccatggcatgacaagaaaagccacagttgttctggaagaaatgttggggagtggaattgccccagacacaatcacattcaatgctcttattcttggtcattgcaagagcagccatctagataatgcatttgctacatatgctcagatgcttcaccaaaacatttcaccaaatatagctactttcaacacgcttctgggtggtcttgagtctgttggaaggatcggagaagcaggcaccgtgctcattgagatggagaagagtgggcttgaacccaataatctcacctatgacatactggctacaggacatggaaaacaaagcaacaaagtcgaagcaatgagattgtattgtgaaatggtgggaaagggctttgttcctaaagtaagcacttataatgctcttataagtgacttcactaaagcaggaatgatgactcaagctaaagagctcttcaaggatatgcaaaagagaggtgttcatcctacatcctgtacttatgatatccttgtaagtggatggtcaaggattcgaaatggaactgaggtgaaaaaatgtctcaaagatatgaaagaaaaaggattcagtccatctaaaggcactcttagttttatatgcagagcattctcaaaaccaggaatgacatggcaagctcaacgtttacttaaaaacctttacagagtttaaaatgcgaagtttggtctcttatctaccagatatagatgtttctttatcttgtcagggtggtcagtagtgctgattgaatgattctattgtctaatcctcgacaagcgttttggctctctgaaaagtttgttgcagtaatctcatagggtggcatgtttgaaatgtggcaggtatgatcttgcaagagagcagaaatcccagaatacatattttacggaaatatactgcttcagtgcatctagacatgtaagtggccgggcagtctcatcacttggagaatgatttggtggcaagtaccatttactacaaactaaatgtacgtgaggttaaaggatgtgtaacacatgttacactgcagacattcttgcacagttgcatccacaacccagatggaggaaaagatgttccagttggaaaagaaaatactgtgctctttgaaatatcagtgctaaatttggatagactaagaactccttagcaataattgttgctgcaggtacaaatacaaatattcttatagtttatgcaatttgttgttggggtcttggggaggtggaactctacacattgatttgccaaatgatgccttgctggtttatgctcacttgggcattctatttgccaaaaatgatgctttactggtttctgcccacttgggccttctagatgtcttttgaatttctgctatgaagtagttgttacctgcaaaaatatttcttttctttactgcaaataattttctagtactatgaggaaagtgatgatgtttgttgcaccatgagtagcctttggacattttttgaaacgaagatccctttcatatttaaacataacaacagctgctaggtgaacttttgctatatttttttgttgagaacttctaatctgctattagcaatcaaagattgccatatccagggtcaatcttgcattgcaggtcatactttactagatgctgttctttttccatgaaggtctggttatatctgtggtcctgtgaaaaccttaattttccttatagtcctttatgttttgccattgcatttcagagttgctttgaaatcctatgcctagctggatcataatggggc

SEQ ID NO: 8698 - DNA, 12263 bp, Oryza sativa
  unsure (1)..(12263): unsure at all n locations
tgctgtaacgctgcatctgatggagaggatttaccgggtctctggtgcttacatggtctgccagtaagactgacagcatcgcattgctgccttccagattcccatattgcttggcattcatcttttagcttcttggagaatacttggacagccggtcctttaaccattgagtggaaggatcgtaaagctttctgtagctgtacttcatgcatgctggttgggtaaaaggcaggcaaatctttcaaatacacctccttagcagctggaagtatcctttggcaccatgatgaagaaaatttcacattaagccccttattgccttccaagcaagataaagcagtttgaattgcgttggatcctgctgaaggaagttgatcgttctttggaaatgaacttgtatgagtaggtgatgccttcatgttttgggaactacttaacccatcttccccactaaacagtgcagacaaaatagatgaacttatagacaaccatgtatcgaaagtagggagatcaggagcactcatttgcttcccggatgctgctgatgctgcagcagcagctgctgctgctgccaccattccaacaccagaaacaggaccagcagttgtattgcttgagtgtccccctcttcctctcagcccatctgattgtcgaaatataaaatccttgatgaactgaacatcttcatgggttgctggatggcaattgttctccagcgaagaaacatccaatgatgatttggatgtcaaagagtcttcaaacagtcctgcaatgatatccaatggctcacgtttcttactaattgaccgatccaacagtgcaacgacccttgatgtatcaagtgagaacagaggtaggtggctcacattactgacacccctcgaaacaatatgccctggctctagacccacaagtgtccgacacttctttagcaagaaacgtatctgaccttctacagaggaatgcagcttcttgctgaaagtaccatcagatctgattgctggcctagcaagcataaccactgaactagaaccttttgaagtcatgttaggttttggcaagccatcagtgttagaagcttgatttgatgatgtgtcgttcgtatcatccggacttgtcggagcacctggagcatcagtgatatcatcctcaaagacaaacagaacaacagggatgcatagccctggcagcatacaaggatgtgagccagttcctgacatcaacgagattgctgagggatgacgacctccacggcgtgcaggaggagagatggatgaggccctgtgagtaggctttgttggagtattagagcgagcaacttttgatggcactgcaggagctactagtgacttcacaaacggtgcaatagcatgctttgaggattgcaacagacggaatttcttcaaaatctgtgtgtcgaaccggaagccttcttggagaaatattattacatggcaaacctggcaacgtatagaaaataaaagcaaatcaaaatcaacattaccaaacaactgaatcctaaatttccattagctaaagtttgacggtaacttctaggatcagagcaccaatcaaatgttactgacaaatttgaatcgcacgaggatttgcaagcaaggtaggaaaaccacaacaaataggttaatttaattgctacaactggataaacaaacttaaaagtgtcatcttaaatttttctccctggcaaatcaagttaggaaacaagtgcatttatcagctaaccacagattttttttttagtttattttgcattcccacggtccaggtaacagctggataaatgatgcccctatctcccacaacatcgccacttcaaaactaaccgatcgtagttgtcaaagttatccagttaggcatgagaaagattgaacccagccactaaattactgtaccaagttctgtagtttgcattggctgctacacagcgtgacaatttagaggtagatgacctaatacaaatgtagagaccgcgctatgatagcttcatatcatatcagggcaaaacaaaagctgagacctccttcacagctagaatcaccatctcatgatctacatcgaaacgattataaacactcacggagaacatgaagagcagctcccgtagatcgcccgccccctccagaggtgtcggcggcgacggagcgaggtgcaggaacaccaccctcttctccccgtcgcggtggtacctgactccgcccgcgagggtcctggcggagccaccaggggagaacacatgggcgtccaggatccggtcggcgaggcgggcagtgcccccgccgccgacgaagccgacggcgacgacgccgtcgtgggagggcggggtggcggcggggggcggcggggagggggaggaggaggcgggtggcgggggcgtgcgggagaggacgcggacggccggggaggggcccgcctgaggcggcggctccatcgccggcggcgaggtgggggtgggtggcgccgccgcagtagcagcaacctctgtctgtgtattgcgagacgccaactaattgttaaatgggcttctacctgggatttcacgagggcttagtgggctttctatctatatgggccggtaatgttaaataggcttttgttagagttgggcccgttgtatgggctgctgagctccgtttcgtcggttagttggttttctgatatctcaaatgggggaaagaaaaaaaaataaagataagaaattgtgtcggtttcggctgttccacaatgttgggttgttcaatgaaccaaacaagaagaaaaaaaatcactgtgagtaataaatgggcatgcagtgtagtgttgtccgcggttagatcagtcatgctcgctcaccgaccatcgatcctagctaattaagctagcaaatgatcatgagcgagacatatcacaaagatcacagtgtgcatatattgcacaagctttaatatatttctctgttcatcatccttaagggaaaaaagattaatgatttaggtaattaagcacacattgcataattaagccggccgagctacttagcttatttatatataggagatatgctaccacccacaaacttgcacgagctagcattatattcgccctgaacaaattaagctagcaactcctccggtttgtaagatcgatcaatggctatcattggtcggaggcagcagcagggtgtcgcggcggcggcggcgacgttggtggcgttgatggcggtggtggtggcggcggcggcggaagcgcagccgtcgccgggggtgtacccgagcaggatgttccgagcgcgggagttcgggcgcgacttccggagcctgtggggggcggagcaccagcagcaggaggcggcggcgccggagacgggggtgacggtgtggctggaccggcggtcggggagcgggttcaagtcgcggcgggcttaccggagcgggtacttcggggcgtgggtgcggctgcagcgcgggtacacggcgggggtgatcaccgccttctacctgtccaacggcgaggcgcacccggggtggcacgacgaggtggacatggagttcctcggcaccacccccgggaagccctacacgctgcagaccaacgtcttctccctcggctccggcgacccgccccggtccctcggccgcgagatcaagttccacctctggttcgaccccaccgccgacttccaccactacgccatcctctggacatccgaccacatcatgtcagttccatcatttcttaatttacagcttaatgatcaaccgttacgttaaattcaattatattatctactcactccgtttaaggtttcaagattttttaattttagtcaatattaaattgcttcaaatttaaccaaatttatagaaaaaatattaatattatcgatcaatataaatttattataacaatatatttaattattaattacataaaagtaatttagtaatgtaaatattactatatttatttataaacttgatcaaattagatacagtttgactttaactaaaattaaaacatcttatatcctaaaatagagaaagtacttaaaaacagagtaagcagtgttcatcactttcttgattgcttaattgggctaaacgaaaatgtccgatgatggatcttgatgtttccttgtcggtggctatagcctatggtagcaagaaagatttatgtcgatattatattagcgcaaattaagtaggagtaggagtatcaagcatggacaagccgtacggcaaaactgcagggtgccgtaccaacgctttaaacacttgtggcagcggcgacactgacacgtagtacgattgcagcagtacagtacagtgcttgatttggcatgtagctagcgatcatcaatatcttaggccgccgacaccgactccctgtcgtcgttcgtcccagcatctgcataaatgtagtgctagtatatgatcacatatgttcaattaatttcataaatactcactccttctctaaatatttaacgtcattgactttttaaatatatttaactgtttatcttattaaaaaaatttaagtaattattaattcttttcctatcatttaattcattgttaaatatactactactactcaagtttttgaataatattcatacaagtttttaaataagacaaacggtcaaacatgtttaaaaagccaacggcgttaaatattttgttacagagggagtataatgttaatactagcatggatgcatgaataatgtatttgtgttatgatggatcgatcagcttcttggtggacgacgtgccgatccggcggtacgggcggcggagcgcggggggcgcggcggggttcccggcgaggccgatgtgggtatacggctccatctgggacgcgtcgtcgtgggcgacggaggacggcaggtacagggcggactacagttaccagccgttcgtcgcgcgcttctcggccttcctcctccggggatgctcgccgcacgcgccccgcacctgcgccgcccccgtcgccggcgacctcaccgccgcccagctcgccgccatgcgctgggcgcagcgcttccacatggtctacaactactgctacgaccccaagcgggatcattccctcaccccggaatgccgcacccacctgcacccatcgtcctcatcctccaactcctcctcgtcgtcgtaccacggctagctaactactgcttaattatctaatacgccgccatgtatactccatctaatacgctcctccgatcctcaattaagctatctttgtcgtctaattaattatattgtgcccctgtttgtcaattaatcgtttgtttatatatatactactgcaatggatgaatgggcatgctgtttaattaatgttgaatgggcatgctgtttaattaatgttatgttttctcaacatgattaattaccgtttcgagaaacacccattagttttccggttagctccataggatggtgggctagccttaccccttctaattgatactagctctaatatttatgtttttattaattgccattttcttctacactacttcctccgttttataatgtaagactttttagcattgtctatatttatttagattcattaacatctatatatatatgtgggtaatggtagaaagtcttacattatgaaatagagggagtacctccaaatcgtgtcaagacagtgcatactctggctgatatgataaccggtcgctgctgctgttgcgttgttggttggtgtctcaccaataagtacggacgtgcatattcatgcatgcatgcatcaaaaaataaagaagagatgaagcatcgattcgatgcgatcaccgacgaggcgacgacacagtagcagcgccaacacgcgctttcctgtctgccgcacgtccattaatgggccgcgccttcatagcaatacagttcggcacgataacaaacaggcccatgacatggctgtcgcaacacccttccggcccatttatagttgggccgttggtcgctcaactcaatccccttccggcccaaagcattgcccccgtcccctcggagagatttgcacttgcttccttccttccttcctccaaatctccaattccccattcgcgattcagaagaagagttctcctagttccagcttccaagtcaagggcaaggcgagcagccagccatcccgcgaaggcgactcgatccggcgacatggtgcgtattccccgtgttctaatccagcaacttttgctctgatctgattattattatgtctgctcccccctcttgtactgattactgatgaaacatcgtgattcgatttgtgctccatgtacaggtttgcctcgcgtgcttgcttcccctcttcttgatccccgtcgtcaacgccctccccttgctcttccacctcatcctcgtaacgccccaatccctttcccctctctctctctctctctctctctctctctctctctctctctctctctctctctctctttttgttcaatcagatcttctcacgaatggttatttcatggttgtttctttactagcgagcgtataattcaaccatcttaggttagcctgatctgttagcttgattgactagcaacaaacaggaaggaactatctataactgcacattttggtttaaccacggttatcgaatactgcaagtaattggcaactatagtcctcgcttgccagtctgtgccttatccactaggattcctaaaggaatcttgataattgttgtgtgctttccccaaaaaggagacgattatttgccgttctttgtaaccatgttcccatagttatgctcattggacagctgaaatatcatacttcctccgtttcacaatgtaagactttctagtattgcctacattcatttagatgttgatgaatctagacatatgtatgtgtttagatccattaacatctatatgtatgtgagcaatgctagaaagtcttacattgtgaaacggagggactataatagttacactcctcgtagagccgaaagatatagcataaatagtaactgaaaggcaaaaggctacataaggttccccttcttgacttgacaataaataatgctgaaagatgttttgctattcatattactctggataacaaataactaaggccctgtttctctcagctttggattattataatctagattattgagtcagattactataagctagattgttataatatgtagtagaataagcggttagttgtttctttcctaaattattagagcctagattattgggtttgcaagtctaaagagagagtggggtggcatggtgggtaatttttcaccaaataatctggaaaaagctcacctaaatgagcttatcagattataataagctgggctccagattataataagctacttaaataagttgtctgtttctttccgcttactctcaataatctggattataataatcccaagctgaaagaaataaaataatgttctgtagctgctgagtgttttctatttgagggcagcaaaggcgtcaaatgttggaacaaatgaagaattttgtccatgtttcaaacatgccctgaactatgccaatctcttttcttaatgaaaacttgatgtacgcggtctagtttagcgctgcctgaagtagccttattggtgttttagcacgcaatgtgcatatgtttctaggttctcctgttatctgtattctgaaaattgattcatgttctgaatgacattccagagcaagatttatcgactatttggatgggaatacaggaggcctgaaagagccccgcctgcttgcccgtttaagcctgcggcaaagaacaatgaagtaagcttccatgctagtatttgctatacttatttctgccttaagtcgaccatttcattatgcaagatattaacacttagcatgcccccactgataatttacaaactctatagagacagctagcttttatgcatggtactgcatcatactagagccagtagggaattttgcagcaactcagtttcnnnnnnnnnnaacaggccattctgatgtgattggtttactccttttgctgtacagggtgcaagtgaatcaaaacctctagttgaaccccaaagcgctagtactactactaccacagcagaagataagaaagaggattaatgttgtcgagcagcggcgaacgtttcaaacaacagtgttaatgtttgtgaccgtagctattaagaaataattgttatatgaatgaatatactccccacatatgtttgggcagtgattgttgattcccccttccatcatgtaccaaaacgttggtggtagtgggcacactgctaactgcatgctagcaatcgtaaactgctacacctttccattactctgatgctgtgaatgctcaaaagaacatggtctgattgcacaattgaaatactgcttatttgacagtgtcacgagaccaaaaagaaaaggaaggaaacgtggttgttgatttcagcagcaaattgatgcagcatgaatgaatgactactacttggtgtactcgaggacagcgtagaaagggtcgaggtagatggcccggaaggaggcgaagccggcggcgaggccgaggtggcggaactcctcctcggatcgctccctgccctgagtccggtaggtggccatgacgaagatgtcgttctccagcagcgccctcgtcctcgtgctgccgtccgtcgtgtccggcaccaccggctcgcaggcgatcaccttcccgccgcccggcagcgccttgtggcagttgctcaggatcgccgtgcactcctcgttcgtccatgtcgtcagaacccactgcatacgtatgccgtataaaaatgaactagcagggttgttttaattcatgtacatacgtaattcgatgcaaaaaaaaaaacaaaatgggaattaatgagccattcactgcatgtttgaattcttggacagaatctgatgcagaaagaaaaattggggggggggggggggggtatactattacttaccttcatgaagatggcatcaccggaggggatggacttgaacatgtccccgccaacatgcctcactcctgaattttaatggtcactaattagagcatgtacaatagcgaactataagctaactataaacacattttgagaaaataaaagataagagcggatataagagcaagtttaatagtatagcccactactagctccaattcattcttagctaatctaatagtcaattcatacaatagttgtttattatactattaatatatgatcatatatgtcatacacacattgtgtattgaagtccgcactgcagctggctacaaatctgtagcccactgcttttctctcttatgttttatcttattaaaatatgtttgcaggtggttaatagtctgctattgtacctgctctaatagcagactataagctagctatgaacatattttaaggagataaaaaagaagagcaacggactacagatttgtagccagctgtagcatggactccaagacataatgtgtgtatgacacgtggaaccaggtattaatagtgtggtaagcaactattatatgaattggctattaaattggctatagatgatttggagatatagttggctatcctattaaacttgctctaagagagaagagtagtgggctacagatttgtagtcggctgcagtacggacttcaagatatatgtgtatatgacaggtggaaccagatattaattatgtaatatatgtttataggtaaatattgtataaattagctattaaattgactatatatgatttagagttagtagttggctatactattaaacttgctcttagcatcaggaacacaacaaaatgaccctgagccccatgcatattttagcgaaaaacaaatagtcccctacattgatcgacgtgtacaactcgtgcttcacttgcatgatgtacggtagtatacttgtattattgtgtggcgtctcgtgatccgttatgtcaaacatcacacgtgaagtagctgcaaaccaacgtactactcctgtattattattaggcgtacgtatcgtttcccaggcgcttcttgtttgtagtttgtaaccactgtttcatctctaacaacacaaatactctctccgtttcaaaatatttaataccgttgactttttagcatatgtttgaccgttcgtcttattaaaaaatttatgaaatatgtaaaaccatatgtgtatatgaaagtatatttaacaatgaatcaaatgatatgaaaagaataaataattatttaaattttttgaataagatgaatggtcaaacattttaaaattttgaaaccgagggagtacttcactatcgtttgtttcctgaaactcgtggtaggtagtgatgaaggaaacgatcgagtccttgtggatgaatcgacgtcacgtgaagcaagccaaccagccatggagagacaaacgtgagccacagtggatatgctgggatgacgtcactcatactcaccgggaatgggcggcgccgccgcgacgacgtcgggcaggtcgaagttgacgccgtcccggatggtgcggacccgccgcatgatcatctccaggcacgcgccggagctgcctcccacgtccaccagcgtgctcaccccctcgaacccgccgtcgccgtagccctccagcagcgcctccatgaacggctccgacacccccgtcatcgcccggagcatcacctcgttcgcctccctgcaattgcaagtccgaatccgatggagattagattggagaggaagcagctagcagattataattaattggttgatctaattctaatctacctgtccttgccgtagtaggcgtaggcggggacgccggcgttggcgcgggcgaagggctcggggccggaggggtcgaggacggcctcgtggaggaggggccaggcgcggacgagcgcatcctggtggtgctgcagaacgtagtcggcgtaggacgcgccggagccggaggggctaccgccgccgccggggacgagggtgcggccgacggcggtgagcgagaagcggcgcggggagggggaggatgatccggtgtgctcggagaagacgccgcgggaggcgaggaggcggaggaggcgctcgaggacggaggggtccgggtggcccgcggggaggaggtcggcggcggcgagcggggcgttggcgcctcccgcccagagcttggcggggacgccgaggcggatgacggcggtgagcgccatggggacggagatcatgttggcgagctccatcatcgccagcctggcctccgccggggacagttcgccgtctcctccgccgcccattttccaaactcttactcactcagatgtgatgaatctcaagtcaacactactcaactcaactgacgagacgagacaactgctgcggttgagttgtttccttcttctatctatctatatactgtatatgtactcgctgacatgtgggcccagattctatcgttggccaagatcgaatgccacatgggctctagcgataattggtcaacaattcaaatctttgtttaaatttcttttcaatgcgatgggttctttttgggtcctgatggttagataagctcgattaccgtgtataaccagcagcaaggagaaccggcaaatctcctctctcctctggttggttccagcttgcttaaaaaatagtagcgcgagatcggatggtgcatgctaccggggactaatgcgtaattagctgaaagcgcgaggaatgctttgcaaaacgtcgctgacgccacggggtttagagaggttaatacgacgttacattcttttactactccctcactctctaaatatttatcatcgttgacttttttttaaatatatttgaccgtttattttatttacaacctagactagggataagttcatgttttcacttaacaccatatatgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8699 - DNA, 711 bp, Oryza sativa
  unsure (1)..(711): unsure at all n locations
cttatttctgccttaagtcgaccatttcattatgcaagatattaacacttagcatgcccccactgataatttacaaactctatagagacagctagcttttatgcatggtactgcatcatactagagccagtagggaattttggagccctcatctgtcacagnggccattctgatgtgattggtttactccttttgctgtacagggtgcaagtgaatcaaaacctctagttgaaccccaaagcgctagtactactactaccacagcagaagataagaaagaggattaatgttgtcgagcagcggcgaacgtttcaaacaacagtgttaatgtttgtgaccgtagctattaagaaataattgttatatgaatgaatatactccccacatatgtttgggcagtgattgttgattcccccttccatcatgtaccaaaacgttggtggtagtgggcacactgctaactgcatgctagcaatcgtaaactgctacacctttccattactctgatgctgtgaatgctcaaaagaacatggtctgattgcacaattgaaatactgcttatttgacagtgtcacgagaccaaaaagaaaaggaaggaaacgtggttgttgatttcagcagcaaattgatgcagcatgaatgaatgactactacttggtgtactcgaggacagcgtagaaagggtcgaggtagatggcccggaaggaggcg

SEQ ID NO: 8700 - DNA, 1057 bp, Oryza sativa
gcgctggcgtggacggcttggagtcgacgacggcggcgccctgagcaagcaggatgaggcagtgcgccatgtcctcctcctcggtggtggtgctctcggaggaggaggccggcgccgcgtggtggcgcggcctcttggtgcgcttgcgcttgacgaccccggcgtgcttgtcctccacggacatggcgacgaacgccagagcgcgctctgtgtcggcgtgatcggtggcttgcatggcgatcgatcgaaagcaagaaacgatggatggaatcgaagtggagaatgaatagcaagtttcgatctctttgcctccttatcaatggaggagaggaaagaggagtaggaatggcaaaaacctagcctagctaccaagctgcctttgcttcttcttcttcttcttcttcttcttcttcttctcttcttctcctgtgatgtgttggtgactttggatatatatgtgtcttctcttctctgcaaggctttgctgttgctttgcaactcttataaccttccactctagagagagagagagagaattaattagggagagagagagaatatgtgtgtgtttgtgtctgtggtttagtttaattaggtggttaattacagcagctagcacaggtgcatgctattgttagaaggtgtaaataggcagtataggagatggagcacaagaagaaaggttaactggtggccaaggaacgggcacgccgagagtgtgtgttaaaaggctccctcttaattacttgtggacgattttgatgcctggctagctccctctactagctgccttttaacttcgtgtgccaaatatgtttttacatcattattagacacccttaatttagccccttgcttgttttccaaatgcttaattacttaccctcttgaattaacccatcaaagtgtatgtgtgtgtgcgtgagtgaggatgaagctgtgcctactcaactattatactagtatctatagttagcatagctgttgttttctttttggtgatgaattcaagtaatatactccctttgtcggcttcatttctagtatttttcagata

SEQ ID NO: 8701 - DNA, 3791 bp, Oryza sativa
aaacggggaacacatgcatggagatatatctagaccaacaagtacgtacagaaataaacttctgtcgaggatgtacttgaacatgaatgtttgcttgatattgttatttagctatattttagaatactttacaaatggagggatgaattgcaagtacaccctctaatttaaattagattaaattaaacacatggtgaaataggaatagttaggaagctaggcagccgtaaattaacctaaaatgtacatattgatagaagcaaggcatagtcatttatgcgtaaaggtaggcaccgacgactacagtagacgaaattttgggggtggacggagagttaattatttttccgttatatatttggtacatatataggtaattaattatgtggcggtttatataaataaataaataaataaagggagatgcatgcagtatgaaataggcaaagggaggcgaggagaaatacggcatgcatgttgaccggaaggcatacacatacatatgcagaaaaaggaaggacggaaaagaaaagatgcatggcggaaagggaaaggcccgacgaatgggaggaatcatatattccatcgattagagcaagtttaatagtaagttcaatatcaactatcgaatcaacatatataagtacagtagttgtaaggttatttttaatttttcttctcctctctttttctctcactaatgtatttatattagagcagctaataattaattgttgttgcatgagagccaacacgtacgttttcttttatatattttttcttttacataataagtttatagtgtgcttatactacctcattgtattatgtttgctcttaattaaggcattaattaaggtggacggagaatcggaatggattgatgcgatgcctccactgggggaacctccctcttctctggatgcttttgctgtgccggcgccgcgtggttcttcgtttcgtttgtctcgccatctcttaattccttacgttgaccattatttaagcctcaaaatcatctgtagcttagcttgttcaaggaggccgcgtcccgcgtgcgtgcgtctgtcgcggtcgcggtcgatgccatgctatgctagcatcacctgtcaagcacgcacgcatgcagttgatccagtcaaaccccacaatctcctcaggcctcagctctccatccatctatatatacattaacaccacaacaccccttcccgctcataccatccatccaaccatcgatcgatcacttccaacttattttctttaagagaaacaacaagcttaagctagctagttagtcatcttgttaattttggcctcaaataggtctagaattcatcaagaacacgagctagctagctgcactgtctcgctatatatatatatacactgctcatatggagctagtggtgcaggctttggcggccgcagctgccctcctcgccgtcttcttcctctccaccttatacctctcgccggcggccaccgcgcgccgcctccgcaacgccggcttccgcggcccgaccccttccttcccgcttgggaacctccgcgagatcgcctcctcgctcgcctccaacaacgacaccgacgaatccaacaccaagggcggcgacatccacgccgccgtgttcccctacttcgcgcggtggcggcgggcgttcggcaaggtgttcgtctactggctcggcacggagccgttcctgtacgtcgccgaccctgagttcctcaaggccgccaccgccggcgccctcggcaagctctggggcaagcccgacgtgttccgccgcgaccgcatgcccatgttcgggaggggcctcgtcatggcggagggcgacgagtgggctcgccaccgccacatcatcgccccggccttctccgccaccaacctcaacgacatgatcggcgtgatggaggagacgacggcgaagatgctgggcgagtggggcgacatggtggcgtcggggcggagctgcgtcgacgtcgagaagggcgtggtccggaacgccgccgagatcatcgccagggccagcttcggcatctccgccgacgacgacgacgccaccggcgccagggtgttccaaagctgcaggccatgcaggcgattctgttccgctccacccgcctcgtcggcgtgccgctcgccggcctcctccacatccgcgccacctacgaggcgtggaagctggggcgggagatcgacgcgctcctgctcgacatcatcgagtcgcggcggcgccgagaaggcggcggcggcgggaagaagaagaagaagacgacgtcgaacgacctgctgtcgctgctgctggccgggagcgaggcgagcgcgggggcggagaggaagctgacgacgcgggagctggtggacgagtgcaagacgttcttcttcggcgggcacgagacgacggcgctggcgctgtcgtggacgctgctgatgctggcggcgcacccggagtggcaggcggcggtgcgggaggaggtggtggaggtggccggccggtctggccccctcgacgcggcggcgctggggaaactcaccaagatggggtgcgtgctgagcgaggtgctccggctgtacccgccgtcgccgaacgtgcagaggcaggcgctgcaggacgtcgtggtggtcgccggcgacggcgagaagaaggtggtgatcccgaaggggacgaacatgtgatcgacgtggtggcgatgcaccgggacggcgagctgtggggggaggaggcgagcgagttcaggccggagaggttcatgagggagggggtgcagggagggtgccggcaccggatggggtacgtgccgttcggtttcggggggaggatctgcgtggggcgaaacctgacggcgatggagctccgggtggtgctggccatggtgctccgccgcttcgccgtcgaggtggcgccggagtaccgccacgcgcccaggatcatgctctccctccgtccatcccatggcatccaactccgcctcacccccctatgctagctaattaatcatattattcatagttaatcactcaattatgttttgtttgtgcatgcatgcatgcaaaggcaaagcaatgcatctgcatgcgtgcgtgcgtacgtacgtatactggtgaccagtatacatgtagtcgtatatacactaataccatgcatgaattaatactagctaaagcttgatgctttaagctttaagctgagctgtgtcatatgaatgaataattgaattgaatcgatctgccggatggttattaacttattactgctctctctgtttcatatttgacttttttttctaaattcaaattgaactaagtttatccaaaaacaaagtaattaatgttttgaatgccgaacaaatatattatcaaaatatatttattgttaaatttaatgaaattaatttaatgttataagagttgttatattttttctataaactcagttaaacacttacagaagtttgattttttttaaaaaaaatcagagtatcttacgatataaaagggatggagtactatgtccatgtttaaatatatttacgacgctgctaattttatatatgtggtttctatgtgcagctttgacaataattttctctaataaattactaaagtatcaactgtggatcggaagtaattataaaagaagaatcacctatatgatttttatgtttcaaatttgaatatatattttaagaactattgatagtcaaaatttaaagagtttgattaaataaaaattatcattgtgtgcataatacgtaataggtgcaaaaatgcatgtgtgtacgcagaa

SEQ ID NO: 8702 - DNA, 15136 bp, Oryza sativa
attgattaagaagagaaaatagatagaaaaatcaaataggggatagttgtgagttgtaactagttcagatgaaagggataggttaagaaataccttacattttagagaaaaaaaagtttcaaaaataactatattttggaatggaaagaatagtttacaccatgcaccaatcatgcatctgctaaaggaacttgcggcctcatcttttcacttatacttatgcttatcagtcaaaatttgaaatttcaatcttaaattttaagttgattttaaggttttttcatcgaagtttatttttcagcctttgcttttacatagataagagtacgtatataaaatttttgttcactttttttttttgtaaatataccgtttcgcgatgggtctgatgatatatccaaagtatgtatagcctatatccaatccaacacgaggtcggtcggtcggtcggtccggtggtcacatagtgcggcaccggcagcagcattacaatctctctcgtgtctcgtgcatccagttgacaaacgcaagaacaggccagccaaactaattgactctttatcacctctatctttcactgtttacttgtaatagaatgtacttgaacttgacattgccgtcctcccttgtgtttagttagtacagaggaggcatagatagatagcattggcttgacagactgcgattgatgtgtgtccattattcttcatttcttctaccttgacaactgcttgacagttgacaaaacattgctccttgctccttgcttccatttgtcggatgatcagatcactgcatcccatggttttcaacccaaccaccgtgttcctttctttcggagcccacaggaacaagcaacctccctgcttctcttcagatgcattccttttgtcttctaaccaacacgagctccagtacctaagatatactccgtcccaaaaaaaaaaaaaaagtcaaaccctaggtatgaatctggacatgatatccagggtttgccttttttttggaacggaggaagtagtatataactagtactctctcgattttgcttgcaatgtttgactattcgtcttatttaaattttttttacaaatatacaaaacaaaaagttgttcttaaaatactttggataataaagtaaaccacaaagaaaataaataataattctaaaattttttgaataagacgaatggtcaaacagtgcaaccaaaaactcaaaatcccaggagtacatagtacaatgttttccatgataaagatgcatcatggctaaacaagtccataaacgccactgcaataccatgggctattcacctttcttttattttcttgagttgatgagctcactcaagtctgaactgatactacttttatagcatcttaaaaagctaaacttaagcagtgtagtagtgcaaattaaatggacgatcttcaggtaccaactcaataataaatccccaggttcttttttcttcctctatataatataatagggtacgatccggatccttcattctcatacaacaccgcagatgcagatgcagcagattcacagtacaccaccataacattcatattctaatacttagtatgtagaggagttcctaacatagcactgacatatacctcagcatccagcaacatcatttctcaaacaactctcttcctcttacacctacagcaagttagcgcatcgcgttgcattgcatgctaccaagcgcactcacggggattcggggaattccgtcagtcagagatagatatataggtggtgctccttccttccagcaataatacacattactcgcgaatagagttgatgtcgatgtttggagttcttgagtccatctgcctcatcaacccagccgaccatccacccatcgtatgatgcggcatgttgtgatctggcagtgccattgtgggggtctcctcctcaccgccaattggctcttcgttattctccgtctcttgctcagctttcgctttatttttctttgtcccaccatacatgaagctccccactatcacctatttcaaccaaaaaaaatataaaacaaaatgcgtaagaaccaaaccaaacagatatacacagaaaacagtgcataacctactcataactggttggttactttgatgggcaaaaaagctgatacagggtaacagacaagataagctgccatgtaccccttttattcagttcagataacagccaaaccatatgacaccaaaagaccgagattggttggataacatagcatatacaaacatgactacctgaacagttccagctgctgtcaggactccacctacactcccaccaataaccctgtggtcagggccacacagagctatgcagaggcctccactccgggttcgcgaaccaccttcctctatcaccaaatatgatccagacaggcacaggatttcaaatcgaccctgccaaaccaatggtaaacataagggcctataaagaattaagctaggcacaacaagacctacattgtaaactatgacctacattgcaagtttgaccatggatatggcaatctttgactgctaaaagaagttctctacaaagataactatggagcaaaagttcatctaaaagcacatcaaagccttttactcaattgaggaactatggaaaatccaaaatgaatggagacaagttgattaccatttctaatgcagctcagcacatgcaataagtatgggtcaaaaagagggataagaggtttagtttaccattctgagtcaaaagcaggataaaggatcttttgctatacccaagagtgaaacatgaggacaaaagcatgaatatggaagtcccggctacaataatactaagaatcaaacaggcctacaagcagcgtacctcatatgtaaccacaccaccagagtttgaatcctgatgaagggttgctgtggatacagctcctgtcgctgagatgatgcacactgcccttgggccctgttgtgagaaggacattatcctggcagcaacatcctgcatgggataggaaagctatactcacagaacaacaaggcatatataacaacatgaaaaactgtttttcatttccagagactaacaaaaaagatcagatccactgtagttttggatcttaattagtttttttttttagaactcatgttaattagttggcatccatcagttatcaggcaaagaattgtagttcttgcataggactactatgagttaagaccactgactccaaaagatgaatcatcaacagctaaaaagtacacctttgtaggtttgcacaacacacagatgctagtgcagcctgagactaccaaatgatacttaactgtatatcccaactaccagttgtatactgatgggggaagccactacatgccaatgatagtgaagtgatttttttaatcaatagacaagagtttggtacatgtagcaggttaatgaagcatcatttattcaacaacgtcatcagtattagttattacaactgaaattattggaaatgtgttgcactcgcaatccaaaaaatagttttgacgacaatttgaggtactacattcaagctatcacgactcacataatcagaaaatcgttgcgttgaataataacagaaagttcaacaaaggttacaacagcatgattcttagctattagtatcctttgtataacttaacttacctctcctggtgaaataataatcacatgaggagtaaaacctgttccaacagaaccaagaaaccattttcctgaagaacacattacagcattttattagatagcaggaacacaaaaaaacccatttcacgcataaaagaaaagaagaggaacaaaagctagccatgcatagtcaatagaagtttctgatgttgattcaagtagtaaatcagattttaggagtacatatactagtattatcagtacacataccccaccaagttcccaacaacaccataatgagcgggcattgtgtttgcatgataacagccgtggcctccaaagacaatagtaggtaaaaaacaaccaactaagctggacaggataccattttcacatctgatccagatacccaatagcatatctaagcttaagttcatgatataagcaaggaaatacgtaacataaaaaggtggtcagaatgtttgcagatctaacaagcaatactatcgtgcaaaatgtaaggtagcatggaatcaagaagttgacaaaattcattcaacaatcggaaatcatctaccactagtttcttagtgcatttctgttaccatattaaactacccttgcattcgatcaatcattaccatataaacatacaacatgatcatgaaatttgctaggttgcaggatctcaccaagagaagccaactgctgcatctttccagacccaggtggccgccctcggccacgcttctctgtaagggcaccagaccccgaaccccccgatcctgcccccgacccaaaccctgagcctggtgtggtcaccattgtacccatcgccgaggtcgacgagtgaggcgtcgacgaagacggcgagagccccagcgtgaccgccccatcaggcttatacttcctcggcctcccccgcttcttcttcaccggctcatcctggccagcaccactcccctgatcccctttagcatccgcgctcatttcgacacccatgccaatgtccataccaccaccaccgccaccactgccgtgctgcgcgacaggggctgaggcatcaacatggtggtaaccctgcccaatgtgggaacccccaatgtgagggggctggaaagggtaccccgcagagactgcatcaagatgctgccgatatccaccgggcggcgggccgtggagcccggccgggtgcccggagcctcccggcacgccaatgccccggtgctgcacatagaaggaggagaagttggagcctgacgccactgtggactccctcccatccattcatggaatgggaagctgcgccacagaggaggaaggaggaggaactcacgcggccacccacaaccacaagcacaaccaaggtggcaactttccttcactattcgagattagattcctccgaaagctatcggaggcgaagcaaatggacgcaagaatatcaatctcggagagagatctcttctccaccgactcccgaacacaaaaaccgcagtttgtttgttttgttttttttctctcctcgagaaacgaggcgagatcagatcgagcagcgacgggagatctcgactctgaacaaggcggtgaaatctccaggcagcaaaagattggaaccaaacgcgagaaagagacgggcagaaaaaaaaacccgatctttcgcagggaaagaaggggcgaaaaggatgggatttgcgcgaggtcgagaagggatggatacacagagagatagagtctgcggcggcggaggcggcgacggcgggcggcggcgggatccgagaggcggtggaggggggagaggagtgatccaatcgaaatggcgatggatgggggaaatgggagatagctaaaaccctagcggagggggatcacaggagagaggagcccaagagaagagaagagaagagaggagaggagggagagagagagagagcaagcatgtatggtgaatgtctctatgtgttggaggagagagagtgttgtgtgtttgtgtgtgagggattctttgtggagccaatatggcagatctcatcaatgcaagtgatatgctgccttgtcctaggagtgtcctgaaatgatttgttgagtatcgtagtttggtcgaagagggctacgttagatatatgtatgtatattggatatggtgttcattaaattaggtggaatcggacaaaagttttattggccaagaaaatagtggatatcgtatttgtcggtttatgttattacgttgttttgtcctatcgtacggttagttcgaatcaatgtcaaaataaataatcacttgttcggtctccgttttttatgcaacgttaaggtagcgacaaaaacatcattaaaaccttccaagttgagattctctaagactcggagattgatgcctattgatttggtaagacagaggcaatgatatagtgattctttctattaagagcatcggctacaacattagctttatcagagcgatactggatacccaaattttagtctttgatgagccgttactttttttggcttggttttatgtttggttggttgataaaatatttcaaactttttatggctgatatggacttcacacttgttacgatcaaaagtgttagagcatgaactatggttgtcagctccaagtcatatgttggataattggctttatgtgatcgtaattgatgtgaagtataagcaaccgctttgctatcttacatcaacccacatacaatctcatggcgagatgcataaactcaaaattcatatattaacgggtatttcaagtgttacgagactttgtttttttaaaaaatgtcttataggatcaccaatggtagaatctcgtcaagttgccatctagaaatggaaagtgaaacaatatttgagtcgcaacaatcctctagcaagcttagttttagagtaccattaataccgattttatcaattttctcagatttaatgtaatgtctatgctcatattgcattatattccattgaaagtggttaaaatgaaatatgagaaagaaaaaaggtatcagtgcaaaattgtttctcactttttttagtacagtggatccgtggatgtgacggtctatgcaagagtagtgtgacgaaatatctgccacaaaggatcatggccttgaccgggtaaggagaaagagaccgagctctgctgacgcgtcagctaagtcgataataattgggtcgataaccccggtgtataggtgagcaatgccattatcatcgagagagtatttgcttacatttgttcaacaacacctgttcaatccagattttgatttgggacagtgaaaaatgctcaaactaaggaccgaaaatacaatcaaagatctttttctttttctgaaaaaagtggctacaattaaacagacagagcggtcggatatgatgaaatcgtcaatttctaagtatttggatttttctctgttttcttgggacggatccaaaagttttatttctcccaagaactgatcacgtcaccataacgttctcttgtgtacttgagagttcacaggggcaccaataattccaatggagtacagcttgatgctgtacatgtgccagggcagtttggacatcttgtcactacttccaagatttattttgtactagacaaatagcaacaagacgaagcactatatgttagtataatgctggagtaccaaacaagtctagcaaagtttttatctgtcctaattatacaaaggactgtctattccaacctgaaaacattcaataacatctaaaaaaactggtgaaaagttcttgtgtagagcaccatttgtcaacgatgatttgctggtcagacaagttgcataattgtcgagcaacaccaacaaaaggattcacacatgtgccaagtttgctgcagatgtagttgtttcatccaaatagcatgaaatagcaaaaaatctacttccaaatgcaacgatctcactttaatattttaaaagtgttcgagatgttaattccaggctctgccactacaaaggtactctacaaaccaacgtatagaaaagagtaacaagctccaactgagtagactgccaaggctagatggaatatggtcacttgaccagagcaaatgcactcatctgagcatagaacttgttctcttccatcaaaactatatcaacactggagcacagtttagcaatggaacacagattgtaggaagtaaaactccccagttacttgtcgacctccattgcttgcgcagctttggcttttgttaaggctgaaagttttgtcttcacctttttcttgccaaccttaaatttgccacccttccttttcacatcaccatctatctgaataaaaatgaaaagaaagcattaagaaggatgctgcaaacttttcttaaccacaaaaaaaaagaagaatgtagcagtttgctatgttcatatttatattcaagtaaaaacacaagaccaatcaacaggaagtgaaatttgaggagccagattgatcaaattattttttgagaaagcagtagggaatgtaatctcaaacaaggcctatataactgactgacccaaagtaaattatgagcagattaaacaagctctcgaagacaagcatatcctcatctaagattgtcatgtagttcaagcactatttctctagagtacttaaactggtgtgagcaaccaggtcacagcatatcagatggcaaatatatatattgtataccgaagatcatcgggaggtttaacgaataaaagagtcaacacctggtgcaaaaacaaaaggaacttgacaacacatgtttggaattgctaataggtaaacttcagaatatacgagtagatcgatgggaaataaaacccaagaagtacaaacagatcatataattggatagaactcatgagcaatcagcttgctcaaatacactctcaaacacaccacctacatttcactagcactaataactgtttgtgatagtaaaaaccagcggcttggaagcaattgagggtttgaagccataaaacagtaaaagactgaagctagtccataacctaaacagctgcatttaatttcagaaactgcctaatgagtaaaccagtgaggcataacaggactcctggaactgcttgggatctgtgagctcttgagatgtcttggaaaagaaagtggcacatgggaaatgaaatcgctcccagagcctcatgagaacgaactacactaaccatttcacatgcctcctgttatgtttctaaagggaagcaagcagggttacaccggtgttgagatttttggatacctgtgcctaacatccaattttgtggattcactgtaaactgacatatccttttctgtcacccctacaaaacaggctgatgacagcactgaacaaattgaaaagtatatgtggactaaagattcctgtaggtgctgtacaaacctcagtgggacagaagacagaaaaatcagacccagtctgtaataaatctttcaactagactcttattcagaattcaaatttcaaagtcctagcttacatcttccctaactctctgataattagcgaatgctggtcctggctatgcaatacagtggttagtttccacaagagcggtcaataggtcgtgtgaattatagcagagatacaactccaacaagcttatagccaccaacaataaggtaaaactagtttttggaaactaaactgcatgacatagcatactcaaacacgcatgctaatttaacagatgaagaccatccagtgttaccaatcaggagctgatcatactaactcagcaagagaggaactacacaacaaatgattcatccatagacagaaaaggagatgtagaagaggttgatagtaccttcatcttggatttcttggcctgcagcttcttggccagtttctccttcgcctccttttcccctgcacacacacacatacaagacagccaccataatcccaaatcagatgcctggttggtgaaatctacaaggagatgagaggaaaatcgacaagggagcagccggatgtatgatctatcggtggtactttggaggtcgaactcgtgctgcttcttccgcttggcgaggttgttcttcttcgacatcttcctcgccgccaaccgccgacgaagcacagcacagcacgcagcaacgaacaaaccctagccgcggcagagcctccatggagatgggagtccttttaactgggctggaattgggcctccactaattcggtcaaggcccaaactgtcgtaaagcaaagcccatcaaaggcccagttaaacagtcattagacctaacccggtgattagtggtcaaagctgtccgtcattacgagacggagacagtgacgtgaggggacacgtggctcgggccgaccactccgatcaatcatgccggacacgtggcgcgtggccaggtgccagcgtgtcattgcgcggccgcatcatttcgtttttaaatatatgttttggaacgaaatcattcgatttttaagcaccacctcacctcattacccgcgctttccgcccggcaattacaccaagaaaaggagcaaaaggaaaaaaaaagtctctttatcggaggcgtaacatctacttctgctgctgctggtaaatacactcttctctgagcttcctcaagcttctgaaaacagcaagagattaaattatcgtaattttaagcatccaaggtgtttggtgccagtgctcgaggactggagatggagacccaggaggcgaagagagcagatgtggcggcggcgccggcgacggcgaccggcggtgaggccgtcaaaccggccgccggcgatgctggcgcagtaaccaagacgagtaagattagtttcttcagcttagctttctctctttttttgctccaagtttcagtcctgcagcaactgtgacccattttgtagtgtttcagactgaagaaaatcttgtttagagttcattggtctgagaaaattgccatcagagttagtagttggaattagagtagttacttgctgcctttggtgctaatccttatagatgcagcagatggaccttcagcaccagcaggcaaagctgcaactccaacgggttcggttgacagaggtactacgtgcataattattcttcaagtttcagtcaagaaattgcaatctatggagtaaatggcagcaacaaatgaaattaacttgcagacgccatactcgcaaacgtggagctggagaggaaactgtcaatgatcaaggcgtgggaggagagcgagaagagcaaagcggagaacaagtaagataagatagcctgaactcaatcaagcactgtaataaattgcattcttgtcaatcctgtaaattatcatcgtgtcacatactcataaaaaatggcatgtttatcagggctcagaagaagatgtcatccatactctcatgggagaacacgaggaaggcagctatagaagcaaaactgcgaacacaagaggtctgaatcttcatatatctcttcttgtcaaagagatagtagttcatagttgcagcaatggctgtggcttcctgaactgactgactgactgacaatgtattccatgaattgcaggagaagctggagaggaagaaggcggagtacgcggagaagatgaggaaccaggtagcggcgatccacaaggcggcggaggagaagagggcgacggtggaggcgacgcggcacgaggagataatcaagtatgaggagatggccgccaagcacaggtccaaggggactacacccaccaaattcctctcttgtttcggctcctagaaccacaaaaaacgctcctgcagtgcagtctcctgtcctgtgtgctgatgcttctgtgtgttgatatggtgatcagtttgcagttttgggcttgtttctcttctttaatcttctgtgttgaagttccggatttcatggctctgtcatgctgctgctgtgttttccttttcgctgaagatgtgatcatcatgtttggtgagtgtaagcatactcaaaacacttgtaaacagtcagtcacatgtaaacataccaccttttttgtgaattttgcgcttccagagattaagaaaaaaagcgtgccaatttgttttgttggtgctttgtatcatgtatgtgcatatttgtattccatgacatgcaagcaacatgacaacatgtacttgttgaactcaagtacgggtaagtaacagttaggcacttgacagcagcagcaagtgtttgctgatgtgggaagcaaacatggaaggaccaaccaattactaatagtgaatgatttggaataagcactgcaatttgcaggtacaactgtaacaacaagtgcattcttgagttttcaacaagatgagcaatggaaatgaaagaaaaacaagcaacatcagaagcgctgcacaacagcgagttgttcttcatgcagttcattactgaagcagaatctcttatatacagctgagcaaaatttcctagaaccaaccaactactgatcatcaaaattcaagtagcacattcaccactcttgcacctgattctatatatgtactatgtatctactgagaataaacactagcacggcattaagccactaactatataaaaaggcatgtaatgtaaatatgtaagagctggactagttgttgatgcatgatgttaaatcttgttggcttgcagcactaatcactttccaggtaggtagctaactacatcaaccaacagtgaagtaaatcatccctatactgatcggtgaagtgatggtagtgaaggattttggtttgcaagtgcagcgaatcggcgagcgacggctgctcaggtagggggcagcgcgtcgtagaggtcgttgccgcggcgggagacgagggcgacggcgagcacgacgtcgatggcgaacacggtggcgaccgtcgcggcgaggatccagacgcgcaccttcccccagaaggcggcgcggcgcaggcggagggtggcggcattggggcggagctcggcggcggcggcctcgacgagcgcggcaacgaggcgcttggagcgggggctgaggccgcggccgccgcgcagctcggcgagcgcgaggctgatctggtccgggaggggctcctcctcctcctcatcgaccatagccgtagcctcggcgggcgctgtgacctgcacgatataatcacagctgtcgaattgtaaaatccaaattcgtagacgcactcgaatcgagcaaattctggaacagaaacatcatttccagttggaaacgacaagtggattcagaatcgaagcaaactgaacataaagggaaacacaaatgaatctgaaatgattggggagcagagaaactgtaatcacactggaatcaaatcgaagttaaaaaaaaaacgcccgatgccataaacccaaaccaaaacccagagcgtgagcatttcaaaatccaccacctcggtgagagcggagtcggcggaagcggtgatggcgtcatccgggtccggggcggcggagatgagggcggcggtggtggtggtggaggaggaggagtcggcggggtcggggaggtcgagcagcggcgcgaggtcgtcggggaaggtgaagtcgccgtcgtggaaggccaggcacttggcgaccccctggtggttggttgatcgaaagggagaggacaaggtttagcggtgggcgatcgaggaggaggtgaagggcggggaggtttggttaccttggagttggcggcggcggggatcggcggcctgggggtggaggaggagccgacggatggccgggcggaggcggaggaggagcggatggaggcggggcgcggggtgtgcacggcggcgggagacggcttcgccatggctcctctcctctccgttgctgcgcttctctctctttgtggctccttccctcatgaagaggagagaggagagggaggaggaaggcaacttgaattgggccgcttccatcatttgggcctcgcgagcgaacccaattcccagcccagcccaccttagagagaggagacagagacggagacaaatcggtggatggggcccaaaaccgtctcttcctcctccttcgccttcttctcccttggtttttccctcgtgacatcacggacaccagcggcgatccatcggcgatccaccgcgcgcgcttcgatcggcgaccgcctcaggtgagctccgcgctcctccctagctccacccccatggtattcccctcccttggccatgcctcgagagtcgagacgatccaagcggattcatccacgcgagtctcagattcagatggcctaatcgatccaccatcgcatcgcatcgcaatttcttctctcatctaactcttcttcttcttcttctctcctttgccagttagttagttaagtttccatggcggggaggcccagcatcccgaccaacagctccgctctcatcgccatcatcgccgacgaggtacgccaccccaacattagcttcatgtttgcgccccaatcataccacaactcctgaatagccccaatcataccatacctcctgaattgccgaatgcccactcttgtcttgtcatgtctgctagcgatccatttacttgcacttgcagggatgggatgcctcaatccattcctccaactaactagctaatcactgcacttctgttgcatgtatgtatgtatgtatgttataagggaaactgtttttcaataccagatgtgtgcataatctccagtccttctctagttgctcaacttgttgccttattactacttgtccaatcacccgagtttagtaattttgtcacgcattttgctagctatggaattggaatactacggttacaggaaagaaataaagtataatgcatagtgttttgttctataataacatgccgatggtcaatatgaggaatgaaagctggctgttgcttaagcaaaattgtctcaaggacacttgatacttccattctcacttgcttcacatgtactcctgaattcctgatcggttaattcacagtagcaacccatagtttccaatcagcatcgttcaatgagaaccagaggagtaaactgaagctcttaataaagaactgacacaaaaccgcatcctacctttgttaatagaaaaatatgcaacactcttttgttggtcttgacataagctgctctaagagtagccaggttccccagtgtttaatcatgattatagtcatctgaaaggaatattctgtttcctcccctgtgtttgcaggacacggtcactgggtttttgttggctggagttggcaatgttgatctgaggaaaaagacaaattaccttattgttgataacagtaataacctcaactttctaacgtgcaaagctgtttaatttttccatcaatgtcaggctgcttttattctgactatatataaggggaacatcgcgtgacactctattgatcatctcatgtgcaaaaaacatattatcattacccaattgcatgtaccattttaatcaatgtaaatctatctttccattgttagtag

SEQ ID NO: 8703 - DNA, 1364 bp, Oryza sativa
ctttcagcgtgtaaatacggcattgacaagaggctaatggtcatattgaccaaagtttgccagtgagaaaaaaatctgcccgtctcaacagaatagattttcaacagcttagatgactaggcgcgtgttttgaagcaaaattgcagtgcagaagagaagttgacgtttgagagcagaatattcagattgcataaatatatgtccaggcttataatctggaactaaaagttccagttggagatgaaacaagagattaaaacatggttaatcacataaaaaaaaggaaccagcattttcgtaacagtcagcatgccttgaagcgtttgaaactagagtattacatcacaaagaagaaaaggaaccgaaatattcagaacattcagcatatattattaccacacagcgaatcacagttttgctttgcaccgagtaaaattaagaccggaagtgaattacatgaggcgacaccatcaccaatccctctgtaatttgcttcctcagcagctcctgctcctcgatggtctgcggataccatgacggagcaaccttgatcttgggatccaagtcttcgcagcactcgagcaacttcctgtcgtacagggatacatcctctaggttaacagcagcttccatgatgtgcctgatgtatccaaggaagttgtcatttggttggaaaccatagattgtgagtttagtcaggttgtaatgcctgaaaccatcaggtgcagatgactcccactccacgtttgctttttcagagtaaccctgttcttcccgttccaccttgtcggtctgcatcccacaccaatggtcccaaaccgtgacgcgcatctccttcagggagggtgctgcctcgagaaagaagcatgtccaagaaatatcacattcttctgggagttcatccagattcagaacttgcagattccgaagaacaggcgccaacagtttcgggcactctggctgaacccaaatctgcaatacataccagcaataaaggatgtagattaagttgagaatgagggacaaataacctgagagagagagagagagagagagagagagagagagagagagagagagagtcttggttaaactaattaccttttcacttccgaagttgaggtacaggtcgcttatgttggggacattagcaaggaagtgacttaacctgataacctcctgatatctcatggctacattagtgaggcttaggcttgaaagcagcgggacattgccaaaagacaaaggttcatggggacagacccacaaactaaaatccagatgtttgaggtttggtaagtagttgagctcgactaattctaaacttgcatgatagatatcaagctcaacaagtcgtgggtgct

SEQ ID NO: 8704 - DNA, 2944 bp, Oryza sativa
gcaaatctcaactttcccttaggatttatctctaagtaggacaatacacattacaaacctggaatggacaatacacagtttttacccggaggtagtaccattcactaattctaaaggtcttaaaaaagtgagagtgcgatggcaggtgaaaattaacaaccccatactaagcttaaatagtggggtaaatagtaaccgtaggggaaaggataaacgaatatattttttcactgcaccaaaagaatatcagaatattcagaacattcacatacattactccagttactggtccgaaaccaagttgcaggaaacacgatgagtgaaaaaaaagaacccgaatattcagaaaactcaatatgtattactgtatagcaaaaccaagatttacatttttgcgcatagtaaattcagatttaagaccggaagcgaattatatcagaggaagcaatcccgaatccctctgtaattttcctcctcaccaactcctgctgcttgatggtccgcggaaatcttgacagagcaactttgatcttgatcttgggatcaaggtcactgcagcaatcagagaacctcctgtcgtacagggatatcctcactaggttaaccgcggcttccatcatgcacctgatgtatccaacgaagttgtcatcaggttgaaaaccgtagatgatgagcttaaccagattgtgatgcttgaaaccatcaggttgtgagctttgccactccacgtttgttttgtcacggtaacccagttcttccccgttccacgctgtcagtctccatgtcacaccaatggtcccaaactgtgatggacatcttcaggttaggcgctgcctcgaggaagaatcttgtccaagctatatcacatccctcggggagtctatccagattcaaaacccgcagtttctggagaacaggcgccagaagttttgggcactctggcttaacccaaatctgcaaatacaagtaataaaaaaaaaaggaagaatgtggttttaagttaattaagaatgaggaacaaataacctgacctgacaaagatgcttggcttgcttaaagtaattattattaccttttcacttgcgaagctgaggtgcaggttgcttatgttggggacattagcaaggaagtgacttaacctgaaaaccttctgatatcccgcgcttacattgttgaggcttaggcttgaaagcattgggacgttgccaaaagacaagggttctccgggagagacccacataccaaaaaccagccgcttgaggttgggtagagatttgaggtcgactaggtggaaacctgcatcgtaaatgtcaagctcaacaagccgcgggtgttccagctgcagctgcaacacgctatcctctgaatcacacaccgacatgcacagatactgcagccgtttgcatgtggagaggatgttgggaatgtcagcttcagcaagcctcaagttctggatgaagagctgtgtaaggccggcgaatgcatcaagataagaaccaagaaaggtcatgaactgcttcccattacggcggaaatcatcaacggtgtaacactctggctgcagctccgtcaagatgatgaactcgacgctgtcgatttggttgtaggtggccatggcttgggaaacagctttgccgatggtgagacagtcgtagtatttcaagtagaaacatatgctgagtcggtgaagagggacgtcttggcttctgaaactgaggacattgtctgttgcatcagccacggcgctgttggcctgaataagacgaggcaaagagacaaaacgagaaccgttgaagaaggaaccagcacgtcgggggtgttgagacggtccaggatgttgagcaggacatcgtcaggtaacttagagagcctatccactggtagtggtagggaaccagtggatgctgctgatttctgcatcgattgcaaattgcggaaactaaatatattagtggcaggcaccaggcagcgaaccaatgtagtataacttacgaacaaaacacaaaacaaataacgtaaatgtaaactaaactaaattgatgtttttacagcacataacaataataataaatagtttagaagtagtttatcagagacagcatagcaacatccatggatctgacagacaggcgagagagatgcagatggaagaagataggaggcggcggcggcttacgttgcggttgcggcgacttcccttcttgttcttcatggatgacctgaagcgggcgctggtggatgagatcggaatcagatgtgttggcgatcttcttgtgtttcttctatactagtagatatataaatatggatgaaggcgctcggtcggccgggccggatcctatgcgaaattggctctcggacatcgaaatcccccactcccttttcgactgctatttcggcaagtcatatcaagaaactccattgtggagaagaacaagatcagaatcagaccagatcgccgttcgccgttagcggcggcgtgcgttgccgatggcgatgggatttagggtttttcggcctctcggggacgacggcctagtacactttgctgggccgccgatataaatgggcccactcatcctttctccctcagctatggggaaaagtacaccgaaggtcccacaacttgtcatcgggttacaaaatcgtccccacccgcaaaacaaaatactaagatactggaggtccctcaattagcaaaaccgttcgcttgagatcctatgtggttttgaccccggttttgtctgacgttgcggatgagttagcgtggaccccacctgtcagcattgccacatcaatcttctctctcttttcctctcttctctattctttctcatcctcatctctctctctctcctctccgacagcgagtctgtgaggtgggagaggaggagggcgtcggcgaccggcgacgcggcggcggaggaaggggcggcgcgcgggc

SEQ ID NO: 8705 - DNA, 2728 bp, Oryza sativa
ccgcgcctcccctggctgcccgcgagccgccccttccccaccgccgcgtcgccggccgccggccgcctgtcgcagacgccctcctcctctcacgccgcccgcgcgctgcttgtccgccggccgcgcaccgcccctcccccgccgctcgcaatcgcagagaatggagagatagaaagatgagatgggagagaagagaggaaaagagagagaaggctgacgtgcaatgctgacaggtggggcccacgctgactcacccaccacgtcagacaaaaccggggtcaaaaccaccagaggacctcaagcgaacggttttgttagttgagggctccgatatctgattttgcggttgagagacaattttgtaactcgatgacaagttgagggactttcggtgtacttttccctcagctatgacaccccacaactgttagtatgttacaactactagtaatatattaattgatcttcctcagtggtttttaaaggtgatttttgtactatgtgacattattcctataaataattagaccttgtgtagttggcaaaaaaaaatttactcctacgtgtcacatcggatatacggacacacatttgaagtattaaacgttgtctaataacaaaacaaattacatattccgtcaggaaactgcgagacgaatttattaaacctaattaatccgtcattagcaaaagtttattgtaacatcacattgtcaaatcttagcgcaattaggcttaaaagatttgtctcgcaatttacacgcaatctgtataattggtttttttatctacatttaatactccatacatacgtaaaaacgaaaccaggatattcaaaacattcaaaatatattgcttacattatagtatatccaagttactggcctgaaaccaagttgcaggaaacaagagaattctaatgcatgccttgaaacgtttgaaactagagtgtttcgtcacaaaaggaaagaagaagaaaccaaaaatattcagaacattcagcatacattattgctactcagctaatcgcattttcgcgctgatgaattaagaccggaagttaattacatgaggcgatgccatcaccaatccctctgtaatttgcttcctcagcaactcctgctcctcgacggtctgcggatactttgacggagcaaccttgattttgggatccaactcttcacagcaatcttccaccttccggtcgtacagggatatctcctctatgttaaccgcggtttccatgatgtgcctgatgtatcccaaaaagttgtcatcaggttggaaaccgtagatggtgagcttaaccagattgcaatgcctgaaaccatcaggtgaagatgactcccactgcacgtttgttttgtcacagtaaccctcttcttcccgttccaccttgtccgtcacaatattacaccaatggtcccaaattgtgatgcatagctccttcaggaagggtgcagcttcaagaaagaagcgtgttatcacatccttcacggagatcatccagagtcaaaacttgcagattctggagaacaggcgccagcagtttcgggcactctggctgaacccaaatctgtaatacaaacaagtcataaaggaaggatgcaggggttaagttgagaatgagatgttcataacatgatagagagagagacttgcttaaattaattaccctttcacttttgaggttgagatgcaggtctcttatggaggttacattagaaagaaactgacttaatctgataaggttgtgcaatctcagacctacattagtgaggcttaggcttgacagctgcggaacattgccaaaatacaagggttcttggggatgtctccaactattaaagaccagccgttcgagtttcggtagagaattgagcttgactagttttaaacatccgtggcagatatcaagctcaacaagccgctggtgttccacctgcagctgcaacacagtaccctctgtttgacacatgaacatacgcagagactctaatcgtttgcatgtggcaataatattgggaatgtcagtttcagcaagcctcaagttctgtaagtagagtcttgtaagcccagcaaaggcatcagtacaagcaccaaaaaaggtcatgagccgtttcccattgttgcggagaccataaaaagtgtaataatgtagcttataatctgtcagaattctgaactcagcgctgtcaagcttgtgggttgccatggctcgggcaacagctttgccgatggtgagacaatcgtagtattttaagtagaaacatatgctgagttggcgaagagggatctctttggctctgaaattgagaacattgtccgttgcatcggccacggcggcgttcatcacgatagtctccttaaaagtgatataatcaggatctggcgcgaacgaaactactccctccatccaaaaaaaaagtcaaatctgagtttccgtgtccaactttgattgtccgttttatataaaatttttttataattcgtattttcattattgttagataataaaacatgattaatattttatgcgtgacttgtctttttaatttttttttaatttttttaaataagacggatggtaaaacgttggacacggaaaccagggtttgtctttttttttgggacggagcgagtaggccaatttgaaagcgcgaaagcatgtgtcggaggtggagcgtcctcttagagaggaggcaggttctgacggcatcgggggtgt

SEQ ID NO: 8706 - DNA, 4336 bp, Oryza sativa
tttatatactgagaggagaagaagaggaaaagaaggcgcctccgactgaatccgattagaataggaaaatattggacacactcgatgatttttatggcttttcatcgcattcgagactgattcgattgcatgagctgtttatatatacttttttttttggaataaattggttaaaggaatcaatcaacaatagaaactcaatactagtactagtcaccagctgatggatggaggcgtggcgtgtccggatagacttttccaggcgaaggctacggaacgaaaccgattgctaatatggttatgtttagttcaacgtaaagtttgaattttaattgaaattagagataatgtgactaaaaagttatgtgtatgatagattgatgtgatagaaaaggactgaaatttgaatccaaacttcgaatctaaacatagcctatatatacacacacttcagacaaacagttaccagtctttttaccttcatcttcagtaggtcagtaaatattacaaacctggcattgattagattataaacgcctttgatctcgcttgaatctagtaccactgataagagattgaacaccaatctcttggtggtacttgaacaaaacacatttgcttcagctgtgagctggatggcaagttctcttactggacaaagggtggaaaatatttcattgcaccaaatagaaaagggaaaccagaatattcaggatatatattattatgcagcaagcttaaatatgtgctggctaccggcctgaaaccaaggttgcaggaaagaagacaagttcaatcaatgcctttaaacgtttgaaaccagaatatttcataacaaagaaggaaaaggaaccaaaatattcagaacattcagcatatattatttccagtaccacacagcgaatcacagttttgcaccgagcaaaattaagaccggaagtgaattacatgaggcgacgccatcaccaatccctccgtaatttgcttcctcagcagctcctgctccacgatgttctgcggataccttgacggagcaaccttgatcttgggatccaagtcttcacagcactcaagagccttcctgtcgtacagggatatgtcctctaggttaacagcagcttccatgatgtgcctgatgtatccaaggaagttctcatttggttggaaaccatagatggtaaacttagtcaggttgtaatgcctgaaaccatcacgtgcagatgacctccactccaagtttgttttgtcgcagtaaccctgttcttcccgttccaccttgtctgtctcaatctcacaccaatggtcccaaactgtgatgcacatctccttcagggagggtgcggcctcaagaaagaaacttgtccaagcgatatcacattcttcagggagttcatccagattcaaaacttgcagattctggagaacaggcgtcaacagttccgggcactccggatgaacccaaatctgcagtacatatcaataataaaggattcagatttatgtcaagaacaaggaacaaataaccagagaggattgcttaaagtaaattaccttctcacttaagaaattgaggtgcaggtcttttatgaaggtgatattagcaaggaactgacttaacctgataaccttatgccatctcatggctacattagtgaggcttaggcttgaaagcaatggaacgttgccaaaagacaagggttcttggggacaaacccacacactaaaaaccaatcgtttgaggtttggtagggagttgagctcaactaggtctaagttcgcagtggagatatcaagctcaacaaggtgtgggtgttccaactgtagctgcaatacactatcctctatttgacacgcggacaatttcaaatactctagccgtttgcatgtggcgatgatgtttggaatgtcagcttcagcaagccttaagttgcgtaggtggagacgcgtaaggccggcaaatgcatcagtacaggcaccgaaaaatgtcatgagcagcttgccattgtggcggagatcgtcgatagagcaatatagtgcccgcttccctgtcagaataatgaattcaacgctgtcgaggttgtggctgtgggtggccattgctcgggcaacagctttgccaatggcgagacaatcatagtacttgaggtagaaggttatgctgagttggcgaaggggaatctcttggtttctgaaattgaggatgttgtctgttgcatctgacacagcagcattcatctgaatctgaattgcatccttggaggtggcataataaccataataatggggcaaaaaggaatgcagcgaaatgtttaagtttgagagcaaatgtcgaaggtggatcgtcctcttagaaaggaggcatgtcctgacagcgtcgggggtgttgaggcgttcgaggatgttgagcaggacatcatcaggaagcttggtgaacctatccactactagtaggtggttattgtgagctgctgatttctgcatcaatataattttgcgaaacaggattaagcaaatataacaagtaaataggtaaatgcaaaatgaaggaagcgaaagatgaagaaaaaggcttacattgcggttgcggcgactacccttcttattcttcatgatgctgatgatggtgggtggttaattccaacgaggtacggtgtgagtatctagcttggctgatggattggacttccttgttggtttattattgctatatgaaggccaacggcggctcttcctgtcctgtatatacaaggatgaggaggcgtgggcgaggtctggccgacgggcaactactactccatctccgtatcctaaagagaaaatccataaaatgccatcgacaagcaccctaatcctagaaatgccatcgacaaagacaacttcccaaaaatgccattgcacaagcctctttctcccaaaaatgccatcaccgtcaactccacaccgttacaaccgttatttttttaataatgactattttgccccagtgcaaaatatacctagtttttactgtcaaagaaaaaaaatgaaatttctaaccctaaccctaccactaccgatcctgatctagcgctctccccggcggcgtctcggcgacagcggctcggcggcgatcccctactgcggcggcgcggcgaggaggacgatggcggcgacgcgacaggacgcagcgaggaggaccagcgcggcggcggtgcggcaagggcacggcgaggaggactgcagcaaggacgcgacaggacgcagcgaggacaggacggcggcggcgcggcaggacgcggcgaggaggtctacggcggcggcggtccccgacggtggctcgatggctgtcctcgacggtggctatggctcggcggcggtcccttgctgcggcggcgcagcgaggaagaccatggcggcgacgcgataggacgcggcgaggaggactagggcggcgatggcgtggcaggatgcagcgaggaggaccacggcggtgacgaggcaggacgcggcgaggaggtccacggcggtggtggcgcggcagggcgaggtgaggaggtccacggcggcggtggcacggcagggtgcggcgagcatgtccacggcggcgcggctattgcaggatgtggcgcgggggccgtagacgccggcgaggagaggtccgtaggcgccggcgaggagggggaggagaggcctgcagccgcagttgctgaggtccgtggaggaggaagctatagtcctagctggtgttgcaactctgatgttgaaattttccctttgtttgatttgatttgaagactttgtttgatttgatttcagtgaatttaattatgaaataacttgattgatagcaaaataatgatgtttgtgaatttataaactaacagaaatataatttattgtgagcaagcaatgcaaaatgatgatgtgtgagtaaatggttgtctaggggtaagattgtcttttcatgcaacttaacggaaagatgctaacggcagtttgacggtgatggcatttttgggagaaagtggcttgtgcaatggcatttttgggaagttgactttgtcgatggcatttctgggattagagtgtttgtcaatggcatttcatggattttctctatcctaaacggaggaggagggaaaggaggactctgaattggagtccgtctcgtcctagtctggaattggattggaggaggcacaagggcaagtgacgcatggagagagattagggttaaccttgcagagattttgctccggctccggccctaaggtggctgggcggcggatcaggggagacgctggcggccaactccggggtccccagcccggagtaacttagtgggcctatccactgg

SEQ ID NO: 8707 - DNA, 28360 bp, Oryza sativa
  unsure (1)..(28360): unsure at all n locations
cgaaccaatgtagtactagtaatatgctcgtgctaacgctacgataatatttagtaatacaaataaaataatcaaaataccacatatgatatatcttttgtatctcaaatattaaatgagatacatttatgatttaaaaggtagaggtccccaccaacgtcgcaccaagctgacacgcacaaaactaacaagattatacccaaacggcacgacgtcacaaagattacacccaaacggcacgatgttacaagttgggtctccacccacattagttgcaccaaaccaaatactacacatacaaacctggaacggtcatacgtgtcgtatgtccgaacaagaaaaaaacatatctgaacaagtgggtcatgaaccgtgcacgaacattagattaccatgtggcgcttttggcagcacaccatttttaagcaatcctatatgattattcaaaacaattacagtgattcagcccataacttatacagtttgatgatagtatgtggatacgggtcatttcataggaatgtcacaaataacaatgttgtgttacatataatgcgaaatctgtcaaatttcaccaaagattttcacaaggctatttgagtcaagcatctttctaatgttcttttcttgtcttccggccacttttgtttacaacacctctactcggtgcaggactccattcttttttactacatctgtcaaagttaaggaagttaaggggaaaaaaaagatggttaccttgtaacagccactgttacctcgatagtgccatgctgctctggcaaatcgccatggcctccatacagctgctcacaaagattagagaccataatttggccaagctgaaaataataaaaatatgaagtattaaaataataaaaaaaatcaagcactcggtgcagcaactactgaacattattgaaagaaccagcgagaaattctttttggctcaattaaccgaaaaaaatatttgatttcccctgttccacgtgtagtgatattaatttgtagttcagcagcttcagcattagaaagctaaattcaattcttctggcaaccatatgtttaatagaaaacagtgtacttgtttgatatccaatgccaaaaccattgataaataaaaggaaaacagtgtacttgtttgatatccaatgccagaaccattgataaataaaagaaacctgaagcgagctaaattaaaatactgtctggcaaaggatgaaaacagacagattacctagaaatttattgaacaattttaaatactatgtaacataagcaaaatagtaataatcactcatcaacaggtttagccaaaaaaaaaagattagctgtgctcttctgttccaattttttttttctagatttcctgcaaattttagaaaggaatacagccaatgatctgttagtgcaataaaatttgttcagtgtaattcctgatgacctggtaaacaaacagatggtcggcgacgaagtccaccggcggcggaggcagcggcccatcgccatggggacggcagcagctttacttccttcttcattcacctcaatcaccgccttgtggatgacttggctcacaaacaacggcaagccggagccgtcgtcttccaccatcacggataggttggtgagctacggtgagaacggcagccggagccccagctgcccgaggacgccgacgacgctgtcggcgaaggacaccttgaacttgggcaccatgaactcgccaacccgcaccgattcggacgaggtgctcgtgcaggaacccggccgctatgccatcttttccacgatgccacgcagcccgtcgcgtgcgtcggggaggaagatgaccatggcgtactgcgtgaggtcgtcggccgccgcggccgcgcttgcgcttgttacggagattcggcgcgctgtagtggagcttgagcaccttgaacccgtcatgcacggcgacgtactgtttggactttggagttgctcgacgacatgtacgccggcgtcgaggcggtagaacggcttcttcttggtgttcttcaccaatcaccatgaagggatgctcccagctgccctttaggtagatggcgttgctgagcacgatggccatcgtcgggccgacggatcccggcggcaggacggagtcgatgaggcccctcctcacctgtcgcgtccactcgttgatctgcttcctcgcttaatttcccggccttcaagaaaccccaaccaaatcaagaacagtgtacaaaaatttaaaattatgatttgcatcgccctgaattggcatctggatatgattcattgattcatcgtgcagattagtaatggtagatactaaccttgttcttgaaatcgacggtggtggcctcggccttgtacctgccgacgacggcgtcgcaccacacgccggacgtgaacgcgacgcgcggcccacccgacgccgacctgtcggccagcgcggtggtcgccatgtagaacggcgaggagctcatccagagtgcagcaatgggcgaggggaggcggagcgatctaggcaccgcggtttgccggaaggagagcgcgtggcggcgtggggggcgtgattttcggctcaggagcgatggtttctgcgagtgggggatgcgagaggaggttgaggcgtacgtgggacgatttgaggcgttggattggatgattctggaccgttggatttgatgaatgagtaatgtaggtgtaagagtgtgttggtgaattatagggtagataacgaacgaacaaaacacaaaactaaattgatgtttttacagctagcaatgacaataaataatgatactatatatatatcacagtataagattggcggcggcggcttacattgcgattacggcggctacccttcttgttcttcatggatgatacacccttgttcttgttgcgtattcaatccgatggatcggtgtgagtattaagactctcctcctcttcctctcgatcagtcggcccggatcctatgcgaactcgtacatggatcgatcgagacagaagtcacctcccttaccttccctttttcgagatcaaatctgatgccaatgaaacagcacacagctatacctctgtttttttttcttttattcccctcgagtactacgggttctgttttgaacgtttggaaattggaactgatgaagtagggtacggtagggtgtatggataaagtaaggaaagacaggccggccctaaactttgggaggcccattggaagcggcggcccagatgagagcagatcccctgtcacgccgacgccgccgccgccaccgctgttgccctaacgccgatctaatgctggagctccattcgcttgttcttatactatacaagtacctatgccggtgatgtatagctgctgctgctggtgcttggattcggttgaatttcataggtatggtcggtcagctggaatagcagtcggtgtgggtatatatgtagcctagttcgcatcgggcggaagctgggaagggaagatctagttcgcatcggagccggaatcgaatcctcccttcttttcctcttctcctctccatcatcagtatataaacaatacgcgcagcgcttgtccggtcaggcccgccgccgttcagaagcttaacattggaattggattttattaaccaccatgaagaacaagaagggtagtcgccgcaaccgcaatgtaagtctcttttctttcccttccttaattaattaattaatttgcattattattattgcataataataatatctgcctttcctgtcgatccatgaattaatttcgatgcagaaatcagctcccgtaaccgtaatggtggtggataggttcaccacgctacctgacgatgttctgctcaacatcctggaccgcctcaacacgcccgacgccgtcaggacctgcctcctctctaagaggacgctccacctcccacgcatgctttcgcactttcgaattgccctactttcattcgcgccagatcctgattatatcacttttaaggacactattgggatgaacgccgccgtggccgctgcaacagataatgttctcaatttcagagccaaagacatccctcttcgccaactcagcatatgtttctacttgaaatactacgactgtcttaccatcggcaaagctgttgcccgagccatgacaacccacaagcttgacagcgctgagttcagaattctgaccgattataagctacattattacactcttgatggtctccgcaacaatgggaaacagctcatgaccttttttggtgcttgtactgatgcatttgctggacttacaagactctacctacagaacttaaggcttcctgaaactgacattctcaatatcattgccacatgcaaacggttagagtctctgcgtatgttcatgtgtcaaacagagggtactgtgttgcagctgcagctagaacaccagcggcttgttgagcttgatatctgccacggatgtttaaaactagttaagctcaattctctaccaaaacttgaacggctggtcttttatagttggaaacatccccaagaacccttgtattttggcaatgttccgcagctgtcaagcctaagcctcactaatgtaggtctgagacggcacaaccttatcagattaagtcagtttctttctaatgtaacctccataagagacctgcacctcaactttgaaagcgaaagggtaattaaattcaagcaagcctctctctctctctctctcaggttattaacacctcatactcatcttaacctgcatccttcctttatgacttgtttgtattacagatttgggttcagccagagcgcccgaaactgctggtgcctgttctccagaatcttcaagttttgaatctggaggatctccctgaaggatgtgatatcacatggacacgcttctttcttgaagctgcacccttcctgaaggagctatgcatcacagtttgggaccattggtgtaatattgtgacagaccaggtggaacgggaagaagagggttactgtgacaaaacaaacgtgcagtgggagtcatcttcatctaatggtttcaggcattacaatctggttaagctcaccatctatggtttccaaccagatgacaactttttgggatacatcaggcacatcatggaaaccgcggttaacctagaggagatatccctgtacaacaggaaggtggaagattgctgtgaagagttggatcccaagatcaaaattgctccgtcaaggtatccacagaccattgaggagcaggagttgctgaggaagcaaattacagagggattggtgatggcgttgcctcatgtaattcacttccggtcttaattcctcggcgcaaaaatgcaattagctgagtagcaataatgtatgctgaatgttctgaatattttggtttcttcttctttccttttgtgatgaaacactctagtttcaaacgtttcaaggcatgcattagaattctcttgtttcctgcaacttggtttcaggcagcagcctggatatataatgtaagcagtatattttgaatgttttgaatatcctggtttcttttttttgttgttgcaataattccccttatccttttccctacaactacaagagagcttgccatccagctcacaggtgaggcattgttttgttgaagtaccatcaaggaattggtgttcaatctcttattagtggcactagatacgtttggagaatccatgccctggtacaggcaatggagtttatcttccggcattcctttgcgaacaaaggaggcatatttctgtttcttcagtctcaagatgctactcattgatgcctctgttccaggcgcatcattcctagagatcttgccagtggtcagatttctccctccctgtttaattaagagaagttctactcagtggctgcagggagatttggcaggaaatggagaccagactcctcagttgaggactacaatggtacatcgaaaacaaaggatttgagaacaggcagaggagatacagaacagggaggttttgggtgctgtgaggatcagaggaggcgtcacaagtcgaggggcgaatctttgtttaccaataaaaggttatgctttcatttatcttccattgttatctatttccttgtaggtagagatgcgaatgcgagttccaaggagtgctgtcccaaatacctgtgacttcaattatacagttttagaagttatgtttttatctaacttcaattgtgcttgcagttttagaagataatgcttcacaataagaagatagttgacacactagagggtaacattttatagccccccccccctaacattgaagtgggtgtttcacttaatatcttgccctgtatgtttgaaaagggaggtggatgatagccatgtttgataattgattgagcgcattctaacgaaaatatacatgaatagataaaaatacccactgccgtagattgatgcttagacactttgttaatttgaaattgccatagagagcttatattgatcgagttaaacagcatgcagctacaatttttgtcccaactttttctgctttatgaactcctaagttgaagaaagttggtttccatggtaaacttagtggataaccgagacttgaacttattcattaccttacattgtgattgacacttgagctgttcaatatattttgcttattccattttatactatgtatctctgggagaactattcggctaatttagttttattttcctttttagctgttatggcaaatgcaattctcatcaatatctttatattttattgatggttgacgacagactttgttcaaacacattgttgaaaccctatttaactattcgctctctcttggtagggaatcattgtgatatcatccaaacagttcaaatttgacctttgcattgcagccacatgcaattaggagctagcgatcaacatgcaaatacttagctggcatcactgtaatgattataagttcaaataaatatgaatcactgctttgagcttcaatttgttgttcactgacagtttctttacactatcttctctaaatatatctattctgtacttctattacagcttgtgatgtctgcgataacctgaaagtgctttgtcagagttgagccaggctaagccatcaataatggctcaggtattaaattaaaaatttattactcaaactctcatggatctgttgacataatccaaaactgttttgagaaataagaacccattcttcgtagttttcttgtcttcatgcaacactgaagctgtgaaggaggtgccaattgttctgaagctcctatatgatcgggatgccctggatgaagggtcaaggagtccctggttatgaagaatgccaagccaattcatggagtggctccggagtgtggagtatttccagttcgtgtcatcgtgtgtgattgtcccaaagtcataagtactagagcctggggcgcgcccgttggcgcgccgcctgagtggaacattggtgaagaggcagtggatgattaagcctgagtggaatgatggtgaagaggcagtggatgattagggatatagatgggaggaaagaataagcaagttttggttaaaaaaaataagaaagcaggcactcatagagaagcaaactgcagctaataagatatagacatcttaatacttagtggtctctagtagtaataggcacatatacagatggtctttaacatctgcaaggtagtgcagtatggatggtaagcacttatggtcccaatgacgcatatccaatttcatcacttgtcgcacggcacaatgggctcatcttaaattaaatttgaatatatcaatacacttctaatataaaatttaaacaattgaccagaatggtgttaggatctcaagtttttattgtcgagaccgctcatgttcagaattcaggtatgcactactaatttcgtactaacaaatgaatcaactctatgtaattgtttttcagtactgtataaatcaacatttatgctcacattcttctgaaaaatgtatacccacttcttcaatattatgtccaaacaaagggaaaagaaaaggaccggcttattctcagtctatcctgctgtcaatccttcatcagatgcatgttatgttctcacttccttccaatcttgccttgcccattgtgatctactgatctgtaaggctgtgagaacctttcaagagagctattgcctgcacaacatacatatgaaccaatttttcattagttcctgggcccgtgaaaactgagtccatctggtcagaaagaggtgctccaaattgcatcatccccttccttcatcttgagtgcgcataagcttgctagctggattacaaaccactccacactgcacctctaattgttttccaccgaccgcatggttgcttgtttcataaagaaaatgttagcagttggtttggtattatagtgatcttcagaaatggtatagggtatacaaagcaacggaagaaaactgatgtggtggtgttccattgcgcatatctgtcattgatgcttcaatatttacactgcccaagttatagaccacctcaatttcttaaatggagaacaaccccaaagcatgttgcttgactgctattattactgaaggcatgtattttttaagggatatattttttacacggtgttcaataacatactttgaacctattattacttaaggcatgtattttttaagggatatattttttacacggtgttcaataacatactttgaacctattattactgaaggcatgtattttttaagggatatattttttacacggtgttcaataacatactttgaccattaatttattccatgttatgctcccaatgaatatgaaattagcatcatatgaaaggacttcaaagtatgaatatcacgagcttgcaaataagcagagtggtagctaaagcgacaacccacaaaaaagatcaatgttgcagtgctgatcaatttattttcactccttgctgcgaatcatctaaaaacctggactactgtcatattacctgaagatgaattattgcgagctgaacatggaaaattctggtatgcaatccaaaggtgtcaaacctgacatgaaaaaggaaaatgatcagatcaccaaagaggctcatcataccataccatcctcaatcttaagtcaaccaaactcatattatttgcaattgactgaaacctccgcatgaattcattattttcgtctctcttttccttatgtctatcaagaaaccatcagtgacccattgcagtcccatttaaagtatttaacatttaagaaaacattcagtacagtaaaatggaagattgagatttgcatcttctgaatattagtgccaaatataaacccatcctgctaccagttgtactaaaaaaaattgactgccaataaccaaaatgctaactactaaaaaaatcatccagtatgtgaagctcctaaatttttccttatgctactttgtaaaactatagtacagagtttctggcaagaaaattggttcccaggtcatccactcatgatggatcagcaagcaatatcactgcagtctcattttccagacaaaaaatatagtgttaggaactcatggagttgattttgtaagatgcagatgagcaacattcagccatcatacagtaataaatcgaaagaaactaagatttacgttgttaaagaagataaccttggatgaatcctaattcaatcataacaaagccaagaatcataatccagtcttaatgaagccaagaatcctaattcccagtgtaccttggatatgagattgatgtcaatggaggtgcgagcaacagtcgacatagtagttgaccctagttccgaggcacgcactatattgccaaaaatagaacatagacaaattacttcttcaaattgcagtgaaaattcatgcattattcattagagggtaaattaccattgattcagagatggcgatcgttgccatttgttcattttagtctatgaatcattgtgttcattttaaactacaagaaccgcatgtggagggagtgaaggggcttgtgcttcagaataattttgatgtgtttcgtgttgaattgaatcttatttaaccctagcagtggtggattgagcttggacttttgggggctacgaacaaacaaaacaagagaagagcttcatccagatgtagaagagaaggtaggcttaatgcaagcaaatttgagacaaaagtaggtgtgagagagagagatgaatcacagaatcagaaagaggatgtggatgctcaccgggatgcagcaggaccacggcgcccctcccctcccctgctgtgctctgcttaccgctgacattgccaccagcttcggcttctttttcggccttggctccagctgcggccactctcacgtcgtcctcctgtggatggactccaacctcgccccgttgatcgttgcgagatgtttccttaacaatagattatatgtgctttctgccttatggagcagaaattataagccagcagacagcaagcaaatataccatgtcaagtaaataaatggatcagttaattgatatcattgacacattcaagaggacaaacttacagggttgtgcatctcttcacttaaaccaaaattttccagaatagaagcaaccaatgtggagaaatagtgtacagcataggagccaacccctacctgaacatcggaataccaatgatatgtgatgtaaccagaactaattgcaatttcctgaagagtgtgccaacacaatttataccagaaagttgtgggcatatggaacttaccgcagatccataaattgtgaggtaaaataaacttttccttcccattggtaacaatttcatcccctataatgaataataggtcacaccaacaatcaatttgatagaacacatttttccataagcaaaaaaaaatcctagttaaaattgagtcactgaacgttccttatcaaaagaaaatggtcttacttcttggtcttcccacacagtttagagttgcctcatggtgtattttacaacaaactaacagaattacaacgaaaactatcttcgctaattagatcaagagatttctatgtttagaatggaaattctataaataaactcagagtgaggtgtttaataacaaaatacagtaagttaacttaacaatttcatatacttaataataagcttgatggaagttcccaataacaaaatgcagtcagttaacttaacaatgttgtctgctgataagtaatcaattagaccatcatgttatgtagaagactgtcaaaaaaacacagaaaaaaaataataataggacattggaaccataaaattttaagatacaaacttacaaggggattatgaaacaaaacaaatatgcgaaccatacgaaaatccaagtgttgcgctaaaaggaatatgtaaataaaaggactatacacgaaaagaagttcataccaagcacagagatgaatcgaaacaaagtgggtacggtctagctattaagagatgttattcaggtaaaaatcatccatctgtatacttcgtaaaacgggaatacttatccttcaaccaaaaaggccgaaaccaccatatacaaaacaaattttgagacattaccgaaatgcattggttttgaagtgaaaggaaaggcatgtcactgcagatttattcacggcaaaagagttgcaactttccaatcacccctccacaaacccactccaaaacccaattctatgactaaaccccaagaatacctaaaataccaagatgctatcagacgcatcttacagcaaaaaccccaaaccaccccaaaggccctaaaccctagatagaacggcgctacgatccccgtgcaaacgcagcagcagtcccaaatccgcccatggtgcaccaaactgcgggcacgattatacctttgatggaccgccccacgatggtggaatcgaaggccgcagtgtcatcgccggtggagatgatgatgggcgcggcgagcgaggctaggagcaggagcggatttgggaaatcccatgatacataagcgttacaagtaaataatgatttacacagtacagcaagcagtgcaatggtttctacaaatataaccgaattttaatttcataggcaaatgaaagacaagcataaattctacaatgtcagataattcaaattgtattgtcatgctccactaactaatgattttaatggaagaatgttgaaaaaaaagtaataagatttctgccagaaaatataagtttcagttcagtacaaaccacccataccaagagaatagcaccagttttgaatgatccaagtgatagcatctcaattccctgtaagataaagagaatcagtaggtttatctccaagaagtttgggaggaaaacagaacatatttgtgaagctcttgaaccatagtcatttcaataatgcatattaaccttatatctcaagataagacaagagcatacctgaatgcagaaagcaatccccaaaacattgtttgctagccaatgcttcttcgcagaataccatatgcaaaagaaaaatcctgggattgatgtaacaacttgagacttggtaaactccactgagagcgctgaaataagaaattaatgaacttaaaagggccaccaagacataagcttgtaacatgattcatgattgcaccaatctgacagatacacatgcaacaatctgacatatgatacacaattgcaccgatgattgagcatttaaaaaaaaagaggtttgggtcctacagacatacagtggaaaaatgcatcatgctgaacgatgaaattatcattccattcttttggaagaaatcatttcatggaaggcagcaatgttgcactgcatcagaaaaaaaaaagcacataaacaatcttaattgcacaaatacaatattacgtagttacatgaatggaaaagctactatatcatccaacctgccagcttttgtgtacatcattgattcattttcctaatgatctgcaacaacaacggtgaaaaaaatgattatagagatttggtgggggcaattagatgagatgaaggaaggggatattagatataaggatgtaccgtgaataaggcactactggaactcgccttcgatttagcacaacactaatgaggtaaattagaacatggacaaccagacaactaccctacccctgcatcagaaatatgaagctgcacagatgagcttttatctcagctgtcataagcagtgaagaaaatcaagcaaaacttgtaattgtaccaatgagtgagatggacagatggttgcacctcattaaaaataaaaaggcccaaacctcctgtccccacctgatgctggcctcctcccttgttccccatcacatcgctccagccgctgctgccatctctcccgcgcaacatgatcagaaatccggccaccctcactgcatgcaaaattgaagctcatcagaaacgactctgtgcaacaaagaacaaccaagcaactcctctgagcacagccttgccacctcttaattatcagtgcatagtgatgtacacattcatgaaacaaaaaaaatatccacagctagagaaacacgcaacctttgatcgtgcgaacacgataaaggatcagtcattttgtgcacctccattatcctcatatactgtgaataatagaacccgtacaaattgggatcgtgctgcatcagtaaagaatcggggatgagaggagatttcttcctgtaacttaccgagatggccactgggaagagccttggggatggggcttggacgccgccagccacctgcctcatgaccgctatgagcagcggaagcagcagggcgaggaaccgccaccaaggttgagcggccattgctgtcgccgattgaaccggtaatttttttctctgttgtgaaagggatgaacaccgcggcaaagacaaggggaaggaggatctgagacccttagcctccctgttgcagccgattcatccccttgtcatcgttgacaatggcggcaagctgctcaaggagagctcgattctgtgtccgctagatcaaccacaagcaaaagtcagtattgcttgagatcacaacacaaaatcatcatagctgcacaaaagacaaagattggcatcgattaccttggcccttggggcgaggcagcccatgagagtggcagcggcattgccggcgttgttctcctcaataaaactgattgtggagttcattacgagcagtgtgatgatgcccacgaagtcctgccagcccggcagcttccctgaaaacaccaaacaaatcaaccctcgtcaattcaatcaaacctctcacaatccctcacatgccatgctctggaacatcatgattcattaaattcattactacttactcctccattggcaagagcgatggccatgatcgccgcggcctccatgacccaggacagcgggttccacatgaacctcaagaacttgctttcctgcacacacacacacacacaaacaaacatgaaaaaaaactctgcaccatcgaatcgattcctaaacagaacaagaaactttagtgatggatgcctgggttagcctccaaacataaaggccattactatgaaagagctgcaagagagaaagcagttgcgggtggtcccagaaggcttggattgcacagattctaccagaggatgttgagatgctcccattgcaactcactgatggagaagaactggagagctcagctagagctggaggaggtggtagtaccagttccctactggtaccagtggtggcttgatcacttcaaattggagggactattgggccaaattcctctactgaatcttgggagagaaactacggattgggtgggtcaccttcttctccttgagcttgttggggccgaagaggttgaggcactgctcggcattggtggaggtgagccagccggagacggcgatcgacagcgacgacggcagtggcaccgcgaggcggaggaggccggcgagagcaggaggtggcaccgcgatgggcaggcggcggcgccgtcggcgtcggcgtcggcgggggtggagaagagtgttcgcctcctccctttctccatgttcacctcgaagcccacgctcggcggaaaggcgtcggagcgaggggaaggcagaggtgaaggcagtcggagactgcgacacgacggcggcgtcggtggaggtggaagcggcggcgcgagggcgaggcagatgtggacgcggtggcgcgaggcgacggcggaagtggcggcgctcgacggcgacggcgacgacggtggcggaggaggggaggcgggcgacagcggctagggttaggggtgagtggaccggcggcggaggaggaggatggttgagggagagggagagagaggaggagcggcggcggcgttcggcggcggcgcgagggggaggcggtggcggcgcgagactgcggcggcggcggtggcgcgaggcaaggcaggagagggagagggcgagacgggagcggggaggggaggggatgcaggcggcggcggctagggtttgggttagtgcgggtagtttagcgaaaagcccctcaagttttaagttttacagcgcggtcctaactcgcgtactttccttacttctcatgtaatatccatattttttaagggtctttacgaaaaataacacctcacaagtactattctcgggggactgcggacgaattacgcgtgaaccagagggctttcgcaaaaaaatacagtagaaatcctacgtggatacgcccagaactcaccccatccgccacacttaatagtctctaatttccagtctgtttgtgtgcgtttcttatcttatgagtaatgttggtcaatacagccagacagtcctgggaccggattatgtggtgccatatctcctggcggttgactttttatctatcgaattgttttactcctgaatctggtggagtatgtgtgaatggttaatacccgaatctcgtgtactttaggttcacaagaaaatattgatgacaagagcacaagattgacgtgtttctgcagtactaaaacttgtttttgggtaaccaggaggagcagcgaagcaaatctttttcggttccctggctatactcgtggagtgcaattgtaaaacacaaccgcaaaccaaacctttgaaacaaccaaaacacacagattccagggcacatcccaccagccaaggacaagtagctgtgcccttcgaaccacatcagaaaactagcaatcccaaacggagcaggacatcaacatatttccagagttgcaaaaaaagcagtatcacatacagcagcgaaatagcgtatggttcaaatgattgttactgctgctgaattgtcttcgtgggtaaccgagtggcgtggttcagctaagtcgctaccttatagttacaacttaggtatgttcaaaactcaaccacatagaacaaaaaacgtccctactacaagcggttcaaaattacttggccccacggccacgggcccttccaccagctttgacgcctttcttctggctcatgtatgcctttcccatcttccctttaccttcagctgaaaatattggtcgtacagtgaagagtaaatgagacacctagtagttaattagggggataaaaaccaagataaaataaattatagttgcatttaacaagcgaggtcaaattcagagtcctcaatcagtaatggcattcacaacatgaaaacatttcattggtccaattgtacagtgtgaagagtaaatgagacgcctagtagttaattagggggaaaaaccaagatacaataaattatagttgcatttaactgtgaggtcaaattcagagtcctcaatcagtaatggcattgacaacatgaaaacatttcaacacaaaacaggagaatgatgtccaaacattaaactaaaatttctataaaatggctgcatgtgcttagaatataaaaaaaccagcacatgaagatatatctataattctatataactagaagacactccagatagaaacaacagagaacatgaagatatatctataattctatttaactagaagacactccagatagaaacaacagagattaaaaaataaaatgttgttgaacccaatgaccaagttaactgttcacaacatgacaagttgaaaatttgaccagtttactattcccttcatccaaaagcttaaaacctattccttttgtcacgaataactcatccgtcatgtgacaaaaccaatgaaccattgacatacatgcagccaataagactattccttttgtcacgaacactaaggtaacccattcgacaaaacaaatgaactatatacataaatacagaccaatagatagcttcacaaacacagtgacttaacacagttaggcttattgaggaaaggcagcagcgtaccacccagagcggaggcctggtccctcctggccaccagaggatcgtcgaaatacccaactgcatgcaaataaacagtatgaggcacaccacaacgaagcaaaggtcatgtaagcaacgaggcacaggtcaggtaagcagtgcaaagaacttaccggagggcatggggtagacgatgaatgcgaaaccggacttagtcccgacgagcgctcctttgcggtagcgcgtgaacttgttctcgaacatgacctcctctgtgtcctcctccttggtggccatggcttccctgcaagtatcaaaaaagaaaaatcaaatcaaatcagtactaaaatgcatgagatccaaatccacgcccaccaaaacgcaatagcatacgagaaatcggcaagcaagagatccaaatccgcaccaaccaaagcaacaaatccgcacgagaaacaaacaaatcggcaagcaagagatccaaatccgcacccaccaaaagcaacaaatccgcacgagaaacagcaaatcggcgagcaaaagactagggagatccaagtcgcgaataccacttaaactcacagggaaacggatctgcaataacgaagaagcggaggccgaggacgagagacacacacagtgaaggcggcggcggcggcggaaggtggagaaatgatgctggtcgttccttttatacctataaaacctgggccggcccaaacctagtgcctcgtcttttgccttatgtttttatgtttgtaagccaaaatttaaattttctatcttaaatttaggccatgtttggttctataaaagttttactgttttcgagcactttttgctataatagatctaaacactagagttgattttagggttctttcatcgtagcttatttttcagcatttgcttttatatcgttaaaaacacgtatgtaaaaaatttatttataaattattttccgtttgcaaatatgccgtcaataagcagaacgatagagtcctaatatagttttgcgttgaataaaaaagaacatgttgcaccaaatattgaaaaaacaaaaaagaaaggaacatggatcaatggatggatagaacaccaaccaatctcgatagtacccgtaatatatcatttgatctctaatctaacaaagtctcgtgatcaaataacatatcatttgatcagagacgactttgtaagattggagtggaggcgcgaacgaggtccggcgccgccgcgcagatcgatgacgccggcggacggtggacgactgcggcggacgaatgaatcgagacaacttctcttctccatgatggatcgtggatgaatggatggacggactgaccgagtatatatagagccttcaatttggtgccttgtatatcgggtccccgtaacggaaattgaccatttaattcattctatttatttcaattcggtgccttatatattgggtcccagtaacggaaattgaccatttaattcattctatttattcgtatgccaaatcaaatcttcactaactaatttctttccttgtttcccagtaacggagtagtattgttattaaaacaccgcaatcagcgccacccaatcacaattaacaacacctacttataaggagtaccatagttgggctaacggcttggcccatggcccgtgtacgtacgcttagtacagatctgacaaattcgatatttctggcttagtaagttaaggctgcatttgatcatgcatattagaggttagtttttaggacgtgaaaccaaaaaactcattagcacttaattagttaagtattaataaatttttaaaaagatttattagatttttaaaacaacttctatgtagactttttattttgcaaattacgcaccatttaatattttgaaatatgtgctaacggagaaggagagagctgacgtttgaagttggagaaaagaagcatgcaatggtcattaatacatgtctcttagtcttactattaattaggaaaatatttcttcggtagaaaagacacaagaataggaaaggcaaacatcggttcaacattaactcttattttatataaaatgaaaatatggttgcacgaggatgaaaaaaaaataaaaaatagtaacaaaatatatatttttccatttaatgattacaatctctatatatgatctctaaatagggtgtgtttagttcacgctaaaattggaagtttggttgaaattggaacgatgtgatggaaaagttggaagtttatgtgtgtaggaaagtttatatatgtagaaaaattttgatgtgatggaaaagttgaaagtttaaagaaaaagtttggaactaaacaaggccataatcttgttcttatctctactttccaactcacctacctcgttttctgcgcgcaggctttgcaaactgctaaaggtgtgtgtgtgtatatataaaagttactataaaaatcatattaaccctttttcaaatttattttagctaatacttaattaatcatgcattaaacgctgcttcgctttgcgtgctagggacgatcacacccttaaacatgccctaatagcattcaacgaaataaaaaacttccttaaatttatcagtaatgcagtatatttttggccatgtatgtacaacaataacaataacaataatatgcctatatacggccggcacagctacgtacatactcccctcattttaaattaaaccaacctagaaaatgatttagtctgtgtattttaggttgatttattttaatattgaggaaatatgataagtagtactcccatattagggccgtgtttagttctttttcaattttttttaaagtatacggatatacatttgaattattaaacataggctaataacaaaacaacttacagattccgcatgtaaacggcgagacgaatctattaagcctaattaatccatcattagcaaatatttactgtagcaccacattgtcaaatcataacgtaattaggctcaaaagattcgtctcgtaatttacatgcaaactgtgcaattggttttttcgtctacatttaatgctccatgcatatgtccaaacatttgatgtgatagaatttttagaagtttgaagtgaactagtttagtttcacaccaaaattagaagtttgaagaaattgaaacgatgtgattgaaaagttaaaagtttgaagaaaaaagttggaatctaaacaataccctatgtgagtgtgacacatctaatatgcaatcaagatagatcgaaaagacagctacagtcaaaaacaggcaacagggcagtttcttcagtcagatatgatcgacgatggcagatgaccagatgtattgcgagcagaatttagagtgtgtttagttcacattaaaattgaaattttggttaaaattggaacgatgtgacggaaaatttagaaatttatatgtgtagaaaagttttaatatgatggaaaagttgaaagtttgaagaaaaagtttggatctaaactcgaccttagaatgacatcagtatatgaagtgtactacatacctttaccactagtaggctgtgtttagttcagcacaaagtttagattttgtttgaaattggagatgatgtgactgaaaagttacgtgtgtatgacaggttgatgtgatggatgtcacaccctgaagttctcctcccaagcttaaaattaaatttataaatgaccctaagaaaataccggtgcaaatcaagataaaaccctaagaaagtaatacaaataatacccgcgccggtcaccactcccgaaaccgctgccgccgcgccccacctcccccgctttccccgcgcccacgccgcgtcgcctgcgcccactccacatcgccgccccctctccccgcgtctcccggccgcgcctgcgcacgagaggggcgggattcaattttgaatcccctcccatcttctctctctccttccccacgtcgccggcgaaatcggagtatgacttgctgagtacagtggatagtactcagtcttgctctatttttcccccaaccccagagtacgagtatgtgtccgatggtgggttcttcgaggagtaggcttcatccgtgcagtcgaggatgcctatggagtgatgttcccgctgcagtttaagtcaaggcttagctcctgttacctttctttttcccgctgcatttatgtaagacttttataatgtttgtaagacgtggatctgtatgtcaacattgtcgtttgtgtaccccggccggtcctggacgggggttttaatgcatattctgcttggaattctattcgggaatttctgggcgtgacaagttggtatcagagccgaccttgaccgtaggacaagccaaatggaaaacctaagagccctctgaattcttttcattgcataagttctttgcaattggatttgttccaggaaaatttgggatctgttctcgtggttcaagggaaaaaaatcttgtcgctcgtttaagggaggtttgccaaaacaagtcggtctagggttttagtaaaattatttgagatgttttgaccgtcagtcgggattggatgggatttgatgggcgaaatgcattagttcttagctcaggaatatgagttgtaaggtatttatgcttttattgttattataagtatgtatctaatttccccattatcttatcgctatgtaagtccgtcttatttattcgctctcatgcaaaataatctatgcataaaatttcgctcttattcgattctcttatttgagtcctttattgctttatttaatttggatttgagcatgcattgatcctacccctttgtcttctctagatggccgagcacccacccaaccaccgcggagaaggcatggatgacttcgtggcagagttggcacgcatgacactggtggtgggctaccccaacgcgccggagtacacgactgttccaccgctcagtggcgagcttcctcaccgtgtccgcttggaggtccatggttacgtggggacttgcctcgctaacatggtggtcgaggcgtctggagccacagcagatcacgcatgtcaggaggcagcatatctgatgatggccagactgcgggagcgccacaactacatcttccacaacacggtgtaccgtttccaccctcgtcgagccaacgacagtgatgtcagttccttccgtccgacagccggcgagaacgacaccaccttcagtcacgtgcgctgtgatgagggggatggacaggatgcactcggacctgcacaaggcgtccaaggccttgaatgatgggaagctcatgaggatcgtcgctctgaaggacgagatagcgcgcctgaagagggagaatgctcagttgaagggtcttcccgcgccaggaggagtccagatccgcaccacgcctcgcaagtcgacaacggcacccgtgcgcatccagcttgcgcccaggaacccacctccgtcagcagctcccgcagcacctccagttccgcccgcagctccagcagttcctacagctccagcgccagccccagctcctgttcccgtgtcagctccagcatccgctctctccttcgcacctgcatcagccgtcaggggccccgccagtggcaatgggggttggttgcctgctactcccagtggcagtcgcgaccgcagcagcagcagctccagtggcatagagccgggcagcggcgagacttatctgccaggctccaggagtcgctcagaggacctggtgacgagcaggaggacgccttcaacttcaccgaccgcaggagccgttccgagcattaggctcgttttccattagcttatcgactgtctagcttctgcttgttagtttgtgtgtttaggttgcttgcttggggtcagttgacagtcgatatcatgtgcctatgatatggctgtcttaataaggatttttgcttgctgtttaaagtattttaattcagattagaacaattgcagtttaaatttctatataataaagcttagttcctgagtatctgtttttctccgtttccccgtctgctcttcctccagatggtctacaccaggactggcacccgcacgacaggcgagggcagcaacggcgaagaacgcgctgatggtgtgcaccccaacagtgattccggcaatggtccgccaccacttcccgagaatccgacgctagcccaagttatggcacatcagactcagatgatggcagccatgatgcagcagatgcagcagcagcaccagcagatgcaccagaggatgctgcagcacgctgaacagcagcaccggcagtttggtccccctccccctcagtccaagttgccagagtttctacgtgtcaggccacccaccttctccagcaccaccaaccccatggaggcgaatgactggctccatgccatagagaagaagctgaatctcctgcagtgcaatgatcaggagaaggtcgctttcgccacacaccagcttcaaggtcctgcgtcagcttggtgggacaatcacatggccacccgcccgccaggcactgaagtcacttgggcggagttctgtcgtagcttcaggaaggcacaggtgccagacggggtcgtggcacaaaagaagagggaattccgggcgctccatcagggcaataggacagtgacagagtacctccatgagttcaatcgcctcgcgcgatatgcaccggaggatgtccgcactgacgccgagaagcaggaaaagttcatggcaggtctggatgacgagctgaccaaccaactgatatctggggactacgctgattttgaaagactggttgacaaggcaatccgtcaggaggatcagcgcaacaaaatggacaggaagagaaaggcggcacagttccggtccaaccaaggaaaccatcagcgaccgcgtttcactcccggacagcagggtggacctaccaccatgatcgtccgccagcaccgcccgttcaactccagcaacttccaccagggcgctagtggcagtcagaaccaccatggaggtcagcctaaccgcggtgcagctccacgcccaccagtggcaccagcacaatcaggcccgtccgcacaagctaaggagaccgaagccaaacctgggtcctgtttcaactgtggtgagcttggccacttcgccgacaaatgcccgaagcccaggcgtgccgggccaaggtttgtctaggctcgtgtcaaccacgcgtctacagaggaggcgcaagcagcaccagaggtcgtactgggtacgttccctgttaactcaatccctgcaacagtactttttgattctggtgcaacgcattctttcatttcaaagaaatttgtggggatgcatgggttaaggaaagaagagcttagtacaccaatgagggttcataccccaggaaatagttcaacctcagtcaattttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccttgaccaacgagaagggagaaaccgtggtgtacaaatcactagtctcaccaaagcaaggggtctccttgaatcagatcgagatggaaatcccagtggtcaccgaggagaagaattcgaggaagttggaagagattcctatagtctgcgagtacccagaagtgtttcccgaagatctcactaccatgccacccaagcgaaagattgaattccggattgatttggcaccgggaaccgcgccaatttacaagagaccgtacaggatggcggccaacgaattagcagaggtcaagaagcaggttgatgagcaactgcagaaagggtacattcgaccgagtacttcaccttggggtgctccggtcatttttgtggagaaaaaggataagacgaaaaggatgtgcgttgattatcgcgcactcaacgaggtcacaatcaagaataaatatcatttaccgcggatcgatgatttgtttgatcaactgaagggagctaaggtgttctctaagatagacctgcgatcaggctaccactagttaaggatccgggaagaggatattccaaagacggctttcaccactcgatacgggctgtatgagtgcacggttatgtctttcggacttaccaacgcacccgcattcttcatgaatctgatgaacaaagtgttcatggaatttctcgacaagtttgttgtggttttcatcgacgacattcttatctattcaaagtctgaagaggaacatgagcagcatcttcgtctggtactcgagaagttgaaggagcaccaattatacgccaagttcagcaagtgtgacttctggttgacagaagtcaaatttctgggtcatgttattacagctcagggtgtggcagttgatccatcgaacgtggagtcagttaccaaatggaccccaccgaagaccgtgtcgcagattcgaagttttcttggacttgctggttattaccgccgattcatcgaaaacttctccaggatcgcccgacccatgactcagttgcttaagaaagatgagaagtttaaatggacagctgagtgcgataagagctttgaggagctcaagaagaaattagtatccgcaccagttttgattctgcccgactagatgaaagacttccaagtctattgcgatgcatcccgccacgggcttgggtgtgttctaatgcaggaaggcagagtggttgcgtatgcctcgcgacagttgcgtccacacgaagggaattatccaacccatgatttggaattggcagcagtggttcatgctttgaagatctgggggcactatctgattggcaaccgctgtgaagtatatacggatcacaagagtctgaaatacatcttcacccaaccggatctaaatctccgacaacgaagatggttggaattaatcaaagactatgatatgagcattcactaccacccggggaaagccaatgtggtggcagacgcattaagcaggaaaagttactgcactgctctatgcatcgagggcatgtgtgaggaattgcggcaggagtttgagcatctcaacgtgggaattgttgaacatgggttcgtagccgctctagaagcacggcctacgctcgtcgatcaagttagagccgctcaaataaatgatccggaaatagcagagctgaaaaagaacatgagagtcggaaaggctcgggatttccttgaggatgagcatggcacaatctggatgggagaaagattgtgtgtacctgacgacaaggaactgaaggatctgatactcaccgaggctcatcagacacagtattccattcacccaggcagcactaaaatgtaccaagacctcaaagaaaagttttggtgggtcagtatgagaagagaaatagctgaattcgtcgcactctgcgatgtttgccagcgagtgaaggcagagcatcaaaggccagcaggtttactccaacctcttcaaattccagaatggaaatgtgaggaaattggaatgaactttataacaggactgccccggacatcattgggtcacgattcaatctgggtagtcgtggattgactcactaaggttgctcactttataccagtgcataccacctatacgggaaagagattggcagagttgtacctggcaaggatcatgtgtttgcatggggtacctaagaagatagtatctgaccgagggagtcagttcacctcaaaattttggcagaaactgcagaaagaattggggacccgtttaaatttcagtaccgcctaccatccgcagacagatggtcagaccgagcgagtcaatcaaatcttggaagatatgttgagagcttgcgctcttgacttcggtggagcttgggacaacagcttgccatatgcggaattctcatacaacaacagttaccaagccagtctacagatggcaccgtttgaagctttatacggccggaagtgccgcacacctctcttctgggatcagacaggcgagcgtcaattgttcgggacagaggtattaacggaagcagaagagaaagtcagaaccatcagggaaaggttgagaattgcccagtctcgacagaagagctacgcggataaccgccgaaggaagctcacttttgaagcaggggattatgtgtatcttcgggttaccccgctccggggagtgcaccgttttcaaaccaaaggcaagttagcaccacgtttcgtgggaccctacaaaatcttggaacgaagggggaagttgcttattagctagaacttccatccaacatgatcggcatccatgacgtgttccacgtgtcccaattaaagaagtgcttaagagtacccgaagaacatgcagattcggagcatattgatatccaggaggacctgacatatgtggagaagccggttcgtatacttgataccagcgaaagaagaaccagaaacaaggtcaccaggttttgccgagttcagtggagtcaccattcagaggaggaagcaacctgggaaagggaagacgagttaaaagccgcccatccgcacctcttcgccagctcctccgaatctcggggccaagattccgtttaaggggggtaggtttgtcacaccctgaagttctcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 8708 - DNA, 2171 bp, Oryza sativa
  unsure (1)..(2171): unsure at all n locations
cacacatgcaggggatcatgaaaattctgactttaggtctaagtacgaaaaaaaatgattttcatcgatcaacactaatatattaataactttagtggtaattgaagatgcatgcatgagatccacttcagagatcgactaattaattgattaatcatatagtatatgttattatctccttaacttgttgctcatgtatatatgctagtgcagagctgaagaggatcacagcatgcatgcacactgcagctggctgtggctgcaggctagcttgcaaacaaaacaagctcccctgcaggaaaagcacctgatccggcctaatttgcatctttcattgcatatgctgatatgcattgcccctgtgattaatttacttacttgatgctggagaaaccaactaataaagcatacatacacacacatatatccaagggcaagcaactaattgagcaagacaggccagtagtgaagctaggcaacaaactgaaacaactcactcttgctcatcaaatatatatatatatatatgccaattatattaattaatttgcccaactctcactcatactgatactgctagctagtagcagcttgcattgttggctagcttccaattgtcttttgcttgcaaccctctcaactcccttggcaactttgcctacttcactatctctatctttattgcagcaaggcagctagctactatagcaaagcccaaaaggaaacgtatgtactaatgtacaccactacttgaaacttaccaaattaataaatacaattaacgtaccaacacgtattaagaacaaacagcaggcgttaatcaaaatttaatttctcccccgagataaattaactaattggaagtgatgtttgcagtgcagtgtccgaaagggaataatattgcatcaaaagtatataaacagatcatgctttatatgtacagggatatttaatttttgcaaacactgccactgaacagaagtgattaagtgattaagctagctagctaactaagctaggatacagatcaatttttttaaaataaaaaaagagagagaaaggaatagttgaatagtccgtagccggccattacattgcacccactcccttcttaatttccatgagaagaatggcaacgaattgcattgccaccatcttctttttttcgtcacattttcagacaactttccaccactcactcgtgctcgcacactctcgatcgatcacactccaagtggcggccaaactttaataatttctggacaaaaattgatctcaaacttgattcattttcatatgtataaatgtcaatcaatccctatgtatgtatgtatgtatagntaatcttacagaaaagaatcgaaagaatcaatagtatatgttacagtttccagcttgatgtacatgccaaacaaatttgtaagtaaacatgcatgtatagtgattaatcccccagaaaaaaattaagaagaagaagtgaaaaaaatgatcaattgatcagtgttaatcacgaaaagaattcttgagcttagctttgctcatgtcatgtcaataatggcagccgaccagcgcggcggaggcggtgagctgcagaattggcttcttgccgtcgttgaactgcccgccgagagccaggagcaccggcggcggcggcggcggcggaggagacacggactcctcgtcggacggcgccggcaggttgaggtcgagctccaggttgatgctcgtgcttccctctttcttggtgtccggggcggtggcggtggcggcggtggtggcggccgtggtcgccgcgcgctccggcggcgcgtgcagcggccggtggcgccgcatgtggccgcccagcgcctgcccggagccgaactcggcgccgcatatcgagcactcgtgcaccctcagcttgttgattatgctgccggcggcggccacgttgttcaggctcagcacggtggtgacgtccgggaccacgacggcgtccgcctgaggcggcggtggagacggtgccgacggcgtcgtcgtcgtcgtcagcggcggcttggacttgacgacgatggcgttggtgttggtgacgttgttaacgttgtcgtcgtcggcgccggggaggcgaggcttcttgtggctggcgcggtggccgccgagggcttggaaggtggggaagcacttgttgcacg

SEQ ID NO: 8709 - DNA, 4832 bp, Oryza sativa
gttttctttttggtgatgaattcaagtaatatactccctttgtcggcttcatttatagtatttttcagataaattagtaatgatgagaaataactatggtgtctcttattcatactcctggttgtatttactaattaagctccaattaaatgccttagtctgattggtttgaaccctttgaaatctaagtttttttatgggatgaattttaagcaccagaaattaagtctttctagaacggagagagtagacagaatagatagagggagctaggtgacaacatgtttgccactactaatatatgtggacatggacaagagattgaaaaggatccaagtaggagtggcgagtgagtaatttgtgcgtggtaacaggtaggccaagaaagaaaagaaaccatgcaagcaagcccaatattccctgggggatgatgtgcatgtttggatgtgtgattcctggggtgatagtgtcacactgcaaggctgtcttgaaccacaggagaaaaaatactctgctttttgatctgcttctcatgacctatatatggttctttctatttctttgcttgttttaataattagtatgcctttaaatttagtaataaaaggtatatgtgaaagtccaccaaattgtttgatggttcttaataattgagatctttatttacatggagagtagtctttggcagcaattccactgatgatgaagcgctaatagacatgaacagctagttttgcttggcagttggcaactaaaattaggaggtagtgaggtagtggtggtgcagctgcagctgtctctactctccattggccacacaaaaatacctgcaatttgttgtcacttgtcaagtactcacttgcatgtatccccacatacacacagtactttgatttttcttcctttttttttcttgtgaacaaacacaattgttcacctgttctttgattgcattgcattggctaataataatagtcacttgctttttaagctaaaccaaaagctagcaaaattgacatgttctgatgcaaatggcacagctacataactagctaattaattcgattgttcttgatctctctaatctgataccctaagtagttagtggtcacaccagttttgtatgtgattttttttttcatttcttagttcactggatctcactagcttagatttggtttgggcgatactaatagttgctgctgctgtggctgcactgtctcaatcaagtaggtcgtcctcaaatttaattgccacaccctaaccactgttcccgtacaatgtatttgtacacgatgcgcgtctacttatcgcctaagaaccatacaactttcatacatacagtaaacactgacgtggcttagctgataactcaattaactacaccaaagtaattgagtagttatacaatgcatatatctaaatagcaaaccttaatttcatccaattttaatccttcaagttgaagaagctagtagtgaagacgatctttgtgttattgtgtgagatataagtcaacgagtgatcgagggaggaacgggtggtgactggttagtagctgattaatagatgattcttgacgtgatgaattgttgtttgttgtgtggggcaacaaggaacttcattagaaaaaagaaacagagtttaattagtttggagaccaatgccaattggatatgatgctgtggtgtggtgggggcaagcaaggcatcagttggaagctggtctagcttagctagatatagcttcctttctctctctaacacacttcctctctctctggatctctcaacactacacatgcatctacacttgctggtcactcacttgttctgcaatccaaactaccgaggaaattaatgatcagatcagtggctgctacctgcctttgttttctctttgccatacttaagcagtgcagaaaagataagtgcccttgagcttgccatgatcctgcccatgattggcaattagccaagttgtccctcatgtggagaaccctagctttaaggatctaattagtgcatgcaacgctagttggacaactagtacccctgaacgtgatcacttctgttaagctgaccattatttatccaaaagattaacaaatctttgtatacacacggcaagccacctatccttctcttaaaaaaaaacaaaaacttctgagagcagctcaaatgtgctgagagctgatgtcattgcctgatcaagttagcaaggtaagttaattagagagtgcatgacactcctctggataataaagctttaagcaagatttgttactaaaaccttgtgtgcttttgccctggccaaagtgcttagtagcatatttcaagtcactatatagggatctgtaccagcagtgattcgggcacacaccaatgagactgagttggggtgaattaaggaatctgcctgcctgcacagaccaaaaagaacacaaataataagtgaacagaataaaatccaggaaacacacagtggattggaatatactagaagtgatgaaatgaaatatgtggtgcagttgatggacacccaccaagcacacataccataccagccatggatcatccagctgcctgcatatattgttaagtagtagtaggatggagatgagctgcctgactgacctggctcaagtggatgatgagtgaagcagtagtgggacactcgacagtagcagcagcaccatccacaatccatgtataattagcagggggatcactggctgcaagtgactgggccaccactcatcacgtcatactcatgctactagacaagagagatccagtgagaccaccagtataaacgacgagatgatcacaaaaattaaggactgttcagatgattatcatgatggacggaaaaaagaagaagagagaaaagaggagaagaagtgtgacaataaatggagagacgagattcactccacatgacaacagctccccgaaggatcccaagcagaagcagcagctgtatcgtgctgtctgtcatgcttggagaaccgttaatcacgatgcatcatcaggttcaggcctcactgacagagtgacagacatgtcttctccaaacaaacctgcaggccctcaagtcaattactggtagttggtgttactactaagacgtactttgtggatacacatggcaattgacacttgtgcagggtagcaaggaggacataaccacacttccaacttccaagctaggatgggaataattcaatatgtggcaggatgattcttcagacttgttgagaagccattgatccataatatgcccctgctgatggaattgtatgattgccccaagttaaattagtggcgtggagtgaagggagagtcaatgcttcatcacataatagattgctgtggctgccaccttaagagtgtggcaagtgttggctttgctcatgggcaaccactcctcacacactgattggtgggcaaaccttattccgatgccatgtgctagaatcatcttttgttccgtctcaagtcatgcctcctctttgcttcctggctgatgactgcatgttgctaattaaactcaacctcacacatgtacattttctaatgatgtggtacaagtatgcaccgcccaatgctccaagaaacttaaccacctactgctgctgacggacacaagcttaattgcttcctacagatgcttctccactggtgcattaacttaagtagttaactaaaagttctccagctccatcagtttgcatcttcatccaacgaaatggacgtcgccacggtaacaaccaacaagtattgggcaaaagttaattctcactgtcctgtgagagatagggaaaagaggaaaactgagaatgagcaaagagaataacaaaatactccaatgccttgtactagctactagctctttggaaaaaaaaaatccaatgccttaataggccattggtttctgaaaatagttagtattattttggtttatttccactgttgctattaaaaatcatttataatactgtcgtttgattagtcaacattaatgtaaagctaaaaaaagctaatggccaaagctatatttcaaagaccacgaaaaatcgagaacatcaaatagaaaaaatagggagggagtaatagctaagtattatcttacataaagcaaggagaccggaaccttcaggttgctcacagccagtagtaattctccgttcagtacaactcttatccaacagtatagaaaatagattccacgaaaaagaaatgtgggtccctgataatgacttgtaatgaatgtcagataatatccgaaataaccagaccttagataatataatccctaacctttctttgccattctttttggaataataagtctggagtctgggatttggttgaatcgaccatataataataacacagtggtgcatatacagctttagcgaagataaaaaatgacctgatcccaaaagtgcatccacagattctccaagattcacacagcagtatctatgatggagatcaaattcagattatcaccagagttaacatgcttgccgaacttgcaaggttatagttagttcggtgaccggccaaactataatgcgtctctggcaagttggccatcactcactctctttgtagctcactgctcagctgatgaacactttttgctcgcaccactgataagtaatgaagacatcaccttcatggccaatactttctgctgcaacccaagtgatgcttccaaaattagcaactttggtagctacagagtccctgtttatcgcacgcttatcagctatcacattatgctcacatttacaaatctgccactgagagtatgtactgccg

SEQ ID NO: 8710 - DNA, 697 bp, Oryza sativa
aacggatgaccattttaggctgcacaaaatttcctaaggactacaactacgaaggcttgcagagctgtaggaaccttaattctgtggaactgactattttctatttcttctgaatcaggtgtcatgttgaacaaatgtttctacacccattgctgttaacactacatgtctagccacaactctgtaaataggactgaacaagtgccttgactagttagatctaacattctagctttaaggctagctagagctatagtttggctttacaacgttctataagcaccttagcatgctacagtttggctttactgatatgtaagcatatcagtaaactggatgataaaacagacaaaaacaaaaaattaacattgatatcgttgttattatacaactttgttggctatgctcctgccacatgccatattgagaactccggagatgtaaaacactccaacaaaagaaggccaactatcaaccaaagacacataattgaatctgagtctagaattgagaaaatcttgctttgccattctcattttataagacctggataagtgataagatgatcattgatcatcttaacaaacagaagaagaaatagctggatgtatacaatcaagatacttacatattggctgatgagaacaattgcaatgtcctcccttgtagtgaattccttaaatgcatcttcgatttg

SEQ ID NO: 8711 - DNA, 573 bp, Oryza sativa
ggcttccagacaaccatgtagtgcgacagaatcttcatttcctttcgggataagctcaagcttatgaatctcaggtagacttttcagcattgaggtgtcatattgtcctactgcattttgttgccaatggacattgataagtagccggtttggtgttgtctgtaaatccacctcatctgtttgtattctcgtctgctggaattcaccccttccatttattaaataaaattcaaactcttccatgtgtgcctcccgatcagaatcagtagtgtcaccaatatttgactcactaggtccttcggtcatttggcattcaatagtctcagactggctactttcaggggcgttttccgatggagcactctgaaacttactatctgaatcaggcgttgcatccatcatgacagcagcaccagccactattacacctcccactatcattaagagaactagtactcttggaaaatcttaatggttccaacaacttcaggtagatattcttcagagttaatccattggctctctcaggaagaactgccagcagtggggcctcaaattccttcatttgtggtg

SEQ ID NO: 8712 - DNA, 18482 bp, Oryza sativa
tataatactttatagtggaaccaagaatttctccaatacttgctgaagatgcagcaagaagtagaagaactgaatcaataatcagacattattatgcagtaaagtttgaatctgtacccctaaagctctatagctgcatataacaagaaatggagggaacactgcaagttaaaacaaattcagtttgctgtggagcagatgtgcagggaacgtatggtgtaaaagctgaaatggccaagagtctttggaaagtcttaaattagtgggtcctgattttccagttgaccaatcctcttatgtaatggcccaaacaaactttttgatgagagaacaagtgtctattggttcaccagtggctgttattctcagcaatattgatcaagggaagcaattctggtttgcatcaagtgttagaaccaaaacaggttaccaaaaaacagtaggtattacttgattgaatgtgtttatttgaaggtctccccgaggatgaggccagatcatgcccaattcgatccttgaaagacccatcacactacagtggcaccttgggagcagaagatcaggaccaaggttgaaaagtgaattgttttatagttcaagtcaaatagtgtcttgttttgaatgaagtccatgattgtttttcttaacaccctagcaatcagtcaaaaagagaacaaataaccaaagtttaaaaatacaatgatttacaattatttgacaaatagaaacacaccacaatgactcaaccattggcatgcccaattgcaattggatttccccatactacaatataatggaaggggagtacttctatgatgaggaatagcaggaatgaaggacaagacaaataaatggtagcaaggttgacctatccaggtactgaagtctacctatgccaaagagcaacttcaatcggttcgagtagccacccattttcaggagaggcttattatagtatcatatggaaaatcatatgaacaaagaaagcctatattaggaatccaccatatcaaggggaagggagatcaaggttggactttgcttttcttattcatctttctttgctttcaaaatcatgctcaacaatgtaacttgcaacacagtcctactgtacctaactggtgcaacatggatgttcattcaacatgcacgcctgatccacatctaaaccttagtacagttaccattttacgtttttaaagtctcagatctgcttgttttcagtaactatatacttactaggtgatatgctcttgtatttgataagaaatccattgttagtcacagaaacaataatattatcaggaaacatagcatatgagacatagggttacactaaataaacattaattatgttagaaagatgctccctccgtcccaaaatgtaacaacttttagcactcaggatatgtccaaaaatataactacttctctaccaacattccctttctaaccaatcacaaccctccaccattcacttttcccacctacttccacttctcaaccaatcccaacctctccctatttaattctacttactttcttaatcactgtgtccaactctagagcttatattctgagacagaggtagtagtagataatatcacttttcattcagtcaactctttgtgattgtggtagtgtttgacatagaacccacctaaagctaaaaatgcaggggataaataggcaggctaaaagtgggcaatataatatatggcaaatttcagtgggacaaaatagtgtactctcaacaaggtgatttagaattttgtaaatgtaaaggtcaatcatgtttaagagaagtggcatcagtcatactgaaataatactaaatattaagcacataccacactttcgggaactcctggaggaggtaatgtaagatttcttggcggtggtgaacgaagataagatcttttgtcaaaccgccattcccctattttcccataagttagctcaccctgagtttggacaagacacaaaaaagctctttcatgagaagcttataaagttaattttgatgacaatgcataaatagattttacaaagtaattgacataactgatatgatgacatatacttaaagtcaaacagtagtcacctttaatgtataatcacacccataagtgtaatggatgatgaatgtgttgtccgatttcgcgtcccaaggaggctgcaattagtatcaagcacatcttatatgatataagacatcgtgacgaagcgtgagatgatttatctagtgacagtttctaagcacctgaatcataaaatccttacgaaggctgtagtgcacaccatgcaatgcactagcgacagcatatgcatacctataaacatgaatatgaaagatcaaattaataaggggtgtgcatgtttaagtcaagaagaaatactgtacacataatagtaccgacatttccaagacccatccaaaagctttgtctgtctccacatcctctttcattttcaacgaaatattcatccaagttggagcaatcttctcaagctgggcctggagatgttttgaaggcatcacgaatgcattgaaacagtattgaactatggcattgcacaatgttcttaaatgtatgttttttatgcggaactgaaaagaactagtttgggcagacagtgctatcttgagttcttgacagctcctatagccggacctaagcatcctattaatcatgcgtcgagatgagagataccttcttgataatcactggggaattaccaataggatcaatttttgagactggtccattttcttcaggaaagaacttcctcagtattatttcattttcagttggtttgatgtagaagaagggaaacgcagcaggttcgtcgccatgagctaagtttggcaatggcctcacaaagatgtgatctggctcagccataagtacatagctgcaaatgcttccattaggaaaccgccggtacaagatcatttagcataacaaacttacaagaaacaaaatacatctacttactcttctttgatgtttgatttcttcagccattgaacaaatgcccaaggcctgtttaggacaatgtaaccctgcgtaggaacgtcatatcagcaagagctcgttttaacttcacgaaatgattttgccatctaatggcgtttgcaaaacatgaacaaactcggggttcttactcgatccgcgccttcggggaggggatcaaccaccaaggtaggtatctcatccatcaatccgtcgggcttcccggagtgcaggatccgcgtgaagccgcccatgtcggagccaggccgatccctcatctccctgtaccagtagtacatcacccgcgactgccactggctgtagagcgcgtccgtcgccgtgagcgcgacgtggaacctcttcgacgggtccgagccgccgccgccgacgccgccgacgccgccgagaatcttccgcggcccggcgtcccggctccggccgtggcccaccatcgtcaggaagttgtaggtcgcgaagaagcagcccaccgagatgaggaggagcagaaacggcgaggccttgccggcattcttcctcccgctcatcctagtggggaggtcctcgtcgtcgtcgtcggcggcggcggcggcggcgaggattaagggttcggaggcgtttgactcgatcgcgagcggggtctccggattcggtggatctgagagatcgcggtcgccctcactcgggtgcaggagagatggagggaagaagaaggaggcggtgggttacttcggggacgccggggatggagggtggcgagcggcggggcagtcgcctcggcgtccggtggggattcgccggcgatcgaccgcgtttgggatggggggaggccgtggaagcgacggcggaggagaacttgttgcggtatggccgccgcgaccgggcgagaaaaaaaaaagagtgtatataaaaatgggttaattacgatttacgcgtgggtgaacaatatctatccattagctgcgatttcatatagccacgtcatcaaaaatatgcatataagatactccctccattctaaaatataaacatttttattatagtaacaagttaaacatttttaactttaactattattaatagcaaaaaaaattcaaaagaataatcatataaaattgatgttacttagatttattgttaaacaaactactataatatgcaactttttttagttaaaacatcttacttttattgatattattggaccatgttagtgtctaaaaatgcttatattttgggacagatggagtattagctattagatacaattggaaggaacatttcctatacacacaagcttgctgcttgcttacatactctgtgcacaataattagcaaatgtcacgaaaaattctataaaaaattgaacatttactcctaatagtattatacatatctacaaagtctcatatttaaattcagtatattttagctgtaaaaaaaggtgaaaaatctgacaattttaagagtaaaaatatgtcataattttatctttttttttgttatggctaaaatataatggatttgaaaataagatttcatatgtaagtgtaatattattgaaagtatgtgtccaatttattttagaattttctgtgatatttgctagttattgtgtacggagtgtgcactaaaagcttatttgcataagatatattcccacaattggaaggctactaatgtggggcccattcctcacattaactattgccgcaataaaaacaaaatgaatggtgttaattactctatatattatcgataatattcctatatattagttatgattacagaagccacatcgtaaaaatatcacaaccgttagatcatagtgcctattatatatctgccatcagattcaattggaagggtagtatgtaaggcccattcctcacattaaccattgccacaataaatacaaaatgaactgtgttaattgttttgtactcctccgttttaaaatgtttgacaccgttgactttttagcacatgtttgaccgtttgtcttattaaaaaatttggtaaataaggtaaactaaatgtgtacatgaaagtatatttaccaataaatcaaatgatatgaaaagaataaataattacttaaattttttgaataagacgaatggtcaaacacgtactaaaaagtcaacggtgtcaaatattttgaaacgaagggagtatattatctactattcctatgtaagtagcccctgtgattacatgggccatatcctaaaaatatcacaactgttgaatcgtagtgcgtattagatatctgccatcacatacaattggaaggccactaatgttaggctcattcttcacattaaccattgccgcaataaaaacacgatgaatggtgttaattggtatgtatattatcaagtaatgaccagccttaaacgaaaattcttttatgcttatacttattagctaaaatttaaattttcaaccttaaatttggagctaattttcgggttttttcatcgaagtttatttttcagcctttgcttttagattgctaataacacgtatataaaatttttgttcacaaattatttttaatttgtaaatatgtcatttggcttattccccgaataagccaaacgatagggccggacacctttttaatgcttaaagaaactgtctaataaacattcaccctaggacaattggtccccttactcttccaatgttctgtaacaacaaaaataacttcatcacaaaatccacattcgtagctcccacttacacattgtagttttatccatggttttgctttcgacccaaaatctctccatgcactgctcatatcgacgtcccagtggtggtaggtggatttcaacaccatcttcagtttcaacaacaatgccacctcttattgtgatggtggtgatgtatttgtttggccaaaagtaagataggtgtttttctttgttttctattaatcacgttttggttattcagagttatttcatagtattcactgtggagattatggataccccatacctacacagcatgtatagtccaactgggtatggggtgtcatgtatagatagaatatctttaaaaggactcgggttcaattctaaacttgtatgtcaaggaaatatccgagatcctagtcggttacgattgtattttatctgtaactacctattccgttaggaatatgggctgtgctttgtaatacgggccccttcccctatattaggagaggtccgggtgcctttaggggcacgattttcacccagatcatacaatcaataatatactcggcggatcaatctctggacaggagtagggtattacttcttgattaagaaggcctgaacctgtataaaattcattgtcttttaactcatccacttttccagcttgatagccacccccttttagtattgccaaaatcttgtttcgacagttggcgcgctaggtaggggtagcgtcaagttcttcgccgactagtgtgatgggtttcgtttctagcatcgacgacttcgtcttccctcccgggcaggcgttccggttcggcagcctcgacttcatcaccaacgacttcggcaagatttctctcctcgactcggatcgaaccagtcgggaagaggccagatctccgccccgttcggtatcccgaactcggccgagatctaccccaagatcatttccatcgagttggcttcaaaccactcggacgagatcccatttactccaacacgacccgatcaagatgatggggcctatccgccaatcctgatgaaactccccgatgatggggctgctgttttcaccacaagggcatcttctccccgtaggtctaagctggatccggcctctgccccgatccagcctagctctagggaagtcagcgtcatactccagcctctcagcacggtttcgacggaacaactggatggctacctcagctcccctggcgttgactcacggccaacggagatcattgagtacgacaactttggctaccgctacgactaccgccacctcgacgacttcgacaaagactttgaatataactacatgcctctctacttcgggatcttcatggctgacaacgagacggaagaacagcataaagcccgagaagcagaagaacaacgcgtgcaacaggaagccgaccgacgccgactagaagaggagcaccaagcacaagagcgagaacggctacagcgtgagcaacaggagcgcgaacgggctacaaaaaagggtgaggactgcgggccggcatgacttgaatgtcgggcgacgagcacgagaacttatcgggcagcaagacgtcgagggaacggtggtttttcgcacccctcaacagaacgcggttgcagcgatcaccctcctcgacaccctcctcaagggaagacgcactcaatcaagccaatcacgtcgtcaacatcttgaatcagaccaagaccatgatcgccgtcaacatcttgaaccagaccaagaccatgatcgccgcctcggtcccggttaactcctcaagcgtccgcacgccgactggcagccgagttccccctcttcgatctcaagattatcaccaaccaagcctcagcgtcgtcggcgcgggatccagtcgcaggagcaagggtcacgatgagcgatctatccactcgcctcccaaacgacatagggagcgtcgagttgaacaatctcgctccccacatcgcaggcgccccgtcgatcttcgcgatactatcaaccagcgccgcgcggcaagaggctacgctccccaccattcaccagatcgctacgacgatgacgtggatggagttgctgccttcacaagcgacctgcgtcgagtggattggccagccggcttcaagccgactggaatcgagaagtatgacggcaccactaacccggagtcttggctcaccatctacggtctcgcaatttgcgcagcaggaggagatagcaaagccatggcaaactatttgcctgtggtcctagcggattctgcccggtcctggcttcacgggttaccctgtggcacaatcggatcttgggtggaacttcgcgaccacttcatcgccaacttctagggtacctttgaacgccctggtacacagtttgatctttacaacgttgttcagaagtgtggagaatcccttcgagattacatccgacgcttttccgagcaacgcaacaagatctctgacatcaccgacgacgtcatcatcgccgccttcaccaagggcattcgccacgatgacctagtcggcaagttcgggcgcaagcctcccaggacggtcaagcagatgttcgaaaaagccaatgagtacgccaaagccgaagatgccattaccgcgtccaagcagtcgggcactacttggaagccgaagaaagatatgactacaggggggagtggaagtaccaatcacaaggatcgcaagcgtaagcccgaggaacttatggcaactactacaccatcctcccgacaacgttcactcgtcaacacttttgacaagatcatgaactcccaatgtccgcatcatccaaactccaatcacgcggccaaagattgcttcgtctacaaacagttcatagaacaatacgccaagaacgcacgcaagacctctgatggagatcaaagcacatgaaagaagaaggatgatgaagacgatgccccgtctggttttcaagaccatcgcaaggaactcaaccacatctttggcggacccctggcttatgaatccaagagaaagcaaaagctaaccgaactggagatcaacgctgttcagcccgacacgcaccaatatcttcggtggtcagagacgataattaagtttgaccgctcggatcatcctgacagagtggtccacccggggcggtatcccctggtactaggcccagtggttcgcaacgtcaagcttcgcagatcctcatcgatggtggcagtgcactcaacatcctttttgccaagactctagacgacatgtagatccctcgcacagaattaaagctgagtaatgcgccctttcacggaatcatcccagggctatctgctacaccactcggccagatcactcttccagttactttcggcactcgggagaacttccgcacagaaaacgtttgcttcgaagttgctgatttcgagacaacgtatcatgccatactcggacgcccagcgttagccaagttcatggctgtcccgcactatacctacatgatgatgaagatgcctagtcctcgaggagtcatatccctgcggagcgacatcaagcaagccgtcacgtgtgacaaggaaagctgcaagatggcccagacccgcgagatcacgctcgcccgagaagaaatccgactggctgcgtccacagcaagcgaaggagaagtgcctgtgaccaagatgcccaagagcggagaaagtgacgctaagaccaagaagattcctctagatccctctgatcctactaagactgctgtaataggcgctgtgttagattgtaaataggaaagcgcactcatcacctttcttcaaaataataaatatatctttgcgtggaaaccatctgatatgcctggtattcctagagaggtgattgagcactctttacatgttaaggaagacgctaaacccataaagcaacgactccgctatttcgcacaggataggaaggatgcgatcaaggaggaattgaccaagctgttagcagtaggtttcatcaaggaagtccttcatcccgactggctggccaacccagttctgtttcggaagaagacggggcaatggcgcatgtgtgtcgatttcaccgacctcaacaagtcttgtcccaaagatccctttgggttacctcgcattgaccaggtagttgactcaacggccggctgcgagctactcagttttttggattgctactcaggatatcatcagatccgactaaaggaatccgactgcttgaagacttcattcatcacgcccttcggggcctactgctacatcaccatgccttttggattaaagaacgcaggaacaacttatcaacgcatgatccagagatgtttcaacccaaattggccgcaacgttgaagcttatgtggatgacgtggtcgtcaagatcaagcagaaggatgatttgattacggatctagaagagaccttcgcgagtatccgtgctttcaggatgaaattaaaccctgaaaagtgcatcttcggagtaccgtcagggatgttgcttggatttatggtgtcccatagaggcatacaagccaacctggagaaaatcaacgccatcctcaacatgaaatcgctgagctcccagaaagatgttaaaaaattaactggctgcatggcggtgctcagccggttcgtctcacgactcggcgagcaggggatgctttttttcaagttgctgaagaaaaccgacaatttccagtggggacccgaagcacaaaaagcctttgaagacttcaaaaaaacatctcactactccatcagtcttagcttcaccacatccgcaagagccgctattgttatacgtgtcggcaacttcccaggttgtaagcatagtcctggttgtcgagcgtgaagaagaagaccatgttcaaaaagtccaacgactaatctacttctttagcgaggttttggctgactccaagacaagataccctcaggttcaaaagctattatatggtgttttaattaccattaggaaattatctcactagttccaaggtcactcggttacggtggttacgtcgttcccactcggggacatacttcacaatcgcgaagcaaacgggcggatcgcaaaatgggccttggaattgatgtctttggatatatccttcaagccgcgaacttcgatcaagtcctaaactttagccgacttcgtcgccgagtggactgagtgccaagaagacatgcccgtggaaaagatggagtattggacttgcattttgatgtgtcgaagaggctttcaggcactggagtgggggttgtcctaatttccctgactggagagaggctgagctacgtattgtggatacatttttctggatctcacagcgtggcagaatatgaggcgcttcttcatggattaaagatttcaatctccttgggaattcggcatctgatagttcgtggagattctcagttggtcgttaatcaagttatgaaagtgtggtcctgccttgatgataacatgaccgcttaccgacagggggtatgcaagttggaagacaaatttgatggacttgagctcacccatgttcttcgacgcaataatgaggcagccgacagactggctaattttggttcaaaacgagaagcagctccttccgacgtgtttgttgaacatctctatgagccaaccgtaccaaggaaagaaacaatcgaggccacggatactcaagacgtaagcatgattgaagccgactggagagagccccttataagatttttgacaaaacaagaactccctcaagataaagatgaagccgagcagatctccaggcgcagtagactttatgtcatacatgagaccgagctgtacaagaaaagtccatcgggaatcctgcaacgctgtgtgtctttggaggagggaagacaattgctaaaggatatacattcaggcatctgtggcaatcacgctgccgcacgaaccatcgttggcaaggcttaccggcaaggttttttctggtccacagccgtgtccgacgctgacaaaattgtgcgaatatgtgagggttgtcaatttttcgcccgacaaactcatctaccggctcaggagttgcaaaccatcccgttgtcttggtcgttcgcggtttgggggctcgacatggtcggcccatttaaaaaggtagtcggtggttatactcatctctttgtagctgttgacaagttttccaagtggattgaagccaaaccggttatcacaatcacggcagacaaggctagagatttcttcatcaacattgtgcaccggtttggggtatctaataggatcattactgataacggcactcaattcacgggcagagtatttaaagatttctatgaggacttcggcatcaaaatttgttatgcctctgtagcgcaccccatgaacaatggacaagtcgaacgcgccaatggcatggtacttcaaggaataaaagcgcgagttttcgaccgactgcatccctatgccagcaagtggttagaacagttgccatccgtactatggtccttgcgcaccactcccagtcgagctacgggccagtcgccatttttcctagtctatggagcggaagcgatgttgccaagtaacttcgtaactttagcgaggagcgctacggagaagaccgagtagatgatctcaaccgactggaagaagtcggctcggtacttacaagggatgcgccgttatcacaatcgcaatgttgatctcgagcttttttagtcggcgacctagttctgagaaaaattcaaactacacgggatcgacacaagttatctcccttgtgggaaggaacgttcataatttctaaagtcactcggccaggttcttaccgactcaagcgtgaagacggtactcatatcgacaactcttggaatattgaacatcttcgttgtttttatgcttaggcattacttttgtatcttcctctttgactgttaacatcaagttgtccattgagttatcagtcgggggctactataataataatggagtgtgatttttatcaattcaatttgtttacttgatttatcattgccttgattgattttttggcttagccaatgaggactgagagtttttttaaaaacttttgcgggttctaggctcaataaggtttgacaaaaacttaagaaatctagagctaagtttaaatcatcaagcacatcataaatttatcagtattgtacaaattgtgcctccaccatcatcatcattatcatcagaatacacaaacaattagattcagttctttcatcatcagaattatcagacccagtcggcttaagattgttgtcctggaatctctcaaccacatcagcggttatcttgtcagcggccttttgcgcatcactgataaggtcaagggcggcctcttcacttgtcccgtctgcaaagccgtcaacagcatcaatatcaattttcgggtacaaggacttggtcattgccaacgctaggtctgcccccatactcccagcttctttgatgttcttaaaatatgtatccggagcagctctcagcttgtcgaagatttcgacagcatcaagtgaactcggaccgttgttattgaaaaacatggcctggacgagtggcgtagcggcattggcgacttcatctctagctccttcaagcttcttgattttattaactaagacgtcgaattgggcctgggatttgatcttgcggtctacatgaataagtttacatcaatgattaggcatgaagatgagagtggtttttgaagtattagctaccagtaccttcgacatctttcagagccgagtccctctgttttgccaattcggccttgtctttctctagagcttggattcgcttctctagctcggatatcttggaagcttgcactgtattgcttttcattggtcagatgcacatggatagcaacatgaaacaggtcagacagagacgatgtttaccttttgatgaaccgctcagctcaaagttagagtcttgaagctccacgatccgatctctaaggtcatgttcagttttcctagcaagctctttggcttcacgcagctggtttctggttgcttcaagggttccaaggtggggaactagcttttcaagggttgcggtcttcgcctcattcctgagatggattctctgtaccacaaatttatctgtatctaagcaaagtggctgacaggatgattgaagccgtgtatagggatacttacatttacaagacgagtagcttggccgagtgtccttttcagcagacatacttcctcatcctctttttgtttatttattacgatcccctgtggttgcatttcgtcatctcaccacttgactaatatggttgggcgagaatcttcagccgattgtatccggaggacctcttcttcgtcgccgatcatcgggccttaggcattcatgaataatggtgaaacaattgaagaaagtctgttggatcaaaacagatttggaggatttgcttacctgttatgatttccggtcggggacaagcaggtccttgcaccctaacaggggaattagttctagagttggcgccaacactcgtcttgggagggctatcagcctgggtctctacttccgagatgtcattattttgttctgtacccgactgatttccagtcgggggctcctgattagcaccaactccagcttcggccgactgatttccagtcaggggctcgttgctggtctctacattgtcggttgctggttgattgtcactcgtgcgattttcggcagtcggcccagtttcttttgaaggacccgtctccatgtcagtcggcttagggccttttccagaaggatctatgtcagatggcttcctacaaatttgagttatactatcagtgctatttcaatagtgagtgagcagcaatacaaggaaaatggtcaaatgatttgtacctggaggacttcctgattttcggcatgggacgaccggatgttttcttcttaaggtgagcttgccttggttttccagtcacccctttgctgccagccttttcagcatcgtcgttttcatcgtcactcagaaccagtttcctcttgcggaacactaagaggtgttgggttgagtgtcagaccggatttttggtcctccgccagcttgaccagtttgccgacggggtgagcggtgttgagcaattggaggatctgacttcatcaaggcgaattcctgggcatgatgatccaagttttcaatcaactttggaaaaaattttgatagtaatcgtgttcttcaccgaaattgcaagaataagctgcttaggggcggattagcggaaatataccggcgtcgcggtttgaaacagcgatagtgcgatatcgcgtaatgtgcgcacgaaagcggtggcgctcatcggtgtcgcggtcctaaagcgcgagagcgaggagatgtcgcgctttcgcaaagcgatagcgtggtccagctgatgccgcctgacgcacgcggaactcgaagcggtcttgcgcttcgagtgcgcgacagcgcgtgcggtctcgcggtcgggttgcgcgagaccgtagcgactgacgcatgtggggtcctcgagcggtctcgcggttgcgatcagcgagagcgatcggtctcgcggtacccgcgcacgagggcgccagcggtatcgctcttccaaagcacgataccgttgctgcgtggcccacggcccctaatccatctactaatcctggagcgacagtgacggcttcggtctcgctctttgaaagagggagaccgcgagcgatatcgctctccccgcgcgccagagtgattagctaattacgttttgcaaatcgctaatagttcatgtcaccgttggtacgtactccctccatcccataaaaaaccaaactagtactaaatttgttttttcgggactgagagagtaaaaagtataattttttacctccatcccaaaaaaagccaacatagtactagattcgttttttcaggacggagggagtagaaaggattttttttcatatttttttattatgtgtgcaacatatgtatacgtaaatgaacatgagaaacatgtttatattgaaaataggcaaagattgtgtacgcggatacgagaagaaaaataaatatcatggaatttgaaaataatgatatcagagaaagaaacaatatattacctatagaaaaatagaaattgaatatatatttattaaaaatatataaacaagtagagagatcatttgggaacaatttttacaaagttgacaaagaataggaatttagaatatgccatattcatagagaaaaccaactttgcatattcacaggctcgatcttgtgacaagaaccacgtagcgagttaacgaactactcagttcttgccacaagactgggcctaagaatatgcaacaccgagtttatgaatttgcaggagtaggtcatattcacaaacggatgttggaacttgaaaaaaatagtgggtgtaagaatgtagtaaaaaaaaatcacatttgtatattcatagactcgatcttgggacaggaaccgaatagtgggtgaacgaacaacatagagcaagttcaacaactactcagttcctgcctcaagatcgggcctaagaatacgcaagacgaagttagaaccagcagaacgtttatgaagaggagatgtagttgtgtgctaggttttgttgttgtttataggggatggcaagaagctgcgcagtttcaattattggaaagagacgacggtgcgtctgaatgcttcactaatcaattcaatagcgtgagactgtttcactcgtgatgacaataattgcaaagcgacaccgtcactttcagcggcacatgctgcataactatttgctttattaattacaaagcgacgaagtcactttcggcgcagcgcagcgaaatcttgaaagtttaattgtgaatgatttgatgctctggcgcatgtcccgtgattggaaagagaggatgccattttaggtgcgtatcgttgcatctctgtgaaaagaaattagtgggcaatttaagtcatagtagtaaaaagttaaagtaatatgcaattttaaccgcacgagtaacatcgacactgcactattaatttagtttgtgggactattatttttgttagctctcgtacaaaaaattaatagttaaccaaaaatcatatgtgttaactggctacaaaatagggcatataaatatgagatatttatgaactacgaaacatcatacataacatgaagaataagcagtacgaataaataatgttcattgcagtacaaataacatgaagaataagccaaaatcatagcaaggttcagatagggttgccagtgaactgaaagacataatgttcacttcttttcgtcatcatcgtcatggtcagtcgtagtcctagatggtccaccttgcttttttgtagtttttttcctttgtcctgcggcatgtcgagggcctgagagggacagacggtttggctcatggcgctcacggttagatctgcgcgggtcattgtcgtttccttccccaacctctggttgtgtgggctgtgtcacttggggcgcatcatcagtttgtgaagtccgaagctcattgggtaccgatgacgaccctccaccgaagctggacatgtcgccgtacgatgcagtgtaaggcctaaaccctgacattagttcagggcgaaatgaccctacagaagcaatgtagatatcaatgaaattatcaaagctggaggaaacaaccaataacacaaaaaaaaaaaatccaaacctgttgacggtgcttgcatatatggaatttcatgaggatgcgaggaatattgaccaaatagccaatcaccttgttgcaacaagtccatataaccctgtactccaccaccaaacgacgtgccttgcatccatataaagtgtcacggagttattgtcttaagttgaagtgggagtcatgtatggcatgaatgtgccatcgatatatgtgtatggagaatgatggctgtgcgtaccaccgtaatccatggattgtccttgccatgggttggtgacatatgtaggtgcatgcagtggaactgactgagtaggccctgttaatatcaggaagtaaatagtcaataagattcatatacatgaaaaattaataaattgaaataataaaaaaaatatgaaattagatgtaaggggagactgaccgcctaacgacgtaaaccctctttgtctgataaaatcagcaggcatttggggtatggtagggataccttggctagtccctgtatatgcaattaatataagcaaaaagtaaaattacgagtggacatatgcatgccaatatggtactgaatgtacacggacctgcaaatggtgcaaatcctccttgccagtgtgaggttggcacatcgggagccatttgagaaatcatttgtggcattgcatgaggcatatgaggcacgggacagaccattcgcgttccctctgtcatcaattggaaaacatcatttagtcatttcacataaacaattgggaaaaaattagcatattgatgagctatcccgtaccagcaaacgacgcaaacccaccctgccattgagaggtgatgggcgtagaactatgcgggggtacccgttccggttgtgctgcgaacgaataaattagtctttaatataaatggcatttattttagcattctgcaataacgtattttaccttgagttgaaccaaatcctcctagacgttccgaaatgtcagtgatttctgggatagtcggaatagtgggtggctcacgaaacgaagttgaccttactcctgcacaaccatcactggatcgt

SEQ ID NO: 8713 - DNA, 13081 bp, Oryza sativa
  unsure (1)..(13081): unsure at all n locations
ccgataatgattctaagcagatgacatctttgccgattacgaaatttcactgttaacacatgccccccagttttggagtatgaggactcatgctccaaaattctcttctgtctgatcttgtaatcggctttcatgagctgatactgatgtgcttgccccccgagccgagattgaatgatcttggcattgacttcttcttcagacatgtggatataaaattcatggtcccactaggcgtgccaatctgtgttgacgaaaaaaaatcaaacacaccggcctgggagatctgcttagctccagtgcaggtccgaatatgatgagatgcgggcgtgccagtcagtttgattctgcaactgacaagatatgcaaatagtagatcaaaacagccgattggctgacaagccgatggagtagttccagccgatagccgataacagccgatgccgataccagccgatagcgatagggtttaagcgatcggctatatgtccaatgtagataatgatataaaggcaatcggctgatgatgatgtaataaaataacaatataatccaatataaaccaatcggctagcaatgatatgataaataagcatcgatccgaaggttaaagcacacatcggctggaggtccgatgtcatgaaatccacaagattagattaaacaatgaaacctttgttgtcatcggctaaatccaacttatatgtatatgcaatcctcatgagccgatgcaacgtccagataactcaccgactgaaaccccgatgaaacccttattggcaatcaataagccgggtaaagattatggttctaagcacgacttagtagataaaacttaactgatgcagcactaagtatgaaaagaaacataatatctagacaatcaagccgatgactgattttcagggtggtagatgcctaagctaatctaatttagcanctggttagggataccggtagaaacctaaacgagaagcagccgatagagttaaatgatagttagattagattattagagacatatgataataggtaggcaaatatatcatccaaaccagagcaatccaagaggtcgaatgtactgatgcagccttgaacattggacttatcccttcgccgggaaatcaaaaacaaggcagccccgcgtcgggtgccaagttccgccggaacgtaaaaaacaaaagtagaaaaggtaaaagggtggcgatgcgccgaaatatattgatcgtagcgatagattacatagaccccgggtatacatatttatacccatgggttgatacaagtccttgtcagacaaaaaagaaactaacctaaagataaaaggaaaatataaagtccttatcggacactaaacacactttcctaaagataaaaggaaactaacaaactattcctaattaatagataaactgccatgccgcatcctctttaaactcggtcacttagagataagcttcctttagtagattgatttccttaaccgaatatagcaggaatccgactattggcgacttgataactcccatcggctgattccgagatgctgcagccgataatgattctaagctgatgacgtctttgccgattaccaaatttcactgttaacagtcttctacccttaccagccttcaacaaaaccaagtctggcacatagatccttttatcacccccagtttcgactaagtgttggagggacctccacccgaggatctcagcactccatgcattcagaactctatcctttaggtagaacgtcgacacgtatgatgttgaatcaagcttaattttagcgcacgcggccaggacatggctacatggcttatgaagaagcttcggcttattgcaaaagcacgaacatgtgttatcagattcgtgccctagagtaacttcatgcgtgatgaccccattagaagatccaaaaccccccttagtgcgacatgtgacttcccaccttcgtctgacgttcccagtggtaatgaccgtgtgaaatcttgccttctcagtgtcacgcccagaaattcccgaatagaattccaagcagaatgtgcattaaaacccccgtccaggaccggccggggtacacaaacaacaaagttgacatacagatccacgtcttacaaacattataaaagtcttacataaatgcagcggaaaattaaaagataactggagctaagccttgacttggaccgcagttggaacaccactccacaggcatcctcgacggcacggacgaagcctattcctcggagaagccgccatctgacgcgtactaaaactctggggttttggggaaaatagagcaagactgagtacaacccccgtactcagcgagtcatatcggaatagagggtatgatgcaggatataatcgaaggacagcttgagcggttcatttgcataaagcgagcatttaaagacggtagttgaaagcagtaaaacagttgtaataattactcaatattaaccatcaactgtccaacgctacaccacattgcgacaggcccaaccatccacctgaattaatcaattccattagactagactagggtgagactaatcacggtgaatctggttgactgcccataaccgcgggcacggctattcgaatagcttcactctgatcagaggtgtacaattgtacccacaagacacagccccatgacacgtttccgtgcaccgacataccaccacgacataccaaaaagaggccgtgacaggacccttcgcataaccccctctagccaagcacaccacacctcaggtttcactcccgtccccagcgggcaatgagcagtcccctctcgtgcctaggtaaattcggaagcgacagaggccgtcgtagggcccgccccgctccatcatgcccacccttgcctgaatgcgtcaactagaggaaagctacactacaagcccagccgttgcccacgctggcttgtggtaagtacgaggaatttttccagggtttcccgcgaaccggtccttaagtgccatgggcgcgaccatcaaaaccatgcacccacagcccaccataaggtatattttaattgactaacaccaggacggtggctttaatccaacaccaacactagaacctgaagtctatgaattaatgtgatttcccccacggtgtgctagttaaactaagcatggctaagcaatccctagtccaatctctagtcatgttatatcccaagctaacaaaggagcatggtacaaaagtagtatggctgtaacagcaggtaaacatctcatagtattattataaaacaatgcagtatttaaaggaaaatggtagagcatttgcaatataggatcaacatgttcaagtgacaagcatgacttgccttgctctgctgctgggggaacctcggcaactatttcaaagtacaccggagcgtcgggagagccggaatctaagcgacatacaaaagcaaacaatacaaacaagctataagactactgaaacagagaacaaaaccatttttaatggattctatgcatttttcttgatttactgagacttgaatgggcttaaatgaagctcggatgaattagatatgaattttagaagattcgctgtgtttttactataaccagaaaaatccttaattgatttattccgcaataattaaaatccacggtggaccgggtccacggaccggggaggagcggcgcaccacgtggtgcacacgtggcgccgatgcggcgcacacatggcggccacgtggcagccacgcgggcggcggggttggacggccccgatctacccgagggtagatcgaatggcggcggaagcgcgtggccggcgcgcacgggcggctcaaaccggcctggcggccatggcgcacggcagcgcggctcgacgtagcggtggcgcaaggcggcgaccggccggcggcggagggtggcggcgtcgcggcgacgcggacggcgacagcggtggctaagcggctaggcggcagcgtggcggctaagcggcgagagagagagagagagagagagagagagagaggaagaggaggaggggcctcaccaacgatgattgacgacggtgagcgacggagggcgatggcgacggcgggacgagcttcggaaccacctagcgaacacgaagaaaggggttagagagagaggaagatggaagagggcgaggacgccagctgaaggcggcggccatggcggagctcaccggcgcgcggtgcgaacggggttcccgtggcggaaagcggcggcggagaggcggacggcgtggccctcgggcttgcgaacccgacagcagctcggcgcggctcggcgcggcggctagcggctaccggagcggcggcggtggcggcggagaggagggcgacgacgctagggcgatagaggtcacgggagagctcggcgaaatggagaaaaagagagaggggagagcggggatgcttaaataggggaaagagggctcggacgtggccaggagcggcccgatttcaccggagtagtgggaagggggagagagggcgtggccggcgggattcaaaattgaatatcggccgtttcggcgcgggcgcgggcgggagagagagagggagtgggcacggggtcgcggggaaagcaggcgcgggcggcgacgtgggcaacgtggcccgggaggcgcaggcgcgatttggcggcggcggttgcgggatgcacggcggcggcccattcgaaaaagaaaaaggggaaaaagaaaaagaaaaagaaggaaatgaattttcctgggattaaatattgctccgaattttttattcataataattaataatgcagaaattaaatatataataaagcaaagtcaatttttacgaaaataggaaggacgctattgcatagggcgtccaggtgtggacgctgttgtagacaatgtccagatggggacgcttcttacaagggcgtccataatgctgcagttgaagaccccaaagagccgtccaattcaccggactaagattggactttggatccaatcacacaatggtcgaactctgcctcgttactcctatgcagactattgtctctcgttgattgcttgcttgccgagcaggcaccgctctctacctgatctgccagacagggtcgccatcccccggccctccttcaatgcttccactattccacatgacggacactctactcggggtcatatgtgaacagccaccacttttattttgagatatttgattagtttggtttttgttctggtccattgtttactacgcatcgagctctctgctgactgaatcttgagaagcggtcgccagatgaactgcatgcgatgtcttcgatcgatgctttttttttccttttgcaacaggccagagattggaagtcatcgggcgacagatgatctgatagaaggaggatgtttgcgtcgtacccttcgtaattttgcattctttctaaactttctattgcagaacatatacacctgaataccaagatctatgaattgagcatacttgctcggccagccacctggagtgaggcgatgcctggacttgctggtaggaaccaagaggggcggacagacgacgcagcacaagccggcacgagtgggtttttgttccagcatgactcaaccagaacgtggatagcggctgcgacctcccggcgtgaaggcagaaagcggcggcgtcctctccggattcgagagccttcgaggtgagttgaggtgaactgcaacggcagattcctgacgttgtggaggtggaagccggaaggcggctattgcagtctcccggagtcgaggtgaacggcgggcatggcaacaccttgcccgagccctgcaccaacattgggcccgagaagaggagagtcgacgatggcgcctctccgcatggcggcatgggcgccccaaactgagcctggacgtgcttcggtacagcgtccacctctgaacacttcttagaacagcgtccaaatctggacgccctttgaaacaacgtccatcctatttttacaaattcaatttaagatttaccacttatttaattcaagacttattaattactataaataaaaaatttggaatattgcttgtgctcatttttaattggttaaaattatttctaaagctttgaaaattccactaaaaatcttgttagcatatttcgacatgtagaactcaagaaaaattccacatgccaatttcgattattatttgcattaatttattagggtttcactcttgctttcacaccggtattttctcgaggtgatttataaattcaatttaggcttgggaaaagaacttcagggtgtgacactcagccttctcttggaggtactctgccatctttttgcagaaaggtgtttgtgtgttagacatttgttgcaacgctatggcccgcctcgtcctcatccacatcgttgtcctgtgcataatgccttctacaatagcagttagaggtaaaggccttaatttgcgaagaaccgcattgtacgcctctgcaagattagtggtcattatgccatgcctagccccattagtgtcatgcaagagtgcccacttatcattcggcttgcactcaatccaatgggtaaagcatttgatattctttgatgacctacgcttctttccatttgatggaataagatcatccattggttccagggcctgggggacatgtacatcctgcgggttgttgttggtctgctttgaccggatatgtgtccttgtcccctcgtcaagttgttttcaaagctcatcgaactttgtagactgattttccttgcacaaccgcttgaacatgttcatcagccgccggctgttgaattgtttgaaaaaattggcccccatgtgccgcatgcaccaacggctatgcatgtcaggccagtagtatgcaccatcaccatcctcctggagctctttgattgccttcaacagaccggcattccagtcatggatgatacatatcgatgtgtgtttttgcaccactccccacttaagatgttgcaagaaccacaaccagctttcgtagttctcgctttcaacaaaagcaaaagctaccggaattatctggatgttcgcatccgcaccaatggctgttaatatctggcctcggtacttcccagataggaaagtaccgtcgacacacagcaccggcctcgagcacttgaacacatgaatgcatgctccgaatgcaaagaatgcccgttgcatcacaagataatttggaggacgaattgactcccaatcctgcacagcaacataggtcccagggttcctgctctttagaatgtttagcatctgtggcaatgtgtcatatgcttcctcaaatgtcccatatcttttctccatggccttctgcttcgccctccaagccttgtggtaactaattgtgtattgttcacctttctccaccagttttattatgtgccgcacaggcaggtcatcaccttcaataatttccttgtagtacttgttcgcgacgtacgccgcggtcaagttgcggtgcgactccctagtattccgaatcagacaggagtgttcctgcaatttggacacaatccagtaagactcgtactttggcacgtgaccatgacgaccgtgtactcagtcttgttagacttcacaaccctgaactgcctttgcatctagaatgaccatgacttcactgcgtcttgcaacccaattttgtcacggaacattgcacccagattgatttggccatccccgtagaaccatattgaatcatgacaagagttttctgcaatataaccagggtcttcaaggttccacgaagcaggcataggtacttcctcaacttcttgttcatcttcgtcatcattctcttcagcagcgaggttttcctcatcttcgactgcatgtcggtccaccctctcaatttcttcaactatagcaggtatgtcctccccttcatcggcttcaccagttggatggcggttgaccacttcatctccttgtatggatagattttgaatgtcaggaccaacatcgccaccatgatggggagctacaacttcatcttcttcgtgtgaactagacccatctcctcacgattgttggattgccccgctgcgctctccgtggggactcttccttgacatgcttgcaccagcatgacatattcatatccccgtctcctacagccagcgagccaatcctgccaggccttactccgtgtcacattttttaactcccattttatgttgttggccgatcggctccacataaccctcacgttaacactatatatacccggatctaaagaaaatgtgctagttaaccagtaccaaacttcgggcatggtaagtgtgtcaggatttggatggtatagtgtgcattgcctaaagttgctcagatcgacaccactttcattttccataatttcaccttcaccgaaatacactctaaataccgacattcctgccattgtagaaaacacagactactccgtatggaagtcttacagaacaaacgtgtcctattcacgaccaaaattactttacacgcatactgtttttttgaataaatattctttatcaataactacttacttatatttccactgtatttaaccaaaaatcatgtacttgtaataaaaaattataaataaataattacgtaaacataaattatttacttacgaatacatgacaatgcaattcattatttataattgtactacaactttgacataaaaaataaacacatgacaataatattaatacaaattaattaattaaaacacgtaattaaacataactatggcaattaatttaaataaaagagtatgtaatacttaaaacaacacaaccataccatatcgtacataaatatgaagtctttaatatttacctacgtttatcagatcccgcctactcctttataaccagcttgctcgtataacaattgctgcctcaaagtttagttcactgcataatccatatgtttaactaacaaattaattatacaatcaattaagtttaatacagcaaatgactacttgcaccgaagaaacattgacgaaagctaagttaaaaatcattttggttagctctttctattctttatctaggacaacgacactcatttagccgcatcatgttctttgctacagactgtttgtacatacttagatatgacctctgaaacaatactaatattgcaaatttggatgagtacatttaatatattagaactttaactataaattatataaattatctaacggaccgtaactttacttaaatacaaaatatttgtaactatcagttagtacaaaattatctataaattaatcataacatgataaattaatagaactaagttcaacttcacttcattaattacataatcaaattaatcataactaccaatttattatagtttaaaactagttgccatgacataaatttatttaactgcactttagttacaataccaaataaattacaaactgtctattaattacaaattgtcttccattatagtaccataccttgtcttgccttcttcttttcaaccaatttgctcatataaaagtcccaatttcaaagttcttcgtactactgcatttctttgttcattcataactacctacaatgttaagcatgtgtttaagcacaccatatatttcccgctacttaacgaatatttataccttttccatttcttactaaataaataactacatgaactactaattaattgtaacttaaaattactacaaattaattacaactttaatttaatttttctaccacatttaataattatcaatactattaatatcaatatcaataactacaaatataactattgatatttcagtttttttcatttgttacatataatattggccgtatatataaaattaaacatcacatgaactactaattaattttgtcacataattactactacgtaccaattaattgtaacttatattatacttttgtaccttataaattaattatgtctacctattttttaacccgaatcgactctattaactttctacatttgtatttttacatacgacctaacaaaatataatgtagtactaactaatacataactaaatttttcactaacataattaaaaacaaatattaactacgtgaactaaaattttctaaatcctcatcgtatgaatttgtcctaatagaaaactaatcaacttacgtgtctttttttccttctctccactgcctgcactgcctcctctcttctcttctcttgctctgcctctcctcctcagttcattcccttctgtcttcctctgtgaggaccatctcctctcctctcaatttaacccgtgagcgcattggattcgatcgatacaacgcttacaaatggccggcatgatgtgactaaaatagtaaactgataagagtgcactgagctcctccacctctccctaaaaagctacgcgcatgtggtgtcggaaaagcacaaaaaaaaacccgtgcaaaaagcacaaaaagcaaaaaagaaacagggatgggaaataaaggtatcggtggacgctctcgcgcatgtggagcgcgatagcgagggaggtctcgcgcgcacatactgcgagaccgagcccactgccgctccctctctacagtcgctctcgcgcacgcctaaagcgaaaccgcgaccggtctcgcgctcccaaagcgcgacgccgcgggcccaccaggctttctctctctcgcgcatgccgcgtcatcggtctcgcgcgcgcaaagcgtgatgccgcgtgcccacgtctcccccgtcgcgtcataaccggtctcgcgatttcatattacgataccgacgtcggtctcatgcaacaaaagtgcgagagcgctggctccgcccgaggtagtcgcattgatttctccacgtggtgctctcgcgcgtgggaaaagcgataccgctgcggtcttgcgtctcgtttgcgcgagagcgccagctcaacttcggtatcgctctttcggatagcgatttcaccacgctatcgcactttccaggagcgaacatcggtatcgctcttccagatggtttatttctgcaaatcgtttgctatccggcatatttttgcacaatcaatcaaaaaacagtttaatttcaaatttttttctcaactttgtagatgataaaagcgtgcttttgagaaaggttgagatattaaatacataccggtggaggggggttgaaagcattgtacggcaccactggcagcaagtgcgagtagctgactacgattgcatttgagaagattttatacattctctccttcataactttgaattcaagagattcaggatcttcacggttagggtcatgcttgccgtcgaattcaaaggccgtgcgagatctttccttgattggggccagccggctcttgataaaatgctgggtgatctgttccccttgcagaccctgctccttcagcttcagtatacgatccatcagggcaagcgcttgagcagcttcatctcccattggaagtgagttccaagtatcttgatacactggaggaaggcaggagtactcgggaagagctggttcgggattttgtactggggtttgaggaagaagatgcgacagaacagggcaaaatgcggtcttatacccaggaaagcctcgcaagcatgaataaaattggcaatgtggactatggagttgaggtttaggtgatgcaaactgatcccgtaaaaatccaaaatttcccggaagaatcttgaggttggaagagaaaatccgccatagaagaaatgagaaaataccacgacttcacgtgtgtcaggggttggaaatgcttcgccgcacgccggacgacgcccgatgatttccttcgccggaagaacaccgtgtgctaccatttccttcaagctctcctccgtgacgtcggagggcgcccattgactctcgaagctttctctctcctccaccatggatgcgaattggatgatgcgatttgctttcgaaatggctgggaatggatgggggatcaatgcggtggatgcgcggaagatttctgtggagttttggaggacggatttgagcgaatcggtgaaccctagtttcgccggtgcggttttgcactgtagcggggaatggggaaagtggcgagagtctcggtggggaagacgaagcggtgtttggtttttggtattattagggtatcgggagtactaatgggcctaggcccggaacagtacttcagcccatttctttctatcagcgtggctaagttgtgatccttagggacttaggctttttgcttcggtaatacttgctcgcaacattgtagcccaatgctgctaaaatcctttttgacgcagttagataattccttggaattatcatgatgcaaataaaaaggtgcccgacagaaaggtgttatacttcttttgtaagcctttttaggctgcaaaggctgtttgggttttgttgagatgattggtttttgaatagtcattctctcggcatgttatatgcttattttgattatggcgtgagtcatagcctaggctatttcgactcatcaattgtcatgatatcatatttataccacatatgatggatctttgagagtttttactcggatttttgtcatatgtgttgatttatggacctttggagtattttttactcgggcctctttatatctccatttttggtatattaaagctaaagcagtcgggtggatgttttattaaatgtcacatgtgctcggctgtgttattctttggaacatttggttgtaaaaccactcggttggatgttattcgaaccttgactatatgtttagtttttaactaatcacatagtcggggctacacctaattaggtgcatctagtcgatgcacccgatttttttctattttcagaccttcacagtatttgattttgatactcggagatcagggcagaagaagtcggagtactcagattttcgttttggattataagagaagactatttcgtcgactggaaaggtctcaggggctactgtggagattatggataccccatacctacacggcatgtatagtccgactgggtatggggtgtcatgtatagatagaatatctttaaaaggactcgggtt

SEQ ID NO: 8714 - DNA, 4011 bp, Oryza sativa
gccaaaatcttgtttcgacattcaccttgatgtaattgcagtatattcgtcatagtatttggttatatcactaatatattttttctaataatatgctcccatctggtctataatttttttgtgcactcatttttatttctggtctttttctttgtgaattatgagacccactgtacattcgattgctttttaagttgtgttatactcctctgtaaaaaaaaacagttctggggatgtatttggtcaatgtgtatgtacagatacatcccttggattggacctttttttcgaaggtgggagtataactttagttgattcgtccttcattttgtagatttattaatattttgttttgattatccatcttcgttgacaaggtaattaagatgaaactagccatacacttttcatctccaattgattcattcattacttggtactatgatgtctatatttctccctaaaacattttttctaatttgaaagcaatactagaattgggataagttatatcgatgacattattatctttcgactgttctgactaattatgcatcaacattactttatcatagtttatcacttggttcacttcacacatatatcttataaatccgtcatatttctttaccttttttatcacctcaaatttcatccaaaagttgcttcttcaaattcctgcagcaacgcacggggtatcatctagtttatactagctagttacctgtgcattacaacgggttatcctatcttactataaagttatcctccactaactccttaagcttgacatgcaaaaatgccacatcatcatccactaacaagatgccacatcatcatccactaatccataaattaacaagataccacatcatcatccactaatccacaaattaacaagatgccacatcatcatccactaacaatcatcacatttaaacatcatgcaaacatgctatatctttatagttattataatttaaaagctttcaaatacaaacatgttaaattatcatccaacataattcacataatgttcaatgtatatctttattatattttatgatatcctatatacttatatagttcatcctcacttagttagtgcttaaatgattaatctatggtccaaattatttttctcattttttcctctaattaagtcatatcacatcaattgtttttagcctttagatgattaatctacagtctaaactatctccctacttttcttcttccataaagtcataccagcttactttttacgtttgaatcaccattctacatactatttaaatttaaattatcataaaccatattaatttacttaatctgatgttatctagctatcttatacattatttttttttgttatcatactaaattcccgcagcaatgcgcggggtttcacctagtttaaattataattgagtattattctcatacttatatataagagtggtaactcaaaattaattatatgtaatagttcttatgagaatgttggggctgcccaaaatcaaacaccacatctctagaaattaactgtagctttttgcaatttatccaagcatcactaaaatattatcggtgttggtgccggcgaccggctggtcagacatgccttgctaaaaggataccaaattaccaatctagatgatctttgcgggtaagcccacctccccgttcgtctattgtttggtgatgacgcccaagagtgagaggtccgaccattgggccatgggttcctctgtaccgtcaccatggacatagcccgcttgacacaagtaaacaatgtaaatagaaggtaaatggtagcatgataagcactgcactagagcttcatcaagtatagaagacgatgtgaatttgaggtgttaacaacaacaaaccaagtttgaagttgcccatcaaaacatcactttgactaaattttgcataacatgctttactaatgttgcgtaagatccaattccttacggacaagaatatttccaacaatccaatgagaagacccattcaactatagtgcattctaaaactacatgttttttgttttgtacatagtggctttcacaatttgaattcacaaactacagtgagcaatgcattcttattcatttaatatggagaccctctttttgtacaccttagttagatgcatgggtaagtgattggtgacacttatgtactcgatataacatttaaattctacaattcttcttcactagctgtctttgattatcttgtggttcaatcatgacattttgagaaaaatctcatcggctcagaaacacacttgttgtccgtcagattgatgtcagtgcatcatatcaaaatagaggaatgcaaaccacaagatttgactcacactacaaaaagctaaaaatacatatagatggggttatattctctttaggagcatgactataaaaattgaaaaactaacaacaagataaactatcaaaaaaataagcgtgatccaagaagtttcctctcactgtacacttgttagctgaaacaaattcaacttaatagtttgtaggaaagtatattgagaaagaaataaactatgtgttaacaaccaaatttggcgtcgacactataccattctccgaagcaacaaaacatattttgcatatggatcagcatttgtctgcaactcttgatccattattccattagtccccccccccttctctcaggagcatcagcaccaccatcataatcaacactcttttgtgctaatctccctaacacattcccattctccttgtagtaaggtctttgaccatagacaggggcggagctacaatgtgatccctgtggtccatggaccactatagaaatatggcccaaggccgattacccctatgcatttctttagaaaaaatatcggtgggccatcgtttttttgctgaagacatcgcgtcgcttcgtttttttcgccgcaacccgcatgacgctgcatcgacgcacctcttcgcctcctgccttcggtgtgatcgccagcgatattgaggggcggagcggcgggcggcaaccagcaaggcaggtaagtaggcaactacggcgtcagtgtcaggccatccatcggcacagcaagcagcaggccagccgccagtaggttctcatctcccccattatccctcgtttctcttctctcctttatcctctattttgatttaggtcagcagccagcaaccattaggcctaaccttaggtattttgatttaggttcaattttattttgattttaggattttgaatagtattggtatgtaaattgatataatcaacacttttatggccaaaagaagtagacctgacaaaaagaagtagtactattttcttcttcaattatcatggatgtgtaagttacatttaagtaatttttagacttgtttatcttaaaatgttataaggcctttattgtttgacctgaatgcgtttgataaattttatctagagtattaaaaaaattattttgtgttggaccaccctaccttaaaatcctagctacgccactgaccatagatctcacctccttaggagaatgcaagctacaatagctagaagaaagcaaatccacttaatagcagttgttaatagtagtatagattcgatgtttgcttaacttttttgtttagtacctcagtttcaggtaataagagtttctagcattacacacattcatatagatattaatgaatctaggtacacatatatgtctagatttattaacatatatatgaatatggacaatactagaaagtcttataatatgtaacggaggaaatactaattatcatctttttgctttttgtttatgtaactttttgcttaagtgagaattattatcttgttgctagggtgacctgatttagcaattaatttatttgatgatcatcatgcatgttatagataaattcagacattaattgaagaaaataaaaccaatacaacttttgtgcaaggatgcttatgagctaaaatccaaacttatttcta

SEQ ID NO: 8715 - DNA, 19332 bp, Oryza sativa
  unsure (1)..(19332): unsure at all n locations
aaaagcaacaaaaaaaactgcattacttagtagccattcacatttgctacctcaagcctcacacctttttccagcaacacatcaaccacaacaatggctccatgcaccaccccgaagtgtagggccatttgctgcccattgtcccccgtgtttatgccgtctccatgctgcccatacaaaacccattagctaaaaaagggacatagcaacaccctaatccgaggctagcagtgagcaaacattatagcgaagactgcgacatcggccggaaccgaccttgatgatggagaatgcgacataggggtagtggttgggagcggcgtcaattacaattacaggttatggctaggtaggcgattaggaggccacactggccaccagcacccccatggcgtgctgtagaattagcaccattggcgttcgctcctctggcgttgtcttcaccaaagcgcaagatgagttagagtcgatgtttgcctcatcaccgtagaccacgagaccaagcgacaacttcaggcatgacgacggtggaacattgtcccaggaataagctagctacaaagctcaagatagatagaatacaacatcctatcttttgcgtgagtgcggcgtcggttggtatgcgcatagaaaaacatgagatggtcaggcatgcacaaacatagtgtctctggtgcacagtcacacatattttggtggctttgttggatgaactagttggccacctcttgaaagttggttgtgatgttacagaagattctcttgcatgcgtcgcatcacatgaactaagtcgagacttcgatggtggtaatgccatggtgatggattggtgttcacctgcttggttggtgtcgcaaggatatggtagattcagaagaaagttatcatcgtcgttgttgtttgttgttgttattgccactgccgtttgtggtgtttgtagtgttggcaggtggtgtggcgccatcatcactggtgttggtgctagagcttgttgtagatgcattgttgcactattgatgatgatattggaggtgccacggatttgctggtgacattgaagttccaaagaggttgaagcatgggtctactaggaacctgggactacaccactagggatagagccactcgtgtttgacgagcaaaccggtcgccgagagcacaaaagatggactcacaaccgcatgctcaatattagggataggtataggctatggctgggcaatcgatctggagaccacaccatccgctaacaccaccacgacatgctgcaacattgctatcgctagcgtccgctccttcagcaacattttcactcgagcacgtgagttagaactcagaatcgatgttcgtctaatcgccgtagaccatggaccgagtgacaacttcagccacgatagcagtggcacattgtaccaggaacaagctggctacaaagctctagataggtagaatacaacaatgtatcctttgcaccagtgcgacgtcgattggtatacacatagaaaaagatgaactgatcaagcatgcacaaacccaacgcctccccaagcagtaggaacaaccagttgatatgctccttctcggccgcgatcacccgatgcattcattactattcaccgcaagcacactgagatggctgggttgccgatccagagaccacagtagctacaagaaccccagggcgtgttgtagcatcgacactgttggtatctgctcattcagcgacatcttcactggagcgcgggaggagtcggagtcgatgtccaactcgtcgctgtagaccacgggactgagtaaaaactttagccccgatggcgaggtcagatataatatcctatcctttgtgcgagtgcaacgttagttggtgtgcgcacagaaaaatatgagtttatcaagcgtgcacaaaacggtgtcccccatgcaataggaacaacatattgatatgctcattctcggtcgcgatcaccgaacgcatttaattctggtggtcacagttgtcgtagtctggtatgttgggtttcatccacctgtccggtgcatgatcacacatgttttaatggttttggataaagtggttggccacctcttgaaacttggcaatgacgtgatcactggagtgaaggaggagtcgaagtcgacgttnctgcatcaccatagaccatgggacagagcgacaacttcagccacgatgaagcagcacgttgtcccatgaataagctggctacaatgctctagataggtagaattcaataccctattccttggcgtcggggcaatcccggtgggggtgcccataaaaaaaatggaaatgatcaagctggcaaaaaccctatgtttacccaagcaatagaaataactagtttatatgctctttcttggccataatactagatgcattcagttttgttgcctatagttgtcatagtctggtaagttcggtttcatccacctctctggtgcattgtcacgaatgctttggtggttttgtttgaagtagtttaccacctcttaaaacttagcttctatgttgtagacaatctccttgtgtgcattacaatgccttcatcgagccaagcctttgatggtgatgatgccacgttgagacggctcaaagatggagtagtgtttggccttttggtttggtggctcaaggatacgatggattgcaaagaatgttaccattgttgttgttgtcatcgttgctgccaccgtttgtggcgttcccaatgttggcatgtggtgcagagacatcgtcgccgctactgcttgctatgaatgtgttggtgcgatgttgatgataatatgggaggtgtgatgagcctactggtgacgttgaaggtccaaggaagttgaagcatggagctaccgaaactatttcactagggatcgaaccactcataccatcggtgaataacaccctggcggccatgaaagcagctcagtcattgccatggtgatatacaagcaaaccggtcatcaaggtcacaaaaaaccgagccactaccgcatccttggtattggggacatgtacaggcgatggctaggtagccgatctggagactacattgactaccaacaccctctcggcatgaagcagcacatgcgtggttggcgtctgctccttcgacgatgtcttcactggagcacatgagtattcggagtcgacgtacgccgcgtctttgtagaccatgggacagagccacaacttcaaccacgactacaacgacatgttgtcccaagaaaaacttgttacaaaggtctagataagtagaatacaacacctatcctttgcgccaatgcgatgccggttgttaagcacatagaaaaacttgagctaaccaagcatgcacaaacctaacgtctccccaagcagtaggagctaccagctgtttgtctccttctcggtcgtaataaccagatgggttctactcttctggtcatagtcgtcacaatctggtatggccgggttcatccatctcgctggtgcatgtcatgcatgggcatgtggtttaggaggaaatagttggccacctctcgaaacttggccataatattgtagatgaacacttgttcatgtcgtgtgcctgtgctgaacctcaccttcgagtgtggtgatgccacaatgagaaagctcgatgagagagtgatgtatggctgcttttttggtagcccaaggataacgttgattcatgagggctctatcatttatagagccaacaccatttgtcattgtcgttgttgccaccattttcaccgttgccaatattgccaggtgtatcagctgcactaccactagagtttgtggtggacgcgttgctgcaacgtcattggttggaacatggtgggtgacacacatgcactgtggaggattggtgatgatgttggagttgcaacgacgagcctggtaacattgaatgtgcaagaaagttgaagcgtgaggctacttggatggcaccattgacattccaagacactaggattggaatggggatcgaacctcttgcatcacgtgtgaaaagatgttggtatttctgttaacagtgaaatttggaaagtccctaagagaattatcgcatcgccaatagtcggattcctgctatattcggttaaggaaattaatctattaaaggaagcttatccagaagtgaccgagtttaaggaggatgtggcatggcaagttatttattaatttggaatagtttgttagtttccttttatctttaggaaagtgtgtttagtgtcctataaggacattatgttttccttttatctttaggaaagttgctttcttgtcctagaaggactagtatcttcccatgggtataaatatgtacacctggggtcgctgtaaactatctctccacgatcaatgcaattcggcgcatcgccaccttttaccttttttactttattttatcgtccggcgggacttggcacctgacgtggggctgcattggttttcgatctccgtcgaaggggtaagcccaatgttccgccggccaaggcaattgtatcatctacgtcggtgtcgttcaaggctgcattagtacattcgacctcctggattgctctggtttggttgatatatttgcctggctatttatcatatgtcctagttaatctagtcttagtatatcaatttagctatattggttgtctctcactttagggtttctaccagtatcagctaaattgttttactagattagattagctaaggcatctaccaccctaaaaatcagtcaacgggttgattgtctagatattgcgtttcttttcatacctagtgttgcatcaattaagttttatctactaagacatgtttagaactataatcccgagcctgcttcttgactgccaataagggtttcattggggtctcagccgatgaggtatctggatgttacatcagcttataaggattgcatataagttggatttagccgatgataacaaagatttcaccgtttaatctaatatgtggattttatgacatcagatctccagccgatgtatgctttaaccttcggatcaatacttgttctattatatcattgtttaccgattggtttctattggattatattgttgctttcttgcattatcatcagtcgtttacctttatattgttatttacacatcaagcgtcaaaatctacatcagaattatagccgatagctcaaaaccctattactatcggctggtatcggcatcggctggaattaatctatcggcttgtcagccgatcggctcattgatctgctatttgtatatcttgtcggttgcagagtcaaactgactggcacgcccgcatctcatcaacctttggtcctgcactgaagctaagcagatctccagggcgttgctgttgtcgacctagcccgcgccaacatagacctagcaccataggccaagcgcagatttctcgtcgacactacctaccgcctacctcactttccgtggagcacataacaaactaaagtaatttctaacctagataccataactaagttattaattactactctagctttgcgcaggaacttccctctttatccatagtcctagtactagagcactcaattggacactaagcaacgaacccgcactaatgagaatatatctcacttaaataactaattaatgaacataaagaaactcgaacacttgcttgaataaaggaagcatccgccgaagtacaagtgagagaaaaaggccgacaatcctggctttctctggaactccattgaaagaatgctgacactccgcactcctccataaaattctcgtaggaactccgatatttcgaggcactccttctggagcttcccctcactctctaccaaactaatatattaaatatgaaactacaagtgagttgtactctacttgagctcaaagttgtatttattgaagtgtgtgaggcatcctccttatatagccttcatatgacggttgagataatcccttatatgcgactccaaattaacaggttctcttatatgccaattcaaattggctcctcccttctatgccactggttcaagtttaccctcacttatatggcattgccttcactccatcgctaggtgaccattaactttatagtaaaaagactcatttccattgagagttggtatacaaccaatgataggtatttttcgtttgatagagaacttggttgatatgtatatgcatatagcattttactaatatagctactacatatgaaaattgatttttttggatcacgtgcaattttagccatcaccactagaaatgaactttcaacaaagagagaatctactccatgccactgacattgtctcttactataatataccggtgactttatccattccttacaatatgcctttgggttggacttttattaaaaatacctaaaataccttatagacatacaatgttaacaattaatttatctcattagaagtttaaaaaatttgaaaatttttatgtggcctccttacataacatggggacttgtatataagtttcaagttttttctaatatatttatttttagaagaaatatttttgtgtggtatatgagagacagtttggttacacaaaagataatacacaaatattttatgtagtgtatgaaagatgatttatattaagtattttatatagcatataatagataatttatattttataaaaaagtagaaatgcaaaaaaacttgaaacttgaatacaaacgtccatgttgtgtaaggaggctacatgaaaattttcatatttttttgaaacttctaatgagataaatcaattgctaatcttgtatgaccatgtattttgggtatttttgaaaagaaggttcgatccagtggcatattgtagaacaattgatgaagtcgttgacatattatagatattatagatagagacaatgttagtgtaaaattgttaaactcggacaaactcaatggtatagaatagattcaaacatgcatctcttcaataattttttagtacaaagagcatttttcactggttctaaaaaaattgttcactcaaataaggattcaaaatgaatcagttatgaatttttgaagtttaaacttacttcagttatagaataaaccattttatcatattctcatcttttactattccaacctggtcgggcccacctgtcagctgcccagaccagatgaggcatgggctggcttggtcaccagtgcttctcgccggcgccggcggcgaacggcggcgcgactcggtttggtcccaaaagagaaaacacagaggagtaaaaggcgaactctccggtggtggttttgtcgtcggatttggctggaggctcgctagcgactttgatttgcggtggccgtagtcgggttgaacatgcttgcatggctacgtctgtggagtgagcaaggcaatgcatgcaggagcaaacacggaccccaaggaagcttaccgagctccgagacaggtccggcgaggtcagggtagctcgagcgccggtggactagtctcgcagcaacagggcaatggcgaacggcaccatcggttagatgtatggacatccatcatatgcacgacgtcaagggtggtccaggttgctccaggtggaaggaaacatatcgaaactcactgggtcgacaggatcgtgcggggcggagctcagtcatagccgggaaagatgacgctgatctcccacctcgctgcatggatcttggggctatttagggcgttttggacctggaggggagttaaatgtgttggcgaggcaggtcgactcgagatggtccatggcggcaggaacacgagctcgatgccaaggccgcgcgctgggcgtgcccttgagctcccacggggcgtcggcgttcccaacgctacaaatgacgaagcaaagtgaggtcacagggagaaatgcttagcatgcatatttgggtacaaatcaattgaaagaaggagcttttgaagaggaatcgagaaatggcagcggcttgctctccatggctaacggcaagcaagtgaagacgagaatgacagagcgctctctttgatcggatttggatcctctaccttcacggcttgaaggcacgagcgtgcagtcggcacctcatccaccgttcaaataatccaatggctcacgtcgcctgtgcacgtctgaatggatatctgtctgtcaaagcccacgaagtactactgctatatttcagtccgaataccaatgatgtttgcattataaatttcgtaatttttcttatcaatcctatgctctaatcataatttttcttttgctttttatgatgtgacttgacattgcgtcatactccctccattagttcccaaaataaaaacttttcatctagaaaaaaaactaattacacagtgtgcgtgtaaattgcgagatgaatcttttaagcctaattgcaccatgatttaacaatgtggtgttacagtaaacgtttactaatgatgaattaattaggcttaataaatttgtctcgcagtttcctagcgaaatctgtaatttgttttgttattagactacatttagtatttcaaatgtgtgtccgtatatccgatgtgacaaccaaacccaaaaattttctccaactaaacaaggcctaagtcgcttgacttttttttagtccaacttcttttttttaatttttaacacaaaacaaatatattataaaaatatattcaacgttagatttaataaagctaatttgatattttatatattactattttttatataaattagtcaaacttaacgatttttgactagaaaaaaagtcaaatgacttataatatgaaaaaagatggagaactactttgtaatgaattagtgttgttatttgaaactttcggttttcttgtatttttaatttggtgatatcatccatttttttcatgtgtattagcactaatatagtttgtaagtttcttcagctcgcgtacacttcccagaccaaaacaaccatcgtgggattttttttttttttttttgcgatagaaccatcgtggtctttcacagacaaattcattcgtctgtttaagcgcacatgtgacgtgagccgttggattacttcaatgatggataaggggctgactgcatgctcgtgccttcactctacaaaggcagacgatccaaatccctctttgaactggggcagtgagggatgatgggtgagcttgctaggggaggtagaaaagacgagctggagccttgaggcttgggacatgcgggcgtcgacaagtgacattggactaaatactattaacagtcaacaagtagtggtataagagggtaatcaaacttaaaccaatgccatttttagtggcataaaaggtaactaactaatttggagtggcatataagaaattctctcatgatggttatgacggttgaaaatgtcgttaacacccccccctccccaccaccttcatttagagacaatctaggatgtacacgtggaagaccaggatcagaggcgctagtgacggttcggccgaaccctgggccctaggtcctagtctctcctttggccaagagactgactggtgggcccttatggcggttagatggtttggccccattttaagttggttttgactaatttgtgggccctccaatccttgtactcacacataattggccagaggttcattttcgtcttatgtcgggtgtattttctccttaattaacctgcatacatataattaccaaaactagcggaagtggttagtagtaaactcctaccactaagttttgatatcttttatacatgagttgatggttaaagtttacacttaacgaccgtcaacaacagaacattgattgccatgagagcagctctgttgccatggtcgatcacccacactggttaccgagaccacaaaagttggagccaacacatcatcggcattggcggcaggtgtagatggcggctcaagcaccgcacccaacactcccacagttgtatgttgcaccaccgatgccagtggttagttctctggcaccgttgttgtcaccgaagagttgtcgatatgtttatcgcgtcgccgtagaccacaagactgagcaatagcttcagcaacttatcctcatcgccgtactgatccatggggaacatcttccttttctgccccaatgaggagccaacgtcgcgcacaagcgatgtcacctctaggggcgtgcctaggttatactacccggtgtcacaggacatcgggtagattattcaaatcctatataaattacactatattaattaatatattagtcaataattagataattagtatgtattaaacccccggtaacttttattctgggttcgccactggtcacctctgtcctcatgacgagggagagcacagaggtgcccttgcccacttcaacaattaactcatctgtggatatgcaatcactagtgtagatcttgtgatattggagattgaggacacgaggctatgccatggtagtaaaacaagtagagattaaagcggctcatcaaaatctttcacgcagcgtggtatcgcgtcccctcgtttcaatcgtgtttcaccgaccggactgattcgatcgagtgtagtacactactggagaaatgatctttactgggtcggccgatttccacaatagtcccggttgctcgaaaaactgggactaaagatcatctttagtcccggtttatttgtgcaaggggactatgtgatctttatcaaccgggactatatttagtcccggttcaactcgtgtcaaaggctgtcaggtcctcagagatatttagtcccggttggtaacatgaaccgggactaaagatcctaaattcagtcccggttgttattcccaaccgggactaaaatttatatagatttttaccaaccaggactaaaaatcaatataccgtatataatacctttgcacttatcctcaaaaatttccatctcctattcctcctcctctctcacgcactcttatcctctcattatcttcctattcctactcctcctctctcacacagtcttatcctctcctttttctcacaacgccggcgaggagcgggtgggccgcggcggcggcctgcgcacgatagcggggccagcgggcggcggcggggcgcggaggcccacgcgcggaggaggaggctaggagggcggtgggcggcgggccagcgaattttttttttagaatttgtgattggatctgagatgtattttggtttgtctgtgatgtattcacgtgatgtatttgcgatgatttttttagaacttgtgatgtaattttttagaatttgtgatgtattttgagatgatcgatttgaagatttggagatttcttttgttctgtgatctatgatgatctatttggggatgatgtggagatggagtaaaatcaatattcaatattaaaaacaattaaaaaaagtagtaaccagtcctggcctggctacactgggactaaagatgtatctttagtcccgagtatttgaactgggactaaagatctttagtcccgagtatttgaactgggactaaagaccgccatctttagtctcggattctcccacccgattcgctacccgggagtaaaggggttgcgaactgggagagaagagggtttctccagtagtggtacatactggtgtagccatacagctgagtatgtaaggcaactgcgagggggcgacctaccatgcaactgactgcacgcgagtgcaggctcgaggtgagtccatcccctatagcatatgtacttcatatatactttatatacgtataaactttgtatacacacctataaaaaaaatttgtatatgtataaagtttttatgcgtacgcacacaaactttatacatacaggtataaagtttgtatatatacgtacatatatgaatagaatattccatgggccaagaaattggaaaatcgagaaattttgtagaaattttcaaaattttgaacactgctagcgtgtggcccagcttacgagttacgacacgagtagctaaccttatcacagcgactatcaccagccacagagtggtctacgcatgcagagatatatctttcttctctcccaggttaggtcaattcatgcacaactttctcaaagcgatcgaagtggctttttattttgtctgacgacgaaactgacgagacggccgggccaatcagcctcccctgcccgcatgccggccacgcactaactcccatcgtttgccggccgcaatttgccggtgaaatcaccgcacgctcggctcggcgacgacgatggccggggatccactcgggatgctgcttttttttttcgctaaaggcgacgcggatctcgcgtaatcttttgctcggcttgctgtgattgacacggtgtctacctggcacctctcgctgccactgattagcattacaagtgtggttagtactagtactagagcttttgtttccgttaattagtgtagcgtgagcaaggtatgaggagaagtgtggtttgacccgggagggtgatcgcaaggggtcaactcttaggttgggagtatttatcactttatcagggttgagaaatcgtcgaaagtagtggtgtttgaatcttctaaagatgaagatgaagataaagatcgagtgtttcacgcaaaacgatatggtaataatatgtgattaattgagttttaattattacaaacatgaaaaatcgattaatctgatattttagagcaactttcatatagaaagttttcacacaaaacacatttgttttggatactcgtggcacgattttcaaactgctaaacggtgcgttttgtgtgaaaactttttatataaagatagaggtaatcttatcatcattaagaagatatatacatggttgtaccatatttttttctactgtaaaactttgcatctccagatagtaaggtttctcgaggtattaaaatttttagggtgaaatttcggtacctacatataaataatgcaagcataatatcgggttcattaggagcaccagagtattgagattaactacgtgaaagagttggtagtcgaatggtgaaggcatactcgtgtgcaacttgcttgatctttggtgtatcaaattatttttcctatactttatgctaccatcttttaacttgttattggtgttttcagctaaatcaaattgttgagatgaattctattgtcaaaagaagactgtaattagacgaaatttatcttattaaatcaccatgcaccacccggcctgaagtgtatggcttaatccttctctggtatctttatttgtcccttcatttcggtcattttctcatcagtccctaattctatcagcatcattgtcccctttcagctccaacatttttagtagaccatgcaagattttttgcttttgacctctaaaattttctgaaacaacgttgttggttatgcccactgtactcatcgggacaattgattgatgtcaatttggtctggaactgagctttcactagctttatacatggagtaatgcaatgacctaattacctaactaagagttgccatattctactcgatgcactcgatccatctctagctaagtaaccaataattatgatgaactggcgactgatgtgaaaattcaactttcaggtaggaaattcagatcaagagaacacaagaattttctctgttcccctactaatgaactactgataaaattcctacaaaaatcatgtgaaaattttcgttcggaacggggctaagtttcagatagaaatcaaattggaatcaacatgagctctccgatgccatttcctttcttgaggttaagggaactatgaaatttaagaaagtattgacggccttgaggaaaattggactataaaataattctaatgccacaatgcaaattttttcctcttttcgtgttgaaattgatcttgctgtgaaatttctccagaaatcatgtgaatgtcctcctctcggaaagggagattaggattttgaagtttccaatggtgccatttcgtttccaccgaccaactggagacaggagtcaaaacaaatgaacatgaactgcaagaagtatcatcggccttgcggcaaaattggacggtcaattaattcttcaatttgccaatttttgcatcaaattttcatctaatttgactgtcttcaaaatgagctagaactaaatcaaatccgtatacttgtctccatccgtatctatgcacaaatccgaactcttttttggcgcggccgccaatgctatcttgacgccgccttcgccagcgcgaccagcctcaccggcgaccgccgccgccgccgcttctcggcctccgatatcgtctcgagccccggcgaccacggccgctgctgccgcgcgcccaccagctgcatgtagtgcttcctcagctccggcgtgctgcacagctggtcgtcggccgccgcctcgccgcccgccttgccgccgcccgcgacgcgggccacgcaggtgatcgccctctcgatgaactccgggaggaccctgatgagcgccatgccgtcgtcgcccgtcacgtactcgaacggcgacgacgcgccgccggcgagggacaccttcgcggccggggacggcgacagcgacgcgagcgacgcggcggtgagcgcctgctggcacgagaaccgcgcggcggggagcacgaagtacgtccgccccgccgccagctcctcgccggccggcagcgccgggatcgggaggccgatgaagaacgagtcgccggcgcagacgaggtggccggggagctccgccatgacgtcgccggccgtcgtcgccgcggacgccaccagctggcttgccgccccgccccagaacaccagccttgccgccgccgcctccgccgccgcctcctcgccgtgcacgggcggggagcacaggcacggagacatgccgttgcccatggatgcactaaccacgatctagaatattctagaagcttctggactagaagcgaggtcgcggaagaggcgctctctcttcgatttcttttccacaagatttgaggatttgttggtgcgaagatgtatatatagggggagcgttgaataaaaaaatggaatcgtgggggttgacatttaaaaagtcaaaaattggggtttgaattttttttttggttagttttacgtggggttgaccagatgggtgttcaaaaatctaaccaggtgtgtcattaattaattagtggtgagtcttgtcatgtcaacgaccgattggagcttggaatggaagcttctagcgttaatcgtgcttagtgagtggttcttctcgtggaaagtagcttaattaggtgggggtgctgataattgggtcaaatccccgggtccatcattagcaagcagggttatatatactcttgggctgcgcttgattgtgctataattgtaacctaaagctaatttaaattttttaaattttgtttttttattaattttaggtgctcttttactttccttgaatagcacaattacatgatttctagggaaaaaaatgctgaaaaatatagatatgttgttaaaaatcaatgtttaaagtttaaaattgcttttgatccaaagcacaatcagcgctcagcttttttttatatgtcaaagtcaataagctatatggagtagtagtatatgccacacataaatgggaagagctccttttgtaattgcgatgtccggcagaaataaaattagcttaaattaaaagttatttactctatattgggcttaaaagacgatggtacctgcagatcaaatatagagatgtgttacctagccactattttgttgcttttcaatgtgtgagtaaagtgctccctccgctttaaatttgtatgaaaacgctattaacttttggtatgaaatttgtccattcattttataaaactatgtattatgagaaaatctactccccggtatcccgtggtgtcgggatagctcttcaaccttattcatccgaccacccgcatcctcatccacccgacgcaatccccatctcactctcatctcactcccctcctctctctctctctcaagaaggccgagtggagacgaagccggccgggaggaaggggtcgtcgtcgtcgtctccggcggccgaggaggacgacgacagcactgcgtcggcgaggtcggccaaccctcagcggggtcgccctcaagctcgcctccccttgctgcgccgctctggctcgccgccctcgtcggtcgggtctgcgccggggactcgtcaccccggggagggcagaagtgggagctcccctcgtcctcgccctcggcctcggcgtcaccgtcgtccccgctgcagcctgccgctttgcgcctccgggatggacgccagcagcctgcgtcaacttacaacaggtatggctgtcaacctcctcctcggcttctcctcgagacttctcacgctctctggctcgggcctcgaccctcaactcgccgttcctcctcgatgccatccttcgccgttgcggccctccctcccccacatctcctcctctttttgacggtaccctctgataccccacaagtatcaggctgatacctaggtaccacccaataccttggcaccgggtatcagatatcagtcgatacctagtcggtaccaaaggtatcaggtaccaaccggtacctaaggtaccaggtatcaggtatcaggtatcggtcgatacctagtcggtaccaaaggtaccaggtaccaggtaggtaaggtaccagatatcaggtaccagggagcacacgtggacataccaggtatcaggtaccagggagcacatgtggatatactaggtatcaggtaccagggagcacatgtggacagaggaaaggaaaagagagagtcacttaaaatatcccgttgcaacggtatcccgttgtgtagctgccctcatgttttatatagtgattgttgtggctacattgcagctatagccgcaacgccacaataatagcagcaatacaagcaatgttgcaacggctggaaccatcgcaattgctttcgaatagggcattaaaaaaatagtgcaaatataaaaaatatacttaaagtgtatttaataataaaacaagtcataaaaaataaatattacttatattttttataatacaaatggttaaacattatgttcaaagtgatttatcatatttaaaaacggatgcatattttatacgaattacactaatatcaatagtgagaaagtcttcccaaaaagccagaaacagagtacttcctgcagatataatctaatacttaaaattagactccacacatttaaataaagtttatgcatgacaaactgaaccatctaattaatacagcaaattgaaagagagaaaacaatactcgtagttgtttttcaaaacagagaaatgacttttctttcagttctagactactacgtacgactgcgttgcattacaattagctggtgccttgtgtagacaacggttcagtagaggaaattttccatccattgttttgatatctgtcagctaggtcattagtcaatcgtcaatcagcttccttcttcaagcggtgtatcaaccaatacaagctagctatcagctggccgacatgcttgagaaaaaaatggaattgcatatcgcatgaatgatgaatggtcctgcgtcaccatcagctgcatcaaaatgagcagagatttcctcatttcgtgcatgtgtacgttttcttgtgccatagaaacaacgataatacctttttgtttgaacaataatactttctgcataagctaaacccgtgtcggtgttgactgtcgcattcaagaaaggtaggcatttttttaaggatctaaggtaaccaatttaccaaagaaattaaaccacttggcccaaccatggtgtggattattattttaactgatgcaacatctttgttcttgtttcctaagttgatttatctatactactttaaatgttgatggtagttctgccagccatccaacatcactgtcgggttctcatcctttatcgtaatgccattaccattatagatacttacgtgtggggcaacagggtgggatccatatgcagtgactgtaatagtcaactatcactgtcatatgagcccaaggccccaaacaatggggttggtgggatgtatctcaaactaacaactggaaaatatgatggcatcttcgattagacaatgaaaaataattttatgtaatgtatgtcagcctaatttctaacattcaactaatgcaagtattatcttatagttagataatagaaaatggtttaagattgaaattttgttgcaacgcacaaacatttagctagtactagtagaatcacacagaatcacaggtcacactaaccaaactttgaagaatgtcataagtaatggaattactaatgtttatcaattgaaatgaagtctttatgggcggagatagtacttatggtcatttattttaacgggctataaacaagactttaaagcctaaaaaaatattatcattataaaatcttcacatcatattatttctcatcaattttgcttcacttaaaaaaattcttattttatggcttgaggttgggggatccatatggccgtggtggtggatggtgacaattcccccctcaccacaactattgggaccttttaaatgagtatagatatggcagttataggaatattaggatacgattgatgatttgtttagaatcattcatcatatctaatctttttctcttatctctattgttatacgtcatctcttgaggctcaatacaattactcaagttacgcaatatatgtctcttgtataacagtgaacactaaaaaaatgggtacttgtgcctctgtggagagcctatttttccgtgttccaaccaaatttaatttgttccatttgattaacttcatgattcgtactccaacattcttcaggcatcgaccccttcttcattccaatgatatatctgttctctctgtaataggaatattgttaggctaattggtttttactcctaggcttcgtaccatggcccaggtgcccaggaggagtaggaattggatttgtcccatttgtgctcacatatgtcggccgcccatttgtgtctgacgcaagatctcagtacagttgtaaggaaaaggaatttcaaataggctgtgtttagttctataccaaaattatatgtttgactaaaattggaagtttgaagaaaaaagttgaaagtttatgtgtgtagaaaagttttgatgcgatggaaattaaagttggaagtttgaagaaaaagttaggaaataaacaagcgcataggttacttttacataccaacctttctttaaaacatatactctattttttt

SEQ ID NO: 8716 - DNA, 13024 bp, Oryza sativa
tcctgcagcctcgcgtataagacatggtacgtggtgggtcctgccgagatttagtcaactactattaggtacgtggtatccataaccctgacaaaagtgttgttcattataaaaaaagagaattactaatatttagagcaagtataatagtaggctataagccggctaaatgctgaggtggaggagagaagagaggagagagaggagaaaatggctgtaaacttacagccgacttggacataagaaccaagaaactctgtgagagagataagtgggccatgtattaattataaagagctaactattatatgggtaagctaagagaagactacacagaaccttatagctaataggtcggctgtattactggccttgctcttaggagaaccatgcactcgtagtcagggacgaagccaggatttgagattaggggggtgtggggtgaagataaaccatgagaccgaataactagtcctttaagaatagtcaccgtcaataacaagcaatgcgtaaactagtcctttaagaaaaacttaaattttagctctttaataatatcattggaaatttaaaactagtctttattgctaaattcttttaatgtaaactattaaataatctcacaaataagtatcatctattttactttgaaaaatatgagaaatcacaaactaattttgtagatcatgtttcttgctaatattttttagacttgctaactaattaaattgataatactttcaagctacacaaaataaactagataaatacttatcttagctaacttaatatagagtaaaatacatgagggtgtagtggtggtagtgtttggataggggggtgttggcaccctttggcacccccttaccttcgccactgctcgtagtgatccatatgaaccgataaatctctccacgccacatcaagtcatcaacctttgggcatacacagtaattggaacaggtcaaggttcattaagacaatacccaaaccgtcctaaacaccccaaccgaattattccgttcaaaacaagggaaaataagtacatatgcccttgatgagctagctaagcacaaaatgtacggattacatgtcaacctcgatgaccatttcgatgaactaggacgacgtccttgcagagtttcaaaatataaacatgtttagatactgatacggtcttcgagatgttactttgacgaacaatatctataaaaataaaaatattttaaataaaaagagttatatattatgatagtttgtttaatgataaatctagtaacatcaattttatatgattgattttttaattttttttctaataatggtcaaagttaaaaacatttaacttgtcactaggcttaaaaatgtttatattttgggacggagagagtacttgtcactatgcttaaaaatgtttatattttgggatggaaagagtaataatagcactaacaatttaaataataatcacggttgaaacttgaaactaatgctaagtctgtgtttggctcccactttttctcctttgttttcgacgtgcatatttcccgaatggctaaacaatagtatttttttaaaaaaaattctatacaaaaattatttaaaaaacatagtgatccattctttaaaagaatttagctaatacttaattaattatatactaataattattccgttttacgtgcgcgagggattaaactgaacacaacatataattcatcttgaatctcgtcagctatttcctccgtccgaaaatgttactcccttcgtgcacaatagttgttgttataggttgtttaataccacctccgttttttaatagatgacactgttaactttttctcacatgtttgaccattcgtcttattcaaaaaatttacgtaattataatttattttgttatgagttgttttatcactcatagtactttaagtgtgatttatatcttatacatttgtataaaatttttgaataagacgaatggtcaaacatgtgagaaaaaattaacggcgtcatctattaaaactcaagagcaaaaatgactacagcaccccctattaaatgttatgggaatgtaaataagaagatactccctccattccaaaatatagggcacaactactttttaaagttgcttcataatataaggcgtgcatatatgcataacaattaattagcatctcttctctcctaaattagtactccctccatactcataaagaaagtcgtttagaacagcgacacggtctttaaaacacaactttgacttcttgtttctataaaaatatttctgaaaagtgatatatatatatatatatacttttatgaaagtatttttcaagacaaatctattcatataatttttatattttcaaactcaacaacttgagagttattcatgatttatattcccaacgtttgacttaaacattatcctaaacgacttcctttatgagtacggagggagtattttttaaatcatacactcacaagatgtttaattctattgggtgcatgtattgtattaattggattgattcaaacaaagaggtgataataattgtttcttggtgtttgggtcagggtggttatgccttatattttggaatggagggagtaattgggagtagaatgaaaaaaaaattgaattgaaggtgattgatgcgacaaaagttactctaagcatgtgtttgatttcgggactaagtgggatgggatggaaccatccctgattttttggttgggatgattccactcacatgtttggtttgtaggatgggatgatcccaattttttgtttgattaaagggacaagagagagatgggatggacgctgtttgcaaccaccgtcaacgatcgggcgggcgtgcgggcgagcatgccggcggcgagcaagagaaagagatggtctccgagcgggcgtgtggacgagaaagccagcggcgagtaagagcaagaggaagagaaccatggcttgctcacctcccacatgaccatggcatgccgctgcccctcaaccttcgcgagttcctccccgcacgccaccgccgctcctcctccgtaacagtcccctgcctccggatccgccgccgcagtcctccccatcgccggatctgccgccgccgccctccccaccactggatctgccgctgccgccctccccaccactggatccgccgtcgccgagccccctaccgccaccgtcgcccaagccgtatgccactgctcccgagggcgagcagggcgagcgcgcgagcaaggcgtcgtcacgccgttcgctcgtcccaggtgggatgagttcgcccgcgagattttcttatatcggttggtcccgggtctgagaggaatattcctctccaggaaccaacccatcccactcgtccctcaaccaaacacccctgaaagtgggttcgtcccatcgtgtcacatcccatccttgtaaccaaacactatctaaagtgataaactttttgcaacaaattttaaatcctaaaacaacaattattttagaacgaaggtaaaatatttttagatgaaggtagtactcattcgtcgtcagtcagtcggtcaaaagtaccaaagagcggcgctgagaagggcgttggctaacttaatttgacatgcaaaacctgatggacagaaagcaatgtacgtaccactcccctttttggtctttctaattagcacgtgcattaggcaggtagaggtagtaggtagagctagcgtgctaattaggtcacgtgttccgtgtgcccacgaggaccaaaacgttaacgtggttgaagggcagagaagaccagtgcatgcgatgcgagtagtaggagtatatgcttggaaaaaattggaatgctgctttggatatatattaagaggacaacggagccggtcgatcggtcgtactccgtacttgtacaaggtttggttaatgttccactggaaagaatatgtgtgctgcagtgtactagtgtggtgataaacaaggggatatcacgttgggaacaacatagcagagtttcgtcatgttttgtccatgcctgtccagaagggagtaatttgaacgtgtgtgtagagtatcagagttccaagtttattgaattgttaatcacttgattcatggccatcgcataaaaaagaagattcataagaaggaataaaacatcaaggtagctagcttattcatcgatcctaagtgtacatgaatacctgatagtcgtaaaatcaattgaagaaccaagtttgaaaggtaaagttcaacggatttaactgcaggctggtttcagtagatttatggtacattcacaaagattcagctaaaaacaataacttaaaacgaattcgaaaaatggattgcaaatcaggcttagagccagtggcgtagttaggatttagagtaaaagtgatccatctatatgtaaggtcaattaaatggatggtccactatataatttttattatattaacttgcatatataatatagttttaatctcgattaaatttttaggtagttcatggaccacagtaccacctagcatgccactgcttagatccttatatcatacacaccatccgtaactagtaaatagccggtggctatctatcactctgtaacacaccatagtctaggaccctggagctttggcccattagagtcgaagcagctgggccttctctctccctcactccgtactaattgggctttctgttgggctgcattctaatggaagtatatgcagctttgggcatactaatgaggcaatggcaattggaagcaaagtggcaaatagttgcagattagacatgtcctctaatttttggcctttggccattatgtctaaaagaattcagttagctaggagtatgttttttattccattttgtccttttgatctgtatctatttgtgcatatccgctaatccacagagggtcccttccctggattcattcggtttgtatataaatccaagcatgacaaattggcgagtgaatagacaaaacatttttttgcacgaaagtatatgaaactgaagttgatgcgtcacactgtcgggaggaaggctccgaattaaacatggcaaagcctgacaagtgacaagtgcgtaagtgcctctcgctatcgaaactaaattttctgcggtgaactcattcaagtatgcacgacgctgttgtctcttccgggctgcaatcagcacggcatgattgcagggctcatgaatctcgcaaagatttgtcttcccttgtttcatggctcatacaatagtacagtctctccacattttcagagcagctcaactgctcaactgtctttttaaaaaatgttgagctaattccatctttcaggaaggacaagttaggccttattcggtttgaagaattcctaaaggatttctcaattccttaggaataaacactattcatgcattcagttagtaggattcaaaggaaagttttcataggaacaccatgccaattctccaaaaatcaacatccactccaaaatgacagtttttttttacatgaaaaatatgctgtcagtctcatatttcatatctcaatttttttcatatatcaggtttaatattttaaggtttttttctgaggtttaactatatgcattctagatcgtcatttatttcgtagcttgttcataacaaaggctatgaaacccgaaaccaattaacaaagtcaggggatgtacgtacatgcgtctttggaacataggaatttgaaaacacaaaaaacaagaaaaatgtagtaatagaatgtcgtaccacaataaatcctacttgaaagaaacccacatgatttcgaaaaaaattgtatggtaatagtataggaagagtataggaattgtgagttagtaaaaagaagagaaaacatgaggcctagccttatgttaatgtttctccaaaactcatatgaaatgagccattccatgagattttcaaaggattttgtcagagctttttctttgctccaaaggatcatgtagaaatattttctaatcaataatttctacagtttccctttgttccaaggaagtcctacatgtttttgactagacatcaaagacaaaaataaaagttataatgatgtttacttacaacacatgtagattatcggaggagtacgagatactctctccgtccttaaaaaaagtcaaactttggatttccgtgtccaattttaactgtccgtcttatatgaaatttttttataatttgcattttcattgttgttagatgataagacatgattaatattttatacgtgacttgtctttttaatttttcatattttttttaaataagacggacggtcaaacgttagacatgaaaatcaaggtttgtctttttctgggacggagggagtaagcctttgcacatgtaggccctttagtatgggttggcaggaagccggccggcctaccggcgttggccgctagctacacaaactccaccgaagcacaacatccttttacttacagcggggccatccaaacaaacgccctggccagagctactgacacatgggcccctgcagtaggctagccctcactcccgtagaaaagcgcttcaatggagccttcatgtagcagatagatcctgtacttccgacgtgttccaggaaagccgtgcgtcaagggcgtttggtcctaaacacgtgatgtgttggatgagatccaattttaaaagtttcgttatcggtgactgttcaaatatactttcctccgttaaaatataaggtaatactccctctcccataaaaaaccaacctagtaccgaatgtgacacatcctagtactacgaatctgaacatatatgtccagattcatcatactagaatatgtcacattcagtcctagattcttttttttttgggcggagggagtatttgattaggaggaattgaactatttcatgcaaagatcctgtaaagtttatatgttccaaaggattattaaagttatgtatttaggaaattcgatcatcttgggtaaaaattttcttttagaaacacatgataaacgttgaggttcacaacgcgcgctctttcagctctatataaacatacacaccatacccttataaacatatcggaaagaatggaccaccgtgtattaagattgacgaagtcatatgtatcttgaagagtatatcgtctaccactgaaattttagttaactataaatacgagcacccatgtcaagtctatgacttgaaccgggtaggttggttctatcataaggaatctaatcagttgaactacactcactttgtaacttgggtacttttgttaacagttaagttaagatcgtatatatttggtgtgtggtgtcatatgcatatgttatcgatatgttcatgattaaaagtattttatattatgctagtttataattattaatgataaatcatcaatggattcgtaattgttgatgaaagtttatcgaagatttatagttgtttatcaagattcacgtatagaaattgatttgttcgtctaggacgcagtgtagtccgattaattagttcaggcataatgaaaacaagagtgattctaccatatttttggaaaggtaccaacagatatcatattttctaatataaaacttattttcagataccaagtaacgcaagataaaagaaaattagtgcaaaattttagtatatacagttaccctcttaagtaccgtacaatttgtttacaagcaagtcttttaatttcttctttttgcgcatcatcgttactgcagaagttaattaatgactcttactagaagcatttacccaatgacttgcatatatattggtactaatacttagagaatttgacaacatcacatttagcctatcctactaaaacttagtaatattgccaatttatcaaaacgattgattttgaaatcgtttcaccgcaatgcagtcgtcgactcgtcgtacacgttcattggacgctgacaagcactagcgccactgcgtccagtagagcataacagcgcatatctgccatcagcatcgacgtccacaaaacatcaatactaacagccacaaacgtacgcatgcatcagtggacaaaaggccagatcagacgacgcacgccctgcgctgcgctcacgcggcagctcgcgggttacacggccgcccgagccaccaaaccaccaccaccccccgatcggcatcgctttccaggcttaccgcttagtacctgttacgacaggggagttcggtatctgtatctgccggattgtcgcgtgtaccgacaaaaactgattaaggactcatcatgaatcatagtactaccgaattacggagtacgagtatcaaagtcgtagcctaccgtgattaattagcatgctaattacagcttccctgttctgttcatatgtggtactcccttcgaccacaaaataaccgtcgttccggaaatggaaaaaaaaagttactatctaactttacataaaagtccacctaattaaaaccagatatgcaccccctaaattttttaacactgttttatgcaaccctttttacataaaacaccttacgatggttttacaaaatagttgctataaatttgcatatatgttaaatgagtttgactatttcacatacacctcgaacgcatatgttaaatctacacctttttatcccattttctctcttacttatataaatgagtactaacataatacaacacaatactagtatgatataattactgtagagtataaattaaggactgatgatttgtgtatgtaggtatgttatatcaacatccgaaaccactttaggagataatttaaatggcattgcaaagtttaggggttagatgtctatttttaaagtttagagtgttatatggagttttatccaaacttcaggggttcctttagaaattggtgggtcaccaagacacacttgtctcattattaattacaaataaaatacctataaaaagataatttttgaaagttatagtattttaaaaatagttttaaaacaaatctaaccatataatttttaaaagttggatcggaatttttttttgcgggaggatcggaattatttaaggacaaaagtataaacttgttgatagtacatatttcaaaggaaaaagtacaaaatactccttgaactatcgcggtcaaccgaattaccccttacccaaaaaccacacattactcactctgaactttcaataccgaccgacttactcccccttgacccaatccagagcggttttatcctacgtggcatacgtatgtcaatccagccagtattttcttttaaaatattggtgagacccacctatcataccttctattcccctcttcccctctctcttcactctctaactctctcttgcacgcatggcacgcacggtggcacggggacgggcgatggcgcggggacgggcgggcaggcgccgcgcatggtggcacgcacggcacgacggtgcgcatggcgacacacacaggatgggaaagggtggaggggaaggggtgaggaggggagggagagtgtgttaacgaccaaatttggtaataccagtatcggagacgatgattagatcaaagcggaatcaaagatgaagattgttgcggaaatagagtaagaatcagctggagtccaaatcggctacgatcgggatcggctaagtccgagtcaggctgggttagacgatacagccgattccgacaatacgacttggtgtacgtcatcaggttgagttgatatgcttcaagatgattgccacgcatggatagagtcctgagaaagcaattgtatctattaattagatattttatgtaatttccttagaaatatgtttgggcaaaagtctgccgcaaagacttatggtattttagagtttgttagagataagagtcgtgtccgatatggacatgttgtgtaattctcgggtataaatagaccccgagccctatgtaatcaaataaacacacgttcaatataatctcggcgcatcgccaccctttttgctttcgttttatttcgacgagttcttgctttcaggttgagctgcatcggtttcgatcttcaacaaaaggtaaaacttgttatggcggcttgcgttctcgggattagtgctttcatctttatgatactctaatcttgtctatgtaattcgtcgagttatcatatatcttatataatctctggcaatatcgctatctaatctacaatcggctgacatctatcaatagagggcagctgattaggttaaatatcgacgttggcttagattatatatgatatccaccactctatgaaacttccaatggcttgattgtctagatattgtccttcttttcatacttatagctgcatcagttgattgatcttatgagtcgtgattagaatctcaatctctagcctgcttcttggttgccgattagggtagtatcggggtttcagccgatcttacctgatttaactatatttgctttatatgctttactgacatgttaaatctaccctttatattaagatcttgttgcacctaggtatattaggctttcgtttagtatattctgcttgctttaatatcttaatttagagtggtatcggagtattagccgatacatgctagatctatttgatcggctatgctatgaacatatatagtcttgttgttagtatatatttcgatctaagtgatttatactgtctcgccatggcgaccaatctatcccaatcactcgatttaagcatatattgacatgaggattatatattgttaatatctacagccgatcgagtagatttagctcttccttacctattcatgactgccgatcgatctatatatgacatcggcttaaagataaatgatacgtcatcggcacttagccgatcggctatcgtttatggatttaaccacggtttttttgtctttgtttttgttgattgcaggatcaaatcaactggcacgctagcatacccgaaggtgaattttggacctgcactggagttaagcagatctcccaagcctcgtgttttcacatcaacagagtggaggtggatggaaaaagggaggaggtggaggtggaaggggaggtcggcgtgcagccggtgttgccaggatcagccattgggggctgggaggggagggagatcagcagggaagatgaggtagcccctgttgatgcgaaaaacacacacaaatttggtcattaacacacccccacctctggccgccgcccgcctctcagccacggccccttctcgccgccgcctcctggcaccttccgccatggccctgcctctggccaccgtctgcctcgccctccacgagcgctaccgtgtgcaccgacctttccttccacctccatctccatctccatgccacttccgacctgtcctgttgctcccgctgccgctcgccgccagctgaagccacccagccacacccccatgctcgccacctagctccattctccgcctccgcgtctcgcgcgccgccctgtgagagagagagagagagtgaagagagagaggaagaagggaagaggagatatgataggtgagtcccaccattttcttaaaaagaaatgttgactggattgggcgagagggtaattcatctggtttaaaagcttagggtgagcaatatctcctcttctggagtaattcggtcgacctcgatagtgaggggataattcgtactttttcctaaatcattccttatttgtgactggttggattttttcttacttacatgacattgttagcggttccacgttaacaactcttttattaatgtcttaattaatattttaatatttactataatcaaagtataacgcacgataaatataaccttagaacttacggcaaactctgtcaaataacatgaacaatgtagtactattctacttacacttgagtagatgttttcttaacaagttggggaaaactatatacatatacatacgtcatcaaataaacctccgtaccaacattttataaagaaaatttagcgttccattccatgtggtttggattaggagtcaaagtggcaatcagggatactggctggtacctaattaagctggcataatgctaattgggattagctagctcaccggcacactccggagatctggcagtaggcggcagcaaccagcagcttctgcacgccctgatattctacgcgacgcccgtgcgtgtcctggaaaggcgacagggcagttgcaaccgtttgcctggctatagccaggacgcattggtcttttctgtttgtacaatcccaaatttgtataatgaactgaattactttacatgaagcaccaatttaacttgaaaataataaaaaaatgtctacattcatttcaactagtgccggatagtttgtacacacgcgtgaccgttaccgaggatgctatagggaaaagatcagatcgccgcagaagcaagaacacactcgagagaagaaaaaaagataacatatggagtgagtacaagagtattagtattaggctcgcacccacccaaatgagacgtcgagaagatatagaaggatagggatgtcatggtcatgtaaaaagaagtacattcaatttatctctcattaataaggttgtaagatatgacctcactatatggttaaaattcatgcgaaataatgaaatatcatgtagttctatccgtgcatgacatttgactgaaaaacccaaagttcttttttttcattagagtgccatacaaccaatggctcctatgcaattgcagtgcatgcatttagatgcacagccccatcttggtctaaccgtaccgtctccacagtttgccagcctgcaagagagccgccgccccacgaatgagtgaccacctccagcacataccaggcagcatatgcatcctccaattaccatttggcaccaccagtagtccggaaaaatatgtagtgcaaaccacatatgtagtggaaacttggatactaccgttggatcgagaaatggacgcccgagattcatccacgtcaccatgagttaaaattta

SEQ ID NO: 8717 - DNA, 3458 bp, Oryza sativa
ttggaggacctaaacgagtgatctacaagtttagggaccgggatgacactgtcgaacaagtttgaggacctgaacggtcaatttgcgagtttaggccgggatgacacaacgatacaagtttaaggaccggtgatgaactttactaaaaaatgacatatatatagaaacagcgggcggtcataatatgcgtatactcatccctataaacgcacacgcacggatacactactcctataagcacctccaaaaaactggacctatatcttgagatcaatgaaattatcacgggacgcctcgctgaagactaggccaacatatcttgatatcaacaaagtcatcacagggtgtctcattgtcaacaatacgtcgtctaccattaaaaaaataattagccataaatacaagcttagaatataggacttgaattaggatgggctaattttatcacaagtaaactaactagtttagctaacctcacttcgcaaacttaacatattttaatgtaaattccatatctaaatataacaacttttaacccttacgatttgtccctaaatataacaacttctccaccaacattctctttccaaccaatcacagccctccaccattcacttttcccacatacctccattagtcatccaatcacaaccctctaccattcactctacttacttttttaataactgtgtccaactctaaaacttattatattttgggatggagggagtacaaacgatagttaaacaatcacatggtgaaaaacaaattaactgaaacagaaagaatataatgctgtacttttagcaaaacttttgtttctctcacatgtactccaacttaggagtaaataagtgagtttggtatagggtttgaagcactaccaaatatcggtagtgtcaaaaatttagataagtttttggcactattagtttgtggttaggataaagaatttcgggttgaagcatttttgaaatattggtggtgtcaaaatttagataagttttttttacactattaatttgtgggttgctatggtagatttgactgcactctataagtttagccgaacatgactccgttaatccagctggctattataaactactagcattccatacatcttgtcgacgggtgatacccgtagaccggatatagagggtattggggtacgttggtacaacgatctacgtagtacgacatcgagcaatcaaaagacaagaattatactggttcaggccccttgacaggtaatagccctaatccagttgatatgggattatacggtggaaaacacagcttacaaaggaaaagatggaacttgccatatccggcgaggttgtaatcgagttgattcgactagctctcgacgacttggctcttcgcaggctccggcttcgtaggctatgtgggttgtattggctctgagattcgatcccttatgccctccccgaggggtcccttttataccataggtctgatgctctccgagtaggactcgaacacaccagacctagcacgacacgtaggtaacccagttcttgtccgagaggactcttcccatttgttgatttcgtgaaaagtttccttagattatgaaggaaatgtccgcgtacgcgtgggtatgccatgtcgatacataacgtatatcgaagggtagagggtatgccagacccgtaaccctgacagtagcccctgacttctactcaaaatgaactcgtgcgaccatttgcgacttcgggtgtcgagaacgttatcattccaggtgcgaggaccacggagatgacttgtagtcaagcatgccgtttgaagcccaacggtcacgagtgaattttgaactaaagtcaaaaactgccgcgcgtaacggacctagaaatttccttcggggatttctctcagttccttggaattcgcaccgtcgggggtgcgcctatttaaagggattttaagtgcgcattttgaagtccgcccactccgtcaagcacacaccgcccgttagcactcctcgccttctccgccgtcataaagaaccctagcttcgtcagctttaggtccatctccggcgatcttgcagctgcgatggatctcggcaagtcgacttccactagcgcgaccctaaagaagctccaggaggatggcgcccttcctggccgtggaaacgcggagagggaagcaggaggtactgatcctcagcccatcttaggttgcatggttgcgatcgaagattatgttgtctgcgggtttctccctccaccctccgaattccttctgctggtcttgaatttctatgggctttctcttctgcacttgaaccccaattccatcgctgcacttgaaccccaattccatcgctttccttagcgtccttgtgcatctttgcgaggcctacattggggtagagccctttcttgatctgttccgcttttattacgagttgcgctggatggaatccaatagggtgtccggttccgttgggttccgacttcgtgacgggatgaagtcgcgctatgtccccttccagtgcccctcttctcgcagtaaatggcggaacaggtggttttaccttgaaatcaaggactcaaatccggtcctcgttgttcccgaggaacaactggacaagattccagtctggaccgccaagccccccttggccccctctctccaatcgtttatcgacatcatcgataatctccgagaacggggtttatcgggatatgaagtcgttgcagacttcgtcggtaggtgaatccagccgctccaggctcgggcccacccggcctataactattccgggccagatgacgcgacccgggtttctcctcggggtatctttctcgcattcacttcgatatgcttgtactcgcgatcccctctgacctatcaaaaactaatttcttcttgacaggtctgagcagcgaaatcgtggagcggcgtgttggtcaggtgatgatcagcggcccgaccacggcgagcgacatccccgtgcccctttgtgaaaagggagcggcggagcgtgacgaagcaatcaatgtgagttcattcgataagcgtccgccttcttttgctcaaaatcagcttatgacatgatttagcgtaagcccttcctttgactgatgtcgtcggtccgctcgcggatcatcaggtggcggcatctctgaaagagaaggtcgtcaaggaggcgtctgacgctgccactactagtggtggcaaagctccgactaaggcgaggaaattctcgtctgtgctcggacaccgccgcaaggcggagactccctcggtaattttcaccttatcatccatttatgtagcgaggaagatttgttctcaccctatgtcgggtgtcttgtaggcttccgacacatctcctccgcctgcgcgacgtcagcgcattgtgacgatcggcgagaagtaagtgaaaaaacttttagattctcgtgtcttctgctcgagtggagttt

SEQ ID NO: 8718 - DNA, 9281 bp, Oryza sativa
aagccggtgctcgcggcatcggccgcgagatctcagaggcgagggcggagacggcagcggcaaacgcgtgtgctgagcggttggtgcgggaactggctgaggcccgcgaggacctcacgaagatgagggagctggtggccgggaacgagcgtcaacgcaaagggctcgaggtctgcatgtcggaacttggagacaatctctccgagatccgtggttcgctgcgggtcacctacaccggcctccaccagctcgccagggagtgcggcgtcgagtccacgatcccggtgaaccccgatgagttctcgttgacttcttctcttgcggagctggcgacggcgataggggaaatcccctccaagcatacggccaggatcgcggaggagacgtccaacggtatcttcaccggggcgtgtcacgtccttgcgtgtgtaaggttgtcgcgccctgaacttgatctgcgtgagatcttggatcagggggcggcaagcgacacgcgtagagaggtgatggaagaagtcagtgacctgggggagtctgtcctccctctttttgaagaataggacttcttgtatttttgtcatttgtaaatcttgaactctggttgccttcgtgcatgtgattaccatccttgttcaatgttgatctcggaagtttttcttgtcgattgtagagatgctgatgacgaggatgtccagcagcgcgggcagccgagtcactgggcagcccgagtcactggcgataattccggtactcgagtttgaaccacacatcccacatgacgtcgaggaccaaactcttgatgtgaaggtcgacatggcgacaaccacctcaagtgagtagcctttttaactccgtgttgggttagtggtttccagcttgtcttagtggtcgttatgtttagcaggtctcgaggatgcccttgcaacccaagatcatcgcatctagtattggaagacgaaatttgaagtggcggaactcgacagaaccatgctagccatgaagaaagagcaagccgtggaaacgctccgaggccgcgaggtgtggtttgcgtcatatttaaagaattgctatacctcaatggcccgggtatgcagggagcttcgagtagtccgcggcgatcctgaggaatcggcggccgggtatatctcgtggctcaacggggcctgtccccaactcgatggcatcggcaagcgtatcgacgaagctttgaagcaagagtgtcatcgagcgagccgatatgccggaggacatgtactagcttgcctgcgagatcaccgcccgcgcctggatcttgaattcctccatgaagggtttgcttgttctcggaggactccgacggagatagaccaccttgcgaggtcgatgtcgccattagccgagaaggtattccagtctatgaactggcattggccctcttggtagtactcgtggcctgttacagatgtcttaggaaaaagtgtaatgtagtgggagatttatgtaaaaaaacagtaagaattattatgtgaataaagaaatctatctttaacaaatgttttcttactctggatgttgtgtgtgtaagagtgtgttctcagttaacgactttagttagccgtttgagtcgtacactctccctagcccccagccttgtcgtaggagggatttcctcgggtgacaaggctcctggacccttggcccgtcttggttgaataagctctgatcctagcccccagccgtgaagttggaaagcttggtttccgattacacggcttggttaatacgcacggcgagaactcttacacgaccagatcttacatggtctttcgtctctaaaggatctgacaaggccttatcggctctgggcgtccctagccgaagatcccttaggttcctcggaggccttgtcgagacggcgtaaagggacataaggacaggtttcaacgctaggcgtcgtcagagtaaggggtcattgggtgaaaacactttggtcgtgatatgagacctaggaataggctttattgatactgtaagggtgcttacaggtatagcggtattgactcatacatagaatttacgtagttggtcaatgttccacgaatttgctagttcgcgaacgtcgccgtcagcgattttgaatgcgcctggccgcaagacttgtgtgatcgtgtagggtccttcccattttagtgagagtttgtttcgccccgcttgggtttgaactcgtctaaggacgtagtcgccgatcgaaagtatgcgtgctcggatgcgcttctcatgataacggcggagggcctgttgatagctagctgctcggatggcaactcgctcacgatgctcctcgagaaggtttagatcgatctctcgctgattctcctggttctcgtcggaatgcttctgtactcgtgtgctttgatgccgtaactcgtcggggagcatggcttcagaattgtacacgaggaagaagggtgtttccttattggatgttgtcggtgtagtgcgcacggcccatagtactgatgggagttcttcaacccattttttgtcgtgtgacatgagtctgtcgtagacgtgggtttttatcccttgtagtactatgtcgttcgccctttcgacttgtccattgctttgagggtgagagaccgaggcgaaacatatttggactcccaagccgatgcagtaatcctggaaatcggcgctgatgaattgagagccgttgtgggttatgatgcggtgcggtagtccgtatctgcaaaatatccctctgatgaacttgatagcattatcggccttgatttccccggtgggtactgcttcgatccacttggtgaacttgtcgatcgccacaaataggaatctgtagccgccctgtcctcatgggaatggcccaagttagtctagcccccagcatgagaacggccaagtcagagggattgtctggagcgcttgtgcaggtagcttagtgtgcttgctgtggaattgacaggcttcacatcgctggaccatgtcgcatgcatctttaagggcggttggccagaaaaacccttgtcgaaaggctttgccgaccaatgtccgaccggcggcgtgtgacccgcatatgccttcatgtatgtcaaggaggagttgtctgccgtcgtcggtagagacgcatttgagaaatatcccgtttgacgcttttttgtataagtcgttgccgaccatacaatagatctttgctttgcggattattttctcagcctctgtatcgtcctcgggtaactcctcactgctgatgaatttgattaatgggctgcgccagtcgtctgtagtttcgatgtcagcaacggcgtgttctgcctcggttacctccgagctgatgtcgggggtgttcgggccaacttcgccgcttacttctttcaccgatggcttcgtcaggacgtcgagaaaggtgccgggctcgagcagctctcgtctggatgcgcgtcgtgctaggtcgtctggctcgacgttgtccttgctatagacgtgccggacctcgatcccattgaacctcctctctagcttcctgacttctgagagatacttggataactcggggttggagcatttgtagtctttgtgcacctggtttgcgattagcttagagtcccctttgacgattagtcgcttggccccaagtgcggctgcagctcgtatcccggcgagtagtccttcgtattctgtagtgttattggttgccctgaagttgaggtgaattgcgtgcttgaattgatctccggagggagatgttaagataaatcctgcccctgctccttggctgttgagtgcgccatcgaacgccattgtccatgtctcattgtcgccttggttatctgacttattatttggcatggtccaatcggccatgaagtcggcgagtacctgagatttgatggctgttcgcggcacaaagtggatatcaaactggcttagctcgactacccatttagcgatgcggccgacaacttctttgtttctcacaacttcgccaagtgggaaggaggagacaactgtgactctgtgggcttgaaagtagtggcgtagcttccttgatgtcatgatgactgcgtagagcagtttttgaatctgtggatatcttgtctttgcgtcatggagagcttcgctgaagtaataaactagtcgctgtactttctctctctcgacgacaatgacggtgctaacggaatatggcgtggcggcaatataaaggaataattcttcattaggttggggagcaacgaatacaggggggtttgataggtagcgcttgagtgcaataaatgcctcttcggcttcctgtgtccatacaaatttgtcttgtttcttcaacaaggcaagaaaggcctgtccttgttctcccatcctagcgacgaatctgcttaatgctgccatgcatccggttagcttctgcacctccttgagtcttgtgggcttggcatcgggtcgcaccattagtttgtgctcaatcacctccctggggacccccggcatgtcggacggctgccaagcgaacacgtcggcattatcgcggaggaaggtgatgagcgcgagttcctatttctcatctagtgtagccccgattttgacagtcttgtccaggttagcactagagagtggaacaatcttgatggcgccatctggcttcggcgtcttgtttagcttgctcactttcttgggtggctcaaacttggtggccgggtgggcgtttgctcaaccatgtcgaggctccgcttgtcccactgcaccgcagctttgcgttcccctgaatagtgattgttcccttcggtcctggcatcttgagcacttgatatgcgtagtgtgatgcggccattaacttcgcaagtgcagttctcccgatgatggcgttataagctgtatcgaattcagtgacatcgaagtgatatgctctgttcggaagttgttggcttggccgaaggtcacgggcaatgtgatcttgcccaaaggtctggatgatgattggggagtaattccatggaagggttgatcagttggtgttaactcactttgcggaattcccattgcatccagagtgctggcgaagaggagattgatcgagctgccaccgttgatgagaactcgtgctaccttgacgtttagaatagtgggctcgaccacgatcggatatcatcctgggataacagaggttttggggtggtcctcctccgagaactctattctctgctcagaccacttcatcttgggtgcagccccctgccacgtcgaacagacttcacgttccactttcttgtattctcgcttggaggagtacgttgtggagccgccgaagatgtgtgagacgtggaggtcggagtccgggtacgcagagtctgattcgtgaggaggtgtctcctcattcttctcgacaacgcatactcgcttgcccttttcaaacgccatgtgcttctcgagcgactttttgaaaacaaggcaatcctccagagaatgtctgtccgttttgtgtatggggcaccatgatttctttgtatcgctgccctgtgggtctgggcgcttgggagggttcgcgtactcagctgcgaggacttccgcttgagctttccttttcccgtttttgcgatttttcttcttgcttgactcagatgcgtctacggctggtttcttctctcccccggtcttcggcttgttgttcttgcgtcttagcgcgtcatccacgtgggcgcaccgctcaacgatctcgaataatcttcgagtagttgtgatgcgtcttgttgccaactcctgggtagtgtagcgatctctgacaccggacttgaaggcacgaattacaaaagcgtcggtaatctcaggaatagtgtttctgcactcattaaagcgccgaacgtattccctcaatgattcccccgagttctgtgttaacgtgtgtaagtcgtcttcgatcgcgtggcgcttgtatgttccttggaaattggcgacgaactgttgccacaggtctatccacgaggagattgagtagggaggaagatgcatcagccatgaacgtgcagaacccttcaacgcagttggtaaatagttcgccaacgcgttgtcatctgctccggcagcataaagcactgtcgagtagacttgaaggaattcttccgggtcggtgctcccatcatacttttcaatggccccgggtcgcaatctctcaggccatcggacatcacgtagggaacgaccgaaagccctacacccagcactgggggcggtgggttgccggcggtcgcgtgaccttcgtggatgtctgtctgatgatgaagaggacacggatgatgacgatgacgatgggtcggttggctccggcgtacgattacgaggatgacgacctggatcccgggaatcttgtcgttgtctctcgctgttatctcggcgccgatctccttcgtcgtcgtcgttgcggcgatggccatgaccagtattgtctggcccccgccgttcgcgatcgttgcattctcggtcctcgttttggcggtctcctcgatcatggtgccgtgaagaaacatgacgccgagagcgatttgcgtcgtcccgtgtgcgccgtgcttctcggcgaccgttaatttgatctcgaagatcgccagtgccacgaggtggaggggtagcctgtcgaggcgattccctccgctccggatcttcaccattggggttgccgattggtggctgatcttggtgtgctgcggtagcgacctcttcgaacgcattgctgaggttggtcaccgactcccgtaattgttctgtccaacgctcgaggtcgtcattcagaacgggatcgtaaggagtttccctcagtatagcttgaatagccctgatgtgctaggctggagtagtcgattgattcgccgcttctgcgttggcttgcgctgacgtgccaacgtcatcgataatagtacctcccgcggcgcacttgttgtcgatgacccgtagtcttcgaggagatgtaagaccgatggttcgtgaggatcgagatcgattaccccaacgaatcgatctgaggctggagtcgctccctgttccttgccgttatccctggcggggacgtatgacttaggagacggggctttcatggcgccgaggagaactttacagctcgagagatcgtgattctttgtcttgtggataggacaatagacatcccgagttggagaaatacgttgaattccacgttctttgcaggcgcgaatttcagcacggacgttgatgaatacccagcaatcttgaagggtatgtttcttggttttgtggataggacaccaagacctgatagcttcagaagtcatctttgtcggcccgtgatttacgtcggagggacaagacttggccgcatcagaatccttcccaagtttggatgtagtcggtaatccgttctccgtttcaacgggtggatttttcgacatggagccgtcttggtttgtagccactgcgttctagttttcagtcattggaggaccggttgagatcggcatcgtggtgtaaaccgggaagacgatttcgcccacttgagtccataccagcatcgttgaagtcgagagtgcttggctggagctggtgttgacgttgttgtcgacgaagcttgatggcatagtagtagaaccttgagtaccaagtgcccctacctggcgcgccactgtcgacgggtgatacccgtagaccggatatagagggtattggggtacgctggtacaaggatctacgtagtacgacatcgagcaatcaaaagacaagaattatactggttcaggccccttgacaggtaatagccctaatccagttgatatggtattatacggtggaaaacacagcttacaaaggaaaagatggaacttgtcagatccggcgaggttgtaatcgagttgattcgactagctctcgacgacttgtctcttcgcaggctccggcttcgtaggttatgttggttgtgttggctctgagattcgatcccttatgccctccccggggggtcccttttataccatatgtctgatgctctccaagtaggactcgaacacaccagacctagcacgatacgtaggtaacccagttcttgtccgagaaggattcttcccatctgttaatttcgtgaaaagtttccttagattatgaaggaaatgttcgcgtacgcgtgggtatgccatgtcgatacgtaacgtatatcgaagggtagagagtttgccagacccataaccctgacttttatattataagtcgttttgattttttttctattcaaaaatttttacattttacttaatatatataaaaaatagcaacatctataataccaaattagtttaattaaatataacattaaatatattttcatatttattttgtgttttaaaaacctaggtcaaacttaaaaagtttcactagaaaaaaaaattcaaacgatttatataatacgaaaccgagaaaaattcaaacgacttatataatacgaaaccgggagaatatattattcaaagctaccggaaaattgaaaggacaaaaaaaaataacgtcaaaccaaaaccaaaaatagccccaaaatcttccacgcctgggcagaaacaggcgaaaaaacttctgacgcggcgggtcagaagtccagaaaccagcagtccacagcaccaccgcagcagcagcacgtactcctacaacaaagtactagcagtggtgcgtcgtacctccacgcgtcgctctctatcccccactcccgccgagattcccctcgccggccgcctcactctctcttctctcactgccacgtgggccccaccccatccgcaccaccgctcgcggcgcatccacccgcaaatcggcggcggcgacgaaggcgagcgactgactccagtagtaataaaggcgaacggctacagcgcccatccagctccctcccactgcacggcgcgcggcagggagccgcacgcgtaaacaaaccaaccataccagcccaactgatttttctgtaaaaaaaaaaggggagaggagaaaaaaaaaagggaaagcgaaaaaaagcgaggtcccccttcccctctcctcccccgtctcgtctcgtctcgtctcccacctcgcaccattcctctctctctctctctctcccccctcgccctcgagccctcgatctccacatctctctcgcgcgcgctctggtggtctctccacccccccccccccacgcagcgcaaacccccccgattccccccctcgcttcggccaccagcggccgcccagcccgtcgcgcgcttccgccgcgccgccgcggagatttttttttgtgcgcgcgcgcg

SEQ ID NO: 8719 - DNA, 3418 bp, Oryza sativa
ggcgatgtcggacgcgtcgtcggatctcggcggcgcgcggcccggggccgtggagcgcgacatcgagcaggtgagccgcttcccgatcctccgcttagctcggcttgggaatgccgaggaaatcccggctgtcggtgtgttcctcgtctcggggccgcgcgtggcggggaaggcgtctctggatggtagatgcatttgctttgcgtttgtgcgttttcgtgcggctgctgaattctgctaccgcagcagtagctctgcgtgtcccccgcggagaaaccaaaattttggggagtctggagcctcggctttgctgctgcctgcaagtagggttctgtggtggaagccgatttaattactgttatttggcctcttgggttggataattccagagacattgatttggctacagtgattgtgtttgctaactttttttttggggaaggccaatcgaattgggctgtttgctggttgttactactttgctctcgtgcaggttgtatgattgagttgggagtggtatgctataacggtttcccaaccttcttttgctgttggttaatgctgcgtgcggtaattgattgagttgagctatactgctatattagttatgtcctattgctttgaggggaagtgccagtgtgttaattggatcaatacacgtcttctctgcagtaatttctgacagatactttctccttgaatgaacttgtaaaattctttgcccatttttttgagtttccattttgttctctctgtgctcacatggcacaatgaataattttaatgaagttctgagttatggtttacctcaaagagaatagcctatatgtgctacccttctaggagaatcccttatttcgaaagatgataattgtttcagagattattgatgagacctttgcatttgctgtaacatgtagcatttcatctcttgtgcattagggagtttgctttagtaattcacttctccatgtaatagctggaacgctattttcatcatctccagtattaaccgattagtttatagtgctatacataatataatgttcatttccagctctgaagtagtttcaaattgtctgaaagaacatgtcgatggccaattagaatgcatgtgattgttccattgtatttaatgcctctcctttgtggcatctaaaatcagagttatttcttgacctagttttattattttactaggatagtagtgtgatactaactactgatgctcgatacaacattccactgtttctcaggccatcactgctctcaagaaaggagcatacttgctgaagtacgggcgcagagggaagccaaaattttgcccatttaggctttccaatgtgagttttgtttgcattttctctcactgagttgtaaagccctctttgtttacccttcagatttatggacattcatggtgtttttgttcattcaggatgaatctatattgatatggttttccgggaaagaggaaaaacagctgaggttgagtcatgtgtccagaataattcctggacaacgaacggtgagttaccatttctggaaaacttcaaatttcaggaatatagatttctctaagtctaattggccattgtgatcaaatctcatatcatatctggtaaaacaacagtgtatttcttttgcttgtttgttttggcgttaactccttatgaatacatctgtgggtgtctcttcagcttttaccctaacataattctccctccttaagaggagtttcgttgcattcttactgacaactgacaagaacttttacagttcaaatttctgatatctactactgatacaacttatgccattaggagatagctgtaatcattagtcttgcccccataacaacaaattacataccacttcaaactgatgcaacttctgatggttcatttatgattctcttttgccactgcctccagaaaaggagctacatatggcagttacaaattgatctgtcccatcatgttgtttttttttttttacattcgctttctgatggaaaacgattcacaagggagtattcaactatatttaaggtctgtaactctcccctaacaatgtctgtttctcttttgccaatgcaggcaatttttcagaggtatccacgaccagaaaaggaatgccagtcattttctctcatatctcatgatagatcattggacattgtaagttatatactgttcattttatatgtgctgtttatcttcttggttcgatttccatttttgatgcacactaaacccctttcctcggtagcaaattgattttgtttggtgatgtggttttatcatgatatcagatatgcaaggataaagatgaagccgaagtgtggtttgctgggctaaaaaccctcataacacgtagtcatcaaaggaaatggagaacagaatcgagaagtgatatgctttcctctggtacaactagtcccagaacttacacaagacgaagctccccattgagttctcctttcagcagcaatgacagtgtccacaaggtatttcccactacccacccagctcatcccactatgccactatattgtgtgttcgtcacctatacagaactacccaatctcttcctgttttgtatgttccatcttttttcttttccattttttggttttggcctgctgctttaagatctgaacaacatggcaaaagtcttatgtcgtacctaggctgttctctttgttctgtatggtctgtacaatctcattacatagatatttatcgctttgcagcaccacaataagaattgtatcttactgaccatgttttattttattcttctgtctacttcaattaatataacaaacatcttgataattgtcctgcaacaggatggtgttgaaaattaccgacttcgtagtccatttgggagcccaccaaaggtcggtctggagaaggcattttctgacattgtgtcatatgcagccccacccaagcccttcttcccatcggattctaatgccggttctgtccattccgtgtcttctgggcagtcagataacacaaatttacactcaaggggcatcccaatggatgctttccgtgttagtttatccagtgctgttagttcatcaagtcatggttctggtcatgatgatggtgatgccctaggtgatgttttcatatggggagaggggactggggaggggattcttggtggtggcaattcgagagttgggaactcctcaggtgtaaacatggattgtcttataccaaagccattggaatttgctgtaaaacttgatgtacagaacatttcttgtgggggaaggcatgccacacttgttaccaagcagggagagatctactcttggggtgaggaatcaggcggacgtcttggtcatggtgtagattgtgatgtgccccagccaaagcttgagtattctatagtgtca

SEQ ID NO: 8720 - DNA, 852 bp, Oryza sativa
cctacctattaatcatatgtctctgttaatctagtcttagcatatcaatttagctctgtcgggtgcttctcgttttagggtttctgccggtatcggctaaatcgcgtgctagattagattagcttagacatctacctccctgaaaactcagtcaacagcttgattgtctagatattatgtttcctttcatacttagtgctgcatcagttaagtttgatctactaagtcgtgcttagaaccataatctctagcctgctttttgattgccaataagggtttcatcggggtttcagccgatgagttatctggacgttgcatcggctcataaggattgcatatacatataagttggatttagccgatgacaacaaaggtttcactgtttaatctaatcttgtggatttcatgacatcgggcctccagccgatgtatgctttaacctttagatcaatgcttactctatcatatcaatgctagccgattggttcatactagactatattattgttatattttattatcagtagccgattgcctatatatcattatttactaaagtgttagaatctacattggacgtatagccgattgcttaaaccctatcgctatcggctggtatcggcattggctattatcggctattggctggaactactctatcgccttgtcagccgatcggctgttttgatctactatttgcatatcttgtcagttgcaggatcaaactgactggcacgcccgcatctcaccaatctttggacctgcacaggagttaagcagatctcccaggccggcgtgtttgatttttttcatcaacaaagacaaacacggcttaagaaatgatatggatgc

SEQ ID NO: 8721 - DNA, 728 bp, Oryza sativa
acggggctgccactagccggccaggcaattgtacgtccggaccctccggaagattggagagatgatattgtatcatgatatgcctgtattttgccacggtaccgctaccggtgatacagacgacgatgaggacaaaatatttttctctgaaaaagaaatcatggccccacattgaagtggttgtcacagtttgaggtaatttaatatttgtaattaaggcatattccgttcacattcacatatctgacaacacattgtttttttgttaggtgcgatatatgccccgacgatgtccaggagtaccaactgacgttataccttgaggcttatctactttggctatttggttgggtcatgttcaccggctcgcacgggaacactgtggacgccaggctaatcccccttgctcgccaaattgctgaaggtaatatagcgccttctgcatagtttagctggggatcagccgtccttgcagccacataccatggattctgcgacgcatgtattaagaccggacaaagggaggcgattttcacggggtgtccacttttggtcatgttgtggtcgtacgagcgcttctcgttcagacgtccatacatgagcgtggccgtggcccacaaggacgattacactgacgcagttgatgatcgtcctaccttcggtactcgctggtgctacggaccagtacgtatgcttgcattaaaggaatatttatgtcatttgaatga

SEQ ID NO: 8722 - DNA, 472 bp, Oryza sativa
acaaatttgagttatactatcagtgctatttcaatagtgagtgagcagcaatacaaggaaaatggtcaaatgatttgtacctggaggacttcctgattttcggcatgggacgaccggatgttttcttcttaaggtgagcttgccttggttttccagtcacccctttgctgccagccttttcagcatcgtcgttttcatcgtcactcagaaccagtttcctcttgcggaacactaagaggtgttgggttgagtgtcagaccggatttttggtcctccgccagcttgaccagtttgccgacggggtgagcggtgttgagcaattggaggatctgacttcatcaaggcgaattcctgggcatgatgatccaagttttcaatcaactttggaaaaaattttgatagtaatcgtgttcttcaccgaaattgcaagaataagctgcttaggggcggattagcggaaatataccggcgt

SEQ ID NO: 8723 - DNA, 6702 bp, Oryza sativa
  unsure (1)..(6702): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactaccaaaatctctccaaaacatacccttagagcttttataaaaccgtgggctctcttatctatcgtagagctagagcttcaagatgccaatatttgatgtatggaagatgttaatagggatgggaagaacaccggtggctcgagaaagacatagttagtagaattttttttcagagataatgaatattttgtaaataaatgaaagcatttggcttctgcacagagttcactcagttgaaacaccatgaagcatgcaaaaggaaaaaaaaaaagcaatacggggaaacttccctactgacttgccccggtgaaggctttcacctctatgggcctgttatgtttagagaaaaaagagagtaaaggattcgaatcggtaaagattaattcctctagtgtcatttgctttggaggaatgaaatatactagaactagagataaattttctttcctacaagtcatagagaaaaaattataggaaattttctattcaaaaattcttttaaatttattttgtatgcatttctgttcctatagattgaaattcgtacaaaccaaataagccctaaatctctagttgagaacatggaatcaaaggatggtggtggcctctctcttttagcctccccatcccgctcaccaccatcaccttctttgccgccagagccaagcccttccatccgccgttccggccatctccttagctctctgcaccggccaacacctttctcgagtgagccaagctcaggaacacattcaaccgccggcgtcaccacctcccaaccaccggagcactggtgccccgctcctcttttccctctgctctatatgcgaagaaagaaggaaaaaagagaaaatgggaggatggacgaataaaatgaatctgacgggtgggtcccatgtgtaaacgtgaggaagatggaaaatatgatgacgatgacatggttctaattttgtaaaatttgagtggcacgcttacgaatagacgaattgtaatgacatttttctgaatagccacatttgcaatggcatggatcgaattaaccctaagaattattccaaaggagacttttttatttatacaatgtaaatcctccaaaaagaaattctctattttcccttagggcatcaccaatatttactacttctacctaatttgtgaataagggcaaaccttgcgccagtgcatattagttgttgtagtagctaaaatggtgaaataacaaaagtaggttctaaggtgatcccacagccactagctatgagagagggtgaatttttatttatttatttgttcattatgacaaggtaataagcatattatctatggccgagtttagttccaaaatttttctttaaacttttaacttttctatcagatcaaaacttttctacacacacaaactttcaactttcaaccaaacttctaattttaacatgaactaaacacactctatataaccgggctgtaataggtattttattgttactcccgattgtggatgcgcgcttggttctctctagtcaagtctcccaccatcagatgatcagacgcgccaaaacgacgcagcacgggcagcaacccccgccacaagccacattttgttccaccactcgccagcaacgtcccgccgctgcgatggcgacaccgctccagtccagtctccccctctccagctggtggtggccgcattcaccgacggacgacgggagtaccccaccggcgccgcaccacggccacgtgacctcgctcgccgacgacgcatacagtagtactcctactcccgtcgtaggaggagagtagccgtagccgtagatacctcgacggtctactacaccctagagcccctacgactactactagaggctactagccgtagaagagaaaggcgacgcgtgacgcccaatcggaagcctcccccaccccatctataggcggccaggccagtagatatagggtgcagcttttatcgcgcttctgctgctgcagtctgcagacggcggccgcagcagaagctgccctccgcccccacaagaagtctcgatcccccccacactgctcccaacgccaacgcacagaggaatttcgagccacttcaattccacgcagaccacctctttcactcttctcttccctctcgctttctttcctcttgaaaaagatagcgagagagagagagagagaacaagcagcggctatagctaggggggagagagacgaaaggaggagaggctagggggtagaggctagtaagcctagtatagaggggtttctttcttttttgcttgggagagagattcttttatagtgggaggagaaagggagggaggaggagtactaggctctactagcgccgtagctctactggtgatcgaagtggtgcgcagcagcagcagcatcttcgcggtattctcgcgcttttctcggaagctggtttttacccggtcggaggagagaggtgagcaagcgtggcgtcgtcggcggggcggcgcttccagtccgactccggcgcgttcgcgggctgggtcgcggcggccggcgggggtggcggccgaggggacgacctgtcgctcgggttcaatgctgcagccgcggcggctgcggcgccggcggccgcgtcggcggcatcgctctggggacctgtcgccgccgcgtcgtcgcgccaggcggcggcgctcaactacgggttagccgccgcgggcggtggtgacgtcgggatggtgctcgtcgcccccgccgcgtcgtatcatcaccacagagccgccgccgccgcggcggcggcggcggctgcggcggccgcggcagagcccgtgttcccgctgctcgggacggggcagtgcgcgctcgacgctgacactgccaagtcgtcgggcgctgccgcggcggcgggggtgccgcccgggagcgccagcgccatccacttctggcagtcgcagccgacgacggccgccggagctggtggtggctccgccgacaagaagccgctccccatgctggactacggcggcatcggcggcccgggaggctccggcgcggccacgtgccacgactgcggcaaccaggcgaagaaggactgcgtccaccaccggtgccggacgtgctgcaagagccgcggcttcgactgccccacccacgtcaggagcacctgggtccccgccgcgcgccgccgcgagcgccagcagctcgccggcgccgcctcctcccctcccacttcctccgccttccccgccgcgaccaccgcctcggccaagaagccacgcctcctcggctcccagaccaccaccaccacctcccgcacctccacctccaacgccaccactcctcgcagcttcgacacctcctccagccaccaaggtaagtgagcacacgcccgcggcgcatggcggcgatggcgcgccgccacacgaacagaattccaggaagcctaaccatttttgcctcgtcgctcgtgaattcctcgcagtcgcgtcgttcagggacgccctgccgcgccacgtgcgcgcgccggcggtgttccggtgcgtgcgggtgacgtccgtggacgacggcgacgacgagttcgcgtaccaggcggcggtgaccatcaacggccacatgttcagggggttcctgtacgaccagggcgccgacgacggccgcggcggcatggcatccaccagcaacgacgagtccagccacggcgccggcgccgccgtgcccagcatctccgacctgcacctcggcagcgcctcggcggcggtgccaccgcacctgtacagcggcggcagcggcgggccgctgatcctcggcgggttgggctacggcaacaccatgaactgaaaaactaatcgtgcaacaagatcgagtaagcatgaggtacccattgattactataaaatctcctgcttttcttttcattgagtagcttagtttatggagtagtactgtcattgctactgatagtggcagaattctcgtttcttgttaatgttgctgttgctgcaatggagcaagctatgtagtcttgttattagaagctgggaaattaaaaaaggttcaagcatttacaggttaatttgtgcgctcatttgcataagatattgccttgccgtgaatatgtgattactggaatatttatcttttgttacattgggaattgcttatgaggttatggaagggttttttttaattaaccataatggagtagaatcatttcgagttcatgtgtttataaagttgttttggagcaatcattccgagtacattttgggatggccgatacaatggagaatggagcggaaaagtttgactctttgatgctctcttatctatcgtttccatgccatcactagactgtcttgcgtgttttagctgccaaatgcaggcctcgtttaccatattgagttgcttgccccttttccagttttatgtccaagaggttggtaggaacagggatggaaggcatggattctttacttggccgtggtgtgtgctgttaagcatcttatccatgcattggaacttgtagccaagagacgaatgtgcaatgcatgtgcttgataagacctcttctcttctctttgcactaaaataatcttgattagaattggctaattttggtcatggcatggaagccaataatccactagccatgcctggttgctgcatgttctatatagggcaatgcttaaaagagaccatggaacttgtactagccaagagatcaatgtgaaatgcatccgctgataagacccatccgtctctttgtattttaataatctgattagaaaattaccaacatgatcatggagttgaaggcaataatccatctattagtaggagtaccatatttggttgcttatgctacgtgaacttctcctaatcttttgtttccaacccggaatattattattccccttccggatcccatcaaagatgaaaagatgtgaaaagaaagaaaggaggtgttgatgaacagccttccactggtcgcagaaagatagccatgtgtatttaatcatttgttttgggttggagtaattttagttgctgttttctacacctactcatgtcttgtccaatgagtgagtttggtcggttttgcttgagctactgtggcatcaaatctttgtgtcaattatcagtgcacctacatgatgatcagtctatatatatcttgtcatcatcaaagctgttgttatcttatgtgactaatcaaagcgtttggtccatgccgtcgttctgaatactgcctaactttcgggagcacggacactgttcagggtgcttctttatttgatgcagtgtactgtagatttggtgtacctcttcaactacgcaacggttgcgttaagttctactcctagcttgactaacggcaaaactgtttacttgttcagttaggacaccatgctcatcttggttactactacgggataatttgattatttccactcttgtgatctcatagttcagcactaatatatacaattgctatttattacggagtatatagcctgattagcctatattccagttattctcgtattatttgaaatgataggacaatcaataatcataagtgacaatcatgttaattttcttgttgaatgctatatattgcgtagcaccactgaaatatgcccatatttgcttgctgtgaagacagttgcacgtaccgttcaacaacccagtgatttatgtttcttgcatatggtagaaggatctcttcgaaaaatcaacagatgcaagaaactgcatgctttggcttgtttgtgaggtttatttttgttcaatagttatttctccaatattcaaagaccgcctgatgctttggctgtttaagtgaattctttattgaaaatcccttaataatggttggatatacattattgatagatattattgctgctttgttattctttgtgttttctgaatttccagtgcagtatgaatggtggtaattatgggagtcttatcactgcctcaaagggaatgttctaaaattgaaacttatgtttctgtgctgcttaccagtgatatgctgttcaggattttgttttctttctgacagttgaaacggtttacatatgctatcctaggtaattagcccttttgtttaccatgatagcatggtttaatttgatgtatgccagtatgattactcagattagttgcctaatatgccttcctcatgctgttgtgtttgatgagagaagctgctgttagttggttaatgctttatatcatttccctgaatcatatgcaagaaccaatcaagtgaatttcgttcttttttgctctaacctgatgagtaagctaagcttctggtagatcacattctttattttttacactgatagtactccctctgtcccctaatataagggattttgacattttgtttgcactgtttgaccatttgtcttattgaaaaaattttggagttattttttttttgactttattatccaaattactttaagcacaactttttgttttttatatttgcacaaatttgttgaataagacgagtgatcaaacagtgcaagca

SEQ ID NO: 8724 - DNA, 705 bp, Oryza sativa
gatgtcaagatctgatttcaaatgacctttcaagttactattcaaactttcacttaattgtgggcttcgcatccctattgtgaaaacatctgacatgtagcactcagcccacttttcttttaaattgtatatgctatccaaccaagtcactttacgcaccttttgtctcatggcatcaaatacattattcaaattcttgtttttcctcatactcatacatacatgcactgaaatctgctaggatacttgaaccttctgtttgttgaggactcaaatgctttacttcattttgtgatatgtgccaagtacataaaccatgccatgcaccagtgaatacttcagacacagcctttcccattgcaatgtcttggtctgtaaaaatggtttgaggttgcttttgattatgggctgataaaaatgtattgaacaaccacttgaatgattcaaatgtctcatcatacatcaaagctgcaccaaaaaccactgtctctctaaaatggttgaagccaacaaacataccaaaaggtctactttctttgtttgtcccgaatgtagtgtcgaaggtgatgacatcaccaaagtgagcataatcagcaatcatcctagcatctgcccaaaatatattagctatttgttcttcgcaatccaattgcactgcatagtgaaatgagggattttccacaattttatcttggaagtacttta

SEQ ID NO: 8725 - DNA, 2435 bp, Oryza sativa
  unsure (1)..(2435): unsure at all n locations
attccagaaatattagaggatgagtggttcaaaaagggctacaaacgcccagagtttgacgaaaaatatgacacaacattggatgatgtttatgctgtcttcaatgactctgaagtgagtaaactgcaatatgcacttgaatttctgtttcacatgacatgaagataaaagcatgccagttgctaaatggtttgaccactgtgatttgacctcctccaggagcaccatgtgacagaaaagaaagaagaaccagaagctctcaatgcatttgaactgatttcaatgtcagcaggcctcaatcttgggaatttgtttgattcagagcaggtacgtgatctccctatttaatcaatattgaccaacaaccttttgaacctattctccctgtattatttttatgaacgaacctgtaacttaaagttaagcgtcattgtttttggttcaacttatacctccctaaatcaagctggaaacatgtaaactggctcactggcactttgtcaatttactcaatcatatggttggagaatgctgcatgtcacaagtcccagaatatatgtagtagttcattggtcagaatgtcttttgatttttgcacctcataattctgccataactttgttatagttttgcaacttattctgctgtactttaattttgttcacactatttcaggaattcaaaagagaaacaaggttcacatcaaaatgtccaccaaaagaaattgtccgcaagattgaggaagccgcaaaacctctaggatttgatgttcagaagaaaaattacaaggtatgctccccttgcctaacaactatctgcatgaatatccgttttaaagtaatgggttctagggacaatttatagcaaattcaaatatatattttctacgtgctgaatttttttttattgattgaccagttaaggttggaaaaggtaaaagcagggagaaaaggaaatctcaatgttgctactgaggtaatatgaagaactgctatactgcaatctggtttgtgtaagcttcttcaatctaacatttattgtgcactattattcagatactgcaggttgcaccctctcttcatatggttgaagtacgaaaagcaaaaggcgacaccctcgaatttcataaggtagatcatgccaattaaaagttgatgctcatgaattatcattggaaaattgagtcagtgctttgatgattggatcaactactcacagaattatgactatgttttttttttcttttgcaacatttggttgaatggcttgtactgaatcacttcaaacttgtaatgtgttgcagttctacaagaacctctccagaaccttaaaggatgttgtttggaaatcagatgatcttcaaaatcaactttcctagagtaacttgggagaggaggaatgggtgaactattttagcatcccattcttttgaatcagcattcccatttctagaggctggaaaagcagaaagcatgttcattgcatctgtaattagatgtgagtggccctgtaaactatgtttggtctccactagtgttgtaaatgctgctcttatttgtcagagaacccttgtgatagctcaagtgaagctgatcactcaatgggttttgtgtgtcaagttttgtatgtaaatcagaatcttgtgaggaacaagtatattaattggccagcattattcattttcatttacactgtgtagttgtttgattttcttgtttgcatagccccagaacaagtgtaaccagaaattgaggtgacaaaaaaaaaactctgaactatacaatcctcatcagaacagttgcaaacctgaaactacatctttttcagaggatggtacatgaggaattcgggccgcagcagccggatttcttgtggagttacttgaccgatggcctccacttccatgtccctccatcatattctgccttcgcctgcatatgatagcaccaaagttgttcagataaatatgattatctgatgacgaatgcactacattatgtacagttcagcagaagcaacatttgcagattaaataggaagaagaaatataatgataatctagaaaagatttgtaattccagtgctagtaataatctacatggagaaaagaaaaagaaaaagaaatcaagaaagcagaaaagaaatgaatgggaggaaggaagaagagagagactgactttgccatcatgaccttgaggaactcgttgtagttgatctggccgtcgccgtcggagtcggcctcgtggagcatgtcggcgagctcgtcgtcggagagggggtcgctgaggttggccatgacgtggcggagctcgtcgggggtgatgaagccgttctggtccttgtcgaagacgcggaaggcgtcgcggatgtcgtcctcggcgccggtgtcgcgnnnnnnnnnnnnnnnnnnnnnnnnnnnnnnnnnnnnnnnnnnn

SEQ ID NO: 8726 - DNA, 6292 bp, Oryza sativa
ttgaatatctactataaaagatatctaatggctaatgtttgaacttataatatctccaacatatcttaagatatatttattttcctcggatatgtgcatttatttattcttttttaagaactggaagatatcttcatttattaaaactattgatggattgcttggatatgttctcatttaataaaaatatgatatgctagatggattattctcatttattgatctgctactacacagtaatttattctcatttattatagagtaaatttcacaaaactatataactttcatcaaattatcacaaaactacagatttaaggtgatatatcataaaactatatatttaatactaaatttatcacaaaactaaaggtttaagactaagtatcgcaaactatagatttaataataaaattatcacaaaactacacatatggggttcaaatccttatgtttgagttatcaacgtccaagttttataattaaattgacgtaaacatgtggttttgtgataattttattattaaatatgtagttttgcaatacttaaccttaaacatatagttttgtgatatattatcttaaatatatagttttctgataaattaatcaaagtatatgtagttccttaaaatttactctttattataagtttataactaccaatagaccattagaacgcatgatgctggtaagtagcatgtagggctaacgatgtcccacctgacacactgaaccaagctacagattatttgtgattaattaagtattagctaattaaaactaaaaatggatgtatgattttttttaaaacaatactttctatagatttttttaataaaacacatcatctagcattttgggaagtgcgcgcacgaaaaacgagagtgtagaagttgggaaagtagggaggatagcatagccctagagtgagttctttcttgatgttgggaactcatccctcgcgcatgaaaaatgaagcgacttattagcgcatgattaattaagtattaactattttttaaaaaaagttaatatgatttttaaagaaactttcatatgtaattgttttaaaaagaatacaccatttagaagtttaaaaagcatgtacgtggaaaacgagaaagttgagtttagaacttaaccgaactcaaccctattgatgttgtgaagtctctgttaaaaaaatagaatgatctaaagtaagttgtcttgactactgtctggacaacaggttgaatggtgattttaatatgcccaagaaatttacaatattgaaagtggttattatcttgtggttgtggctagagggagatccaaaagaaatgctataaaagtatagattgttgcatgatatgaaaataaggatatcaatccgtaagcccttctctatttatgatgggaaaataatttgtgaaaagttggcttagatattcatctaacttagaaatactcagttgcattttttttagttttaatcatttgctacataatttcagtactatagtgatgtttatcaagttgtccttaagaacctgcactctcttacaatcttccaactaacaaagtacagtgctcttgaatttgcatagtttttacagaaagggtgaaatagataaagagtgaacttcatattaaatctcaaatacttgtgttagaaccatcggaattaggtgaaggcatgagcatcatcttcagcagaaataagcatttgtactatgtacttcatggttggccttttgtttttatcttcttccaagcatgaaacggccaattgcattagtagcctagcctgcaaatgattaaattcaccatgcaaccgatcatccatcaaatccgcaaccaaggattctatgttgctctcaagtttgctgacaaccatcttaaccacacttctcaattcggcttctagttcctctttcccatccaacacccaatctgaaatcctcacccctttcaccagttcaagaagcaccactccataactgtacacatcaactttctctgtgattggaaggctagaaacccactcaggagccatatatcctcttgtcccccgaatccatgacatgtcagaaccagacccgtctctattcaacaacttggacaagccaaagtcagtgatcttaggctccatatcttcatccaatagtatgttctctggcttcatgtcgcaatggatgatccactcaaggcactcattgtgaagatatgccagccccttggcaacacctagagcaatgttgaacctttgcttccatccaagaaacataccagaatccctcccttgaaatagtactttggccaatgatccattctcaatgtactcatagactaaaatcctatgtattccttctgagcaaaaaccccacattctaacaagattcatatgataaattctaccaataacactcaactcagcctggaacacatcctcaccctgcttcacatcttgtagcaccttgacggccaccgtcctctcatcatctagaattcctttgtacacaacacctgacccaccacggccgatctcactctgaaaatttctagttccattccgtagctctacgtaactatatgcgcgaaaatggttggtaaccatcctgtacccttcatctagtgctgaaacctgacatcgcctaaaaactcccttgttggaaaagagccagcaaccgaatgctatcacaaacacctcaatgacaaaaaatgcagtcagaaatccgtagaagtagaaccatatcgacttgccctgattacttttgctcgatgacgcattcgagacattgagcaagaactccggtgagctcatgccaccgcatccgacaatgtcttcctgaatggcaatggcgtggcgatcgccgtccttttgccattggtggatgtgaatttctggcatgtcgagatcagccgggaccttgagataggccgtcccaggcaggccggggaacgttctgccattgaacatgaggctttttgggtagcactcacctttgccctgcttgtactggaaaaccacgcacgacggctcgctcatgcaccgtgtcgagcactcgtccagcgacaggttctcgctgctgttgatgtcgaagccccagaagtcggtgtgcggcagcgccaccagcttcatcgcccgcggccggccgccgccgtcaccggagttgaacgttggccggcagcctctgctccagtcgctcgggtcggcgcgcgcgtaccccggcgcgcagacgcacaccggcgccggcgagtagaggcagacggcgttggcgccgcacacgccgtggatgatgcacgggttgctgaacgccatccacgacaccaaccatgtcccggcgacctcgtcaaggctgtacagcctgaggttgccgtccgtgtccagcgtcagcctcctcctaacggcgacattcttgcccagatcggcggcgccgaaggtggcgttgtcgctggacgagaaatggccggaggcgtcgaagaaagcttcccgggtgaagttgtagatcttgcgactgttctgccagtagctgtagtaggggttgggccagtagatgctggacatctcatggttgtcgtacaccagcgacagcatggcgtagtcgctgaagcggaagctgtagaagccggcggcgaggatcttgtctgccgagaccatcgcctcgccggcggcgatgcgctgcgtgggcagtagtgtgtcggtggggtggtcgaagctctgccataggacgttcccgctcccgtcctcgatggcgaggttgccggaatcgtgcagccgcgcgcgcgcagcggtggcgctggcgctgacggtggagttccagaccacctcgccgtcgtagtcggtgaggacgagcgcgccgcggcggccgctgagtttgagacgggagcgcttgctgtggacggggcgggcgcggttggcggaccagacgacggcgcggtcggcggcgcgcgcgaaccagacggagaaggtgaagacggtgggcgagacgccgtagaagccgcaggcgaaggtgccgtccggggagagcaggacgtcggtggcgtggtcctcgacggcgatggaggcgccccggaggagactgtcgcgcgccgtgcacggaaatggacgcgacagcgagacgaagacgacgagtagcagcgctttggtggcggcggcgcgaagggcaccgctactgctacaactagtgctcatggctgtcaagtcgtgccggtaatggtaattggtaggtggcgaggaagtgattagctttgatctaatctactcactgttgatgtgttgagttaattagacaagtatactagtaattaacaaatgttttatccgacaggcaaattgcaggaaccgtgaccaaggcgcctaataagtttgactcgccctgacagacgacgacaacatgtttttcctgagacaatggggaccagatcctgcaaatggtattaggaggcaatcgcgactggtattggaattttgtaattcttccgtttcacaatgtaaaaatttctagcattacctgttggtaatttttctaacaagtcgacaagcacgatcgcaacacctaaacgccttgcggtgatatggagtcgccaaccacctcgatctaaccaaagggccaaatcaatatgggttttgcaaaaagaaaagctaaaccggctagcggagctatgggttttgcaaaaagaaaagctaaaccggctagcggagccgatttagagatcaaaatcagcctttatgccgatttagatcgatatgaggataactacccgtctcgtgggcaaaacggaaggttttcaggacaaacctacaaagaggtgtcgcactctcgcagcggcgacggacggtttacggcgcaaaccgacaaagatggactaaaattagggtaaaataaaaaacatagtaaaagaacgattcaagtagattgtattcgggtgttttacgatgaaccggtcttgtcccttctccacgtccaactcgggatagaaaataaaggaaacacgaaacatgccttcccgagcaaggaaacccgagacctgacgaaaacagactcggacttggaccctaccggtctgaccgcccacatacctgcggtcagactggccctactagccggtcagactgcccatatacctgcggtctaaccggccctatgaaggaaacccggcactttccaaactttaaattttcctctatttcgtctataggtgccaaatttgggtgtaaacacatgcccccctgcattttttatgaacatcgtgaatctaaaagcatagaacatattgtcttagggcgataatccaattaccggccatagtacttcctaagcatcttgccaaatgctcgggaagtatttcttcaagtatttcccattaattgctctatgaaaacaccgtcttgaagtgtcttcatctccttcaaagtcttcaaacgcttgtcgatgacgtcttcaaaattgcttcccatcaaggtcttgtaatcttcaaccgacaagtcatcttgcttgaaataccgaagagagtcaagatttacctcaacttcgtataagtaatattctcaagcggcacggcttcggcccacttagtgaaatccattgcaactagcacgaaccaatgcccttttgataacgaaggataaatctgaccaatgaaatccaaagccctacctcggaacggccatggtttgataataggattcaatatagcgacatgcgccaaatgaacattgccgatccgttgacaagcttcactccctctgtagcacttgaaataatcatcaattactttcggccaatagaattccactcttctaagcaaccaattcatcttatgggccaattgatgaattccacaaatcccttcatgcacatctcccctagcaactttagattgatcattgtctaaacacatcaatagcactccatctatatttcggcgatataatatttgaacatttgccgccgaatcttccgatcaaccccaagactaggatctttcaaatattctatcaaaggaattctccaagctatttctaactcatgggcacaaatgtccgaattcacaattaattcggccttttaatcaactgtaacgtgcccccaagcctcctgtctgggatcggtcagaccggccacgcaatgccggtcagaccgccctgtctgcctgaacagaccggccatgcagagccggtcagaccgccggtaccaccggtcagaccgccggtaccaccggtcagactggccgtgcaatgccagtcagaccgcccctagtctgtattttgccaatttcatccaaagacttaaaagggctgcag

SEQ ID NO: 8727 - DNA, 9570 bp, Oryza sativa
aaatattaacaatgccaatgttcctaaagaaaaccactctagagcaaatcatcacattgaccattgacattagtcgaattactagtaagcaaaactttcatggtgcaataaatatgaaatctatatattatctggtgatccataaaaacacatataatttggctttaaataaatatcagagtcatgagccaaatcatatttcaaacaaattatatgccaacctaccaattctactacctagaactggcatttgcaacatgtatgtataatatgaatttgataagtaaaaacacacatgtgctagatagcaagcaatgttctaacatggcataggcatataatatgatgatgaacacaataaacccataccttgccttagcatccaacaaacggcggctaaaagatgtgatgccgtatccatcgctattcatcttctcttggttccctcataagcatattgatgtcttgccccccgagcaaaatcggctttcttgattgcacaatttcaaaggcaagacgaacaccgcaccagcatcgatagcatcatgtgaaggagacttatctctaatgaccgatgattcttctcttatcaaattggattcatctctactacgggaaatcaccagtctcttaacttttacctcattggatctccacatttgcctaggtgcttttcgaggctccaaattattgcatgtcttgttctccacatcttcggcctctttttctttttgacctatggctcgaagacgctgtagcctcctcttttgagagtgagataagccagaaggtatccacttcggctgtggttgttttccaggagctaagcaatgattcttcatatttttggtcgaagtggaagctcctatgttgctctcaattttcacactcttctccaatacccccccccccggtcagaccggcctctgggcccggtccgaccggtcacaagccgtcggtcagaccggccagtaaggtcggtcagaccggccgtagactggcggttagaccggccagctggctcggtcagaccgctgatgtcgacaacaacggtattggctttagtcttttccgtttgtatagttttcgctgcatctccagtaggtacatgaacatcttgagattcctcattgatagcaacgacctccggagctttggcttctttcctcacccacaccttcttcacctttttcacctttgatccaccggaccgattcttttggggaaacggtcttgtcttgagttggatgaatgatttggcactaacctaggtgattccttccactcttggtaatacggcataggtggttgatgcatccaaggcatgtaatacataaaaggataaccatatagtgacattggatatggataccatggcatcacaaccggaggtttatatggagttggtatggttgatggctccgattgctttgatgtttgaccaaatctcttcctacgagatgatcttggtcttttcgaatcactagtttggttatcaaatcgttgaccggctaatcctttcttgtatttagccataagcatctcaaaagtgagcttcggctttttggtcctttggatactagataactcatcctttgcaactttatgatctccggcctttgcattattgatcctattcttgggccaaggatccccaataataacacttttccctttctttttgtcaacatcaataggactaataaggagagaattactaacaattccggtcttaggcataggtgtaaccgaaatagtttcacacgtgaccgatgaagtatcaatcggtctttgctccatcaagcttgcatctttaaaataatcatgaaactcatgctccatttgtgaccatgtagaaattgaattgggagcaagtaaactatatcatgtacatgcaaagtttgacaaagaaagaggaaacaactttaacttaagcaaatcatcactaccggccttaccacattgttcaataaattgaccgatatgctccattgttgttctagcatcctcacctgtgaatttcgtgaagttgggcacttcaaatccttgcaggtacgggaccgaatctacatgttcaggatacggcctttgatatgtatgcatagctactttggattctatttcactactatcccgcaaaacattatcattatcttttccaacatccacatgaccgatttgtgattcggtcttaggtgataatgctatttcactttcacttgtgatataacctgaaccgtcacttagttcggctatattttcaatgatgctattctctaagctagcaacacaatccgaaccattacttgttcggctattccatcgttgtctaaactagtaacacaatccgaaccaacacttggttcggctataatcgctatggcatcattgcacaaattattaacacaatccgaaccatcgcttggttcggctatacatgatattgcattttcatctaaactagtttgtaagctattgtcatccactcggctttcctgagccagagcttcatgcaacacatgatcaatatcaagaaatatatggccattcaatttctatttaatagaatcaagcaatccatcatatgcgatgtcagccaaatctttgtcagttattttcaaattgaaacatcggtttttaacatctctaaacctttcaatataatcagcaacagattcattgtatttgtgcctaaccgatgttaaatcagacaacctaagctcagtctcactagtgtggaaataatcatgaaatttttgttctaattgagcccaggaagaaatagaatttgccggtaaagaagtaaaccatgcaaaagcaataccggacaaagataaagaaaacaagcgcaatttacatgtatcccaattagcttcaccacattgcgctaaaaaattgatctacatgctcccatgtggtcctactttcctcaccactaaacttagtaaattcaggaattttataaccacgaggatatgggataatatcataaaaatcaagatacggcttttggtactccctagcatgattccttagctttgcgaaattctccctaatagtatttctaaaccaatcctccacagtttcaggctttggtggatctggtggtggacttggtggcctaaaaggtggttgttgcggcacaatattgttatattggccatacctagtatcgggaggatatcccctattaatatcattgtaggcattagagatatgtggaaaagcatgactaacagtattaacaggtgatgaataataattaaaatcagtactgctagtcgtggtatgaaaacctggagaaactcccagggaaccggtccgaccggcccatggcccggtctgaccggtggtcagtggtgcggtcagaccggccacaggaggcgcgatctggccaggatagggtatggtctgaccggctatagtaggcacggtctgaccggcgtagtacacggtctaaccggccatggtgggcacggtctgaccggcaaaggatgcggttagaccggtgtcacgactggtcataccgtcagctcggttttgcatatagccgattcctatgtaatcggctgtataatcacccattgaccccccctccccctagcattataagcatattgtataggagcaaaactaaaagtagcatatgcatctacacaatgattattaacgttttgaatagcaaaggacgggttgggcgaatcgaaggttacctttggtgaaattacaacttgaggtagcgggacgtcttctctcatgacgccttgatcggtcctaatgtattgtgtagcaatattgttgaacccgttctcactcgttatagttgatgaagaaattccttgattaatttcagccatatagctcgtagccgaaatattgatatttttcatgtgtgtgcagtgagcaaaaatctggaaatttcgatgtctcgcagaacaaccgatacagtatgaatcggttttgtattttttttttatgtacgtacacagtaatagatcggctttgatcaatagcctgatctcgttttgttttgcttttttttactcggttaatatgcacaataagaaagcgagactgatactgctcctattgtcttcctggttcccgcatttgcgtcggcagctgctgctcctcttctccggtctgaccgaattgataatgtcggttagaccggcaagataggcagccagatcgacagcacaagaacaatgccgccgatctgaatcaatcaacacaatgatcgatagatatgtgcagtgatagtacatagatagattgatttcggctgtttagccgaaactctagatttgacgaaacagaaattactagattaaacgaaattcggccatgatatggctgattagatcgttccccagtggagtcgccaaaaatcgtgttggcaacttttttaacaagtcgacaagcacgatcgcaacacctaaacgtcttgcggtgatatggagtcaccaaccacctcgatctagccaaagggccaaatcaagatgggttttgcaaaaagaaaagctaaaccggctagcggagccgatttagagatcaaaatcagcctttaggccgatttagatcgatatgaaaataactacccgtctcgtgggtaaaacggaaggttttcaggacaaacctacaaagaggtgtcgcactctcgcagcggcggcggacggtttacggcgcaaaccgacaaagatggactaaaactaaaacatagtaaaagaacgattcaagtagattgtattcgggtgttttacaataaaccggccttgtcccttaaataggggttggtcttgccctctacaggcccttctccacgtccaactcgggatagaaactaaaggaaacacgaaacatgccttcccgagcaaggaaacccgagacccgacgaaaacagactcggactcggaccctgccggtctgaccgcccacatacctgcggtctgaccggccctgtgaaggaaactcggcactttccaaactttggcaattttcctctatttcgtctataggtgccaaatttgggtgtaaacattacccatattcatttagatgttaaagaatctagacatatgtatgtgtttaggttcattaacatttatatgtatgtggacaatgttagaaagtcttacattgtgaaacggagggagtagtttactacccctccattctacgttataagctttttgggcgaagcaagaagccttcgtctgaatagaaggggccttcgaccaagggtttgggagaccttgcggcccatgggggcctttcgtcattaatgggccggcccaaggagatcgcttgagggcccatgaatacaaaagagactgtgtacccacactaatgtccatatcataaaggtatccatgtaaattctcatatactaactaaaccctagaaggtatgagcatgtactaagactataatattgctcttactattccatcaacttactgagtgaaccacgtctttcgatatgacgcaattgtcttttgacaacaatatctttatccaaaattacaaattattttatggaaactaaagttgccatagaatacaaatagctaatatcaacccctgatattccttgcaagagatctaaggttaaaactacatatcacataacaattaatcaacaaatacatgactgacatagctttaaccttcaaatgaaatgagtgcttgcacaactgagttcatgtttggccgcttgctcctatcttcctccaagcatgaaagagcaatctcaagcatcagcttcacttgtacatggttgaaatcaccgttcaatcgatagtccacaagatcctcgatagatttttcttcattggactccatcttctcacgtgtcaccctaacaactatcctaatatccatctcacataccttgatcccatggatcacccattccgaaatccaaatccccttcactagctcaaggagtattactccataactatacacatcaaccttctctataaccggtaggttagtaacccactctggagccatgtaccctcttgtccctctgatccgtgtcaaaattgcatctgaaccatctctgtttaacaacttagacaaaccaaaatccgtaatcttgggctccaaatccttatccaacaaaatgttctcaggcttcatgtcacaaggaacaatccattctgaacactcactgtgaaggtaagccagccctttagccacacacagagcaatcctgaaccgttgattccaatcaagcacatcatcatcaaatccatccctaccaaacaacttatgtgcaagtgatccattctctatgtattcagagacaagaatcctgtgcttgccttgagagcagcaaccccacattctgacaaggttcatgtgatagatccttccaatcacactcagctccgcttggaactcctcactctaccggctcacgttcttgagcaccttcacggccaccgccctctcatcgtcgagcacgcccttgtacaccacgccagagccgccgtggccgatcacgccggtgaagctcgccgtggctttcttgatgtcaccgaggggtcacatcaagaaaaggttagaatgttaccgagcagtggcggatctacgaatttttctaagcccgggcaagcctagcgatgggtagaaggtgtacttaaatctatataagtacataaaccatttaatatatattatatagtcttgtattatcttaaaattgaaaaaacagatgatcaactagtaaattaattaagaaagtaattagctactactactcaactgcatgtacgactgaaccctgtaactaagtactagtcactgcagtatggtgcactgaatgaggcgaagtgatggtaacaagtaacaagtgctctttcactgttgattcatgcggcggagctcgggcagctgcccatgctagccgggcggcggctccgccgctgttaccgagggtcttctctctggcatatagaagcttgctgcagaactttctcacatgtatgattgtgaaaatgaggacatggtggtgggttttggaacccacttgcaattccagccataccttcctctatggtatggtatgtgtgacgtgataaatattcatctagctcagctaaacccttagccatgtcctcttcctggacaacctcctcctcctcctcctcctccagtagtacatgaagggcaagaacaactggatgtattcctttatttaatttcttcatgataggatgattcttcaaaatagaatgaatacccctctccagatctgcttcttcctcttcatgagtcatattcccaatagaacaaatgtcctcatccaccacatcctcatccacctccaaatccaatttctcaaacctaaacaacacattacaatccaattagtaatcatattaaaaaaaattgtccctattaatttagagatgattgtaatgacaacaaaatcttgcggttatatgacattttattaacaacatgcactattttcttagactaaacatggcatgcattaaattaatgccaattatcttcatatgaagattaatgcatggtgcacgagtcaaaatatgaagaaatacatgaacgcaaaaacaaatactcacaattgtgacatccaatgcggtaattcgtcttgttcatgcaagccagcagcatccacgttgaccctaaataaatatagcattgcattaacgttagcatgttgctaattaatcttgctttgagaaactacaatgcatggatctaaataaatcaaaaggaacgcatagttttaatatggcatggttagaagataacccttataaggttttcagcaggtgatcatattttcacacacataaagaatagaaaccatttttcatctcatgtcaagcatgcaatttttgccaaaagcaaaaaacagtgccctgatataaatagaccaattgatagaagtgaaatgcgttaagcatatagtaacaaaacagcaatataatatcaaggataagcttatgaattggcaatacccaaagcataaagaatcatgatttgcagattaacaaacaggataagtaaaccataaacagcatgggaacatctacttagcagaagaaaactgaaggaagagataagatgaacatacatggtggaatcctgctggattactgcagttgattcggaggtcactgtttcagcatcagccgtaggcatttgctccgctagcctgaagaacacaagatgaacatatatatataagtcatcaagaatgcatcctattgcacgagagcaactgagcaagcaagcaaacaacggcaagcacagacgtaagtgcctggtttcttccccaattgcctcccgcagccgtgggtcgtctggcagagaagagctgctccggctcgtcggcgtctcctcgtcatcgtcggcgggatccatggcggagtggatctgtggatggatgggtggaggcgaagccgcaggccgcagctagagctaggtaggaggaggaaggagcgagccctagctaggtgaagtaggtcccttttcgttcgaggaagacgaaggggaagggaaggcacattgcgaaatttgatattttaccatcgttaggcagctggattcgccgaaaatatcattatcaattgagaggcttcactcatatgccattttcttctaattctctctttcgtcttattattattgactaaaatactcctagttgaatcaatttaagtatatcaaaaaatacgtagattataaagtaaatataccaaaatagttttacatgttattttttttctctacaccatattacatagtatgcggcgtattatctccacaacataaaaaaaaacactctcaactgaaactctcataaaaaatacgtaattattttttatttatgctgtgaagatagtgtcttatactctgtaatttggtgtaaagaaaaaaaaacatatatattgcatgtcaatatatttgtgcgatatgtactctgtaatctacatatttgctttacttgaattaattcaactaggggtattttggtcagcaaatataagagaaaaaagagaattggaagaaaatggtgtttcggcaaaacccctcaattgagaatggtatttcggcgaatcccaactataagtggtatttgggtgaaaccctattttaacgatggtattatgccaattttctcctagctatgtagtgttatcatggcgcatgggcctttgggattcggcccagtttccactgttttgggccaataagttcatctgaggtccttaagttgtcagcgaatctgattttcgtcctttatctagaaaacgatacaacgggttcctcaactgttaaaaccgatgcaatataggtctcatggcggtttgaacggcgattttagctaacgtggcattgacgtgacaatttaatttggaaaatattaaaaactgtgaccccacatattagttacaccaaaataatgaattaaaaaatggtgggctcatgtggaccccataggttctcaaccccccccctctctctctcttcctcccggttttgctactgggaaagagtagcatgtaggggttgggtgggggg

SEQ ID NO: 8728 - DNA, 6550 bp, Oryza sativa
agaggcgccggtggggagagggagagggggaggaggaggcggcgttgggggcggggaaggaggaggcggccggctcggctcgactggggcgggagggtgagggggagggttagggttagggttaggttttcatcaattttaaactgatctgaggcgtccatcaaaacgaacggctgagatcgatcgagggtttgggccacaccacttgggctgcacgtgggccggcggtccactaagtgagagaggaggagtatgggggtatcgggtatcaagtagattttgctctcttgtgggctgaaaaaggcccatacagaaaaaatgatttttatttcaataaatgctgaaatgatatttgtattatcaaaattagcaattaagctatgtaaattccaagaaaatttcaatgagtgtaattaatatagaaaatttaataaaagttaaatccaaccataacattttatttcttacccttactttacttataaattaatttaattatatacctacctacttaaaaaatacccaaatattagaatttaatatgttttaattcaattttatttgttttttttcttttcttgcaacgcaagaccacttttgctataatttaaaagagtgtaattaatattgcagaaaattttatatttcatcaaattataattcattttcttcatattaatagttcaaatcaaatttcagtcaccatatcattagccggtacaacgcacgggcattttgctactccctccgtttcacaatgtaagtcattctagcattttttatattcatattgatggtaatgaatctagatatacatatctatctagattcattaacaacaatatgaatgtgggaaatgctagaatgacttagatcgtgaaacggaagaagtagttaaattaaatgaatgaagaagtaaaattttgaaagatcatcatcgttaccttttatctcctgatgattgatgatgattcattgaacataaatagatcggccgatcgatcgatgtcctgcagctgacgaacttttatctcctgcaccctgcacgtatatatgcgcgcgcggggcaagttgtagttgagtatatattctgatcacgagcgcgcaccggccggcttggaaacggactaggcattaattatacgaatcggagtagctaggcactgctattcacgttcgcgctcgatcggatgcgtctccgcggccgatcgatccaacacgcgtacgtatgcttttcagattatttgcttcacattttaaaaaatatattttcttgtattgctcagatcaatttgtttttaagttctttctaaaaaaagcttatttatcaatatatttaatattttcctacaatcaagtagataatccgtagtacaatactctcgataatttgtttcaaactaagccttaatgttaggccactaaaaacataatactccctccataatataaggcgcacacatattccaagattcaacctttaaaatatacatttgaccaacatttaatataatatgaaacgaattttatttgttaaaaattatatcattggattggcatttaaatatactttcatatggttataattttgttgctagaaactttatagtatatgagaaattataaattaaagattagttttgaacaccgtgtcaattttgaccgcgccttatattatgggatagaggaaataaagaaaatatagtaataataaataattgctagtggatctatacactcaaatgtttggctacgtggattggatcacactcatgtctgaattaaataatagatgcatcccagacaaagagattgttggatttcatgaatcatttagaaaagaaaaggttatgtgattacataaatatatttcattagtccgaatcctcaaaactctacaccctcccgttcggaactatcattgaccattatcactctttatctctctacaccactcatcactgtttttcttatttagcagctattgtctaatcgatctcatctagtctccgcgccacatccgttctctccctttgtcaagctcttctccccccccccccctttctctctgatctttcatctcattcttaatcacactactgtcgaatttgacactgcccaaacatcgagtttatcgccctaccacttgccttgcccatatctttggtggcgtcatgccatcccttcctcactatgttgtgtagctaggtaatagacatctcttaagcccaaagaaaatcccaccacaacacacccccatctccacccttaccctaccctaccacatgctcctcgacaagctaggataaatagtaaggtgaaaatgatttttttgcaatttttttaatcaaatacttagcaaatcccttaaattaaataaatcaaagttaatgaaatatcttcatctaaaaatacgaattagtttacggaaactaaacttgtcatagaatacaaatagccaatatcaatctctaatacgtactcttgcaaggatctaaggttaaaactacttatcacataacaattaatcaacaaatacatattaacaaagcactagatgacacatactgacatagctttaaccttcaaccgagatgagtgattgcacaactgagttcatgtttggccgcttgctcctatcttcctccaagcatgaaatggcaatctcaagcatcagcttcacttgtacatggttgaaatcaccattcaatcgatagtccacaagatcctcaatagatctcttttcattggactccatcttctgacatgtcgccctaacaaccatcctaatatccatctcacataccttgatcccatggatcacccattccgaaatcctaatccccttcactagctcaaggagtatcactccgtaactatacacatcaaccttctctgtaaatggtaagttagtaacccactctggagccatgtaccctcttgtccctctaatccttgtcaaaattgcatctgaaccatctctgtttaacaacttagacaacccaaaatccgtaatcttgggctccaaatccttatccaacaaaatgttctcaggcttcatgtcacaatgaacaatccattctgagcactcactgtgaaggtaagccaaccctttagccacacccaaagcaatcctgaacctttgattccaatcaagcacatcatcatcaaatccatgatcaaacaatctttgtgcaagtgatccattctctatgtattcagagacaagaatcctgtgcttggcttgagagcagcaaccccacattctgacaaggttcatgtgatagatccttccaatcacactcagctctgcttggaactcctcctcactctgccggctcaagttcttgagcaccttcacggccaccaccctctcgtcgtcaagcacgcccttgtacaccacgccggagccgccgcggccgatcacgccggtgaagttcgccgtggctttcttgatgtcagcgtaggtgtacctctggaaatggctcgtgatcagcttgtagccttcttgatcaatggcgtacacccgtgaatgccggaacaatcctttgcttgagaagagccagcagccgaacccgatgacgatggcctcgacgacgagcaacgctgacaagaatccgtacaggtatggccacaccgtcttaccggcgtcgtgagatgacagtgaagaggagacgttgaggagaacctttctgttgctgtcgccggtggcggcggcggcgcagccggcgatgtcttcttggatggcgaggccaccgccgccgccgtcgccgccgcgctgccattggtggacatgaaactccggcacgtcgaagtcggcggggaccttgatgtacaccgttcccggcaagccggggaacgtcttgccgttgaagaggacgctcttgaggtagcactccatgtgctccttgtactggaacaccacgcacgcgcagttgtcgaggcacttgttggcgcagtcgccgagcggcatgacctcgccgtcgttgaggtcgtagccccagaagtcgctgtgcggcagcgccaccagcttcgccggccggccgcactcgagccggaacgtcggcctgcaccccctgctccagtcgctcgcgtcgacgcgctcgtgccccggcgcgcagacgcacaccggcgccggcgagtagaggcacacggcgttggcgccgcacacgccgtggatgttgcacgggttgccgaacgccatccacgacaccgaccacgttcccgtcgcgtcgtccaggctgtacgccctgaggttgccgtccgtgtccagcgtcagccgcctcctgacgccggcggcgccgaggtcggcggcctcgaaggtggtgccgtcgctggagaggaactgcccgagcgcgtccatggcggcctcgcgggagaagttgtagatcttgcggttgttctgccagtagctgaagtaagggttgggccagtagatgctggagaagttgccgttgtcgtagaagagggagagcatggcgtagtcgctgaacccgaggctgtagtagccggcggagagcagccggtcgcgcgacaccagccgcgtcgccgccgtcagccgctgcgccgggagcagcgtgtcggtggggaagtcgaagctctgccacagcgtcttgccgcaggcgtcctcgaccaccaggttgccggtgtcgtggagccggacgcgggcgccgccgctgccaccggcggcgggggtggaggagttccagaccacctcgccgccgtagtcggtgaggacgagcgcgccgcggcgcgcgtcgagcgtgacgcgcgcgcccttgctgtgcacggggcgcgcccgagccgcggtccagacgacggcgcggtcggcggcgcgcgcgaaccagacggagaaggtgaagacggtgggagacgcgtcgtagaagccggcggcgaacgtgccgtccggcgagcgcaggacgtcggtggcgtggtcctcgacggcgatcgaggcgccccgggcgagccactcacgcgccgcgtcgacgcgccgtggacatggacgcggcgacgagcttagcgtgatgatcacaagcaacgcgaaggttgcaaggcgagagttcatcatggcacatcaatcaggatgttgattctgacaggactgagattaggatgttgatttggactgtatagtgattacggttaatttttttgtcacacaagtcaagaattttgtgcgttccatcgcctgggcaccagtgactaccactaattaagatagtaatatggtaatagactagtgttagtgaaagcgatttgacttagatctgagtattgtatatgcataacgaggtgtacatgcacgttgcgtccaatggagtttgtgtgcatctgaactctgaaattctaaacttctgcttaaagaaagctgggtgagaagatagtagttctgttcacagcagtaattgggactacgattgattaatagaattatggggcaatttcatttttcccccactttcatctctaatattgattttgcccctactttttagggtttttgtttttgcccccactttttgaaccgaaaaatacttttgcccctgctttggatggaggagttaacggtgttaaatatgacatttataccctctcccatatctattcattaattgtgtttttgcccctattatgcatggctttggaaaattatttttgtgaatatgtttaaaattaaatgattgatttggacagattttgacattacaattgggacataatttgaatttgatggaattttgacaaaatttcggcagcattttgacagaaattgagcaaaaattttgacaaaatttcaacaacattttacacaatcatatgaagtcatatcagccttgcatcgttgacaataccacacttggcatacagattaatcagggcattgctcacatgcgaattgtccaccaacacaaccttttccgcatacacatgaaccctcctcccaagagcaagcgccccaatctctgcacaagcggttagaacactgactatggtgactccatctggcgcaaagttgacgcccagcatctcccggaagacagtgagaacctcgttagggcgcccgttggccgcaaagctgttgagcatcgaattccacgagacgaggttctgcccatgcaccggcatttcatcgaacaccttgtgcacgctctcgaacaggccacacgcgccgtagagatgaacgggcgagttttggacgaacccgttcttggcggcctcggtatggaggcactccccttcgcggagcgcgaggaggcgcgagcaagcctggagcagcgacgggtaggtgtgcgtgtcgggcggcgcgaggcggcggcggtggagctcgagcgcgacgcacgggcggaacgagcccgcagcgatgcggtgcacggtgttgagggggaacgggtctagtggcccgtgcgggaggaggcgggagagtaccgccacggcgtagcggagcggcggcgcgcggaggacggcgaggtggaagaggaggtgcttggcgaggagcgggtgggaggtgggcacaccggctccggagcgcccgcacatggatctgcttggc

SEQ ID NO: 8729 - DNA, 4229 bp, Oryza sativa
gcagaggcggcgacttgactccccccctccccgccctctcgctatagggtttcctcccttccccgtcatcagccgccaccccaccccctcccccgccgggcttcgccatgtacggtcaccgcgggtaagccaagcccctcctcttctctcttattcctgattaatctccgcaattccatcccgccgattcatccattgctttctttttttcctacaatacttgcttgcttacgcgatctcatcaatttctcgattcttttagggataatttctaagtaggtcactttgctttgctaccatgatatgatatgatatcatctgcctaggatttaggatacatgtacagcttcccccttacaagaccaaacctctctccccccaataaataaataaataaatcggaggcagtaatacatccaaattgatgtttcatcaactgcaccagcatcccaactgtggtttgtaagattcttttctactgatatgtgtcatccagtagtttgagtatttcttctattcatatgctgtcaacatttaattagtttttgtttatgtccactaatgcgttcgcatttcgactccattcacctttttaagccttaagtcatgtttagattactagtatttcttatctgtgcagttatctttatgtttgggttattttatatgaaatggggattgagagatggggggatcgtctcctttttttttcttttctctttttgggactctggattatctgaagggcaatgatgggaggcgggggggtttcggatgggtacgagggatcaaagaggccacgaatgatcgaatccaatccatacttcgcagtgaccgcaggcagtcccttggatgtctcaaagagggccaggatgatggaaccagcccctccctatttcggagccatgggcagcagcgctgctggtggcaccagtgccttctaccagccctacggcaccaacttacctggtgcaggggctaacagtgccatccagaactttccaggggtccgtctacgagggctcccctttgactgcgacgatcttgacatctgcaagttctttgttgggctggacatagtggactgcctcttggttcacaagaatggccgcttcaccggcgaggcttttgtcgtattcccatcacccatgcaagcagagtttgcactgcaccgcaaccggcagaacatgggcaggaggtatgttgaggtgttcagatgcaagaagcaagagtactacagtgcaatagctgctgaagtgaaccagggcggcttcttcgactcggagtaccgtcactccccacctcctccacggcccaagaaaccagctgaagacaagagcagcatggagtatactgaggtgctcaagctccgtggcctgccctactctgctaccactgaagacatcatcaagttctttgtggagtacgagctgacggacgaaaatgtgcacatcgtgtaccgtccagatggtaaggccactggagaagcctatgtggagttcccgacagcagaggttgtgaagacagccatgtgcaaggacaagatgaccattgggacaaggtacgtggagctgttcccatcaaccccagaggaggccagcagggcgaaatcgcgagtcaggcaatgaattatttgatccagtcatctactttgccctggccttgagcagctgtgttccagtttagctttcgccttgcatgcttaaactgtatccctcgcctttaggtttgtgtgtgtgtgttttagtatgcatcatgttgctaccgtgccacaacccgttggtgtggtgactttataagaacccgaattgcatttttaaaagaagtggtggattatgagatgcctgcactttaacagcagttgcgcctggttggatgcattttatatggcaatggcatgatcattgttttccttctgagtttgcgacagatgttctactgtatccccttctttttggtgaagcaggggatgaagctcgcactaactctgttccaaaagttggttgttaattaatatgaatatgcataaacataacgaggtgtacatcagtacatgcacgttgcggcccatggattgtgtgtgcatctgggatacggttttcccgattcctatgatctatccaatatgctaactctgaaactctaagcttcagcttaaagaaagctgggtgagaagatagtagtagctttttaattctgttcacatcactaattgggactacccccggacaacgattggttaagaccctgtttagatgggactaaaactttttaagtctctatcacatcggatttttggacactaattataaatattaaacgtagactattaataaaacccattcataatcttggactaattcgcgagacgaatctgttgagcctaattaatccatgattagcctatgtaatgctacaataaatattctctaattatggattaattaggtttaaaaaatttgtctcataaattagcttttatttatataattagttttataagtagtctatatttaatactctaaattagtgtctaaatacagagactaaagttaaatctctgtatccaaacaccacctaatagaagcaatgtttgtaacataccagcaccagcagctgtgcagtgtcaaatgcaggatgggctgagcagacaggaaaggttttgactgtcagttaatgttgggtgattttttagtcaacacttggtttgatgatctgtaccgttgactttgtaaacaaatgatctatattctactgtatgataaggttgaggtgctttgcggacaagcattaatcagccatcaatcaagccaatggagaagttccatgtagtttcaggattgggacacctcacagattttcagcgagtaaatgcatcatcacagcagctacaataacagactataagaatatattttaaggagataaaatagtgagcagagctgaactcagctgcgtctggagaaatttataatatgccactcaatagaggtactctaaccgaatgtcactatttaggatgttcttataaaaatgccactcaataaagataaagactcgttcttaataaaatgtcactttaggctattttgaggcttttaatcgcaaaagatgtgcggaatgacaaaaatacccatgtgtctttccctgcggcgataacgactccttctcggcgttggcgctgcggtggggcggcgggacggcggtggcggcgtcggcccctagcgcgactgagaggaaatcggccgtgcgtggacgggcgacgccgcgacggtagcacggccggccaggggcgcgcagacggggcggcgtcggcccctagctcctctcgactgcgcgcggtcaagtgacagcgacggcagcggcagctgggcgagcgcgcgccgacagggcggcggtggcggcgtcggcccctagcgtgccaagaagaagtcgtgagaaagagaagagacgcattctccagatctaaacgatcctaagggtatttcggtcatttcgcgagcttagtgtgagaaaaaaattaaaaatataaacaaataaaaaatgtctcaaaatagcccaaagtagcattttattaagaaacagtctctattgagtggcatttttataagaacatcctagagagcggtcttctgttaaagccacatctactaagtagcatattgttaagggcatgttcactttgaagccattttcaaccttaccaaattttggtaaagttaccaaaaaagtggctacatttagtttgctgtcaaattttagtaactatataagaaatcctaccaaaattttggtaagtcaactataccaaaattttggcattaccaaaatttggtaagttttttttttcgcataaagtgaaccggcactaaatttctccacctagatctgcacctgcaccagtacctgtacttgttctacttcttgttgtgcgaagtccagacccaattccaggctcaatcgtatcggcatcggtctcaggtaatgggcctaattccaggcccaacagtaagcaatgcagttcggtcatgggctcttcctcctcctatgcgtatagccgtataggaatagtcgtgtcgcgcctggattaggaccgcgctataaaatttaaaaatcaaggggttttttcgcaaaacgacgcgccctaacaacccaccccgcaagtcggcaaccctagccaccgccgccagtcccctcctcccccgcgctctccctcttcccataacgcc

SEQ ID NO: 8730 - DNA, 665 bp, Oryza sativa
tatgctgcacacatattgatcaacaaacacacaaattttagcatccactacaagaagatgattagtgctaaagttgtaggagtgttttgcattcttggctttgtagccatctcttcttctccgagccatttacaagctgaaggctgtgagaacgagaaaaatattgtgatgaataaggatggatgctatcacaatattgaaaaacatttgggtgaccaattcccaaaaagacactcacattgctgccaaacagtgcagagcgcagatgtcaattgcatctgtcgcacatttacagcagcggataaggctaaaattgctttgtcaaagtgggttaatgttgcaaaagtatgtgacaatccgttacacgcaggaactaactgcgcaggtagttattaattcatactaacttagttgattacatacagttatatctgttttaatttaaccttttgaaaagttctccctgttctgcaatgaataaaagacttatgtttcttttgttatttttgcaggttaccatgttccgtagagtccgtacacatagttaagccgttatcctggtcaatggagaaataaacaattagaaatttggtagctgcataacgtatcttgtaaattttgttggtgcaagtaataaaggagagatggtagcttttatttctttc

SEQ ID NO: 8731 - DNA, 5506 bp, Oryza sativa
ctcctttgttggggcttattgccactgaaagttcagcctatcaaatttttcttcagcacattgcaattctaagaagcatgggctgtagcagtctgacaataggcattcctagttagacttaaggttgtgttcttccctagttttcccaactcacctctctcgttttccgcacgtacatttttcaaactgctaaacagtgtgtttttacaaaaaatttctatacgaaacttgttttaaaaaaaatcatattaatccatttttcaaaaaaataattaatacttaattaatcatctagtaatgcatccttcgttttgcgtgtcggggaaccctcctcccgaacgcagcctaagacttgtggaaaatctacctaggacagaccaatgataccaacaacccgcacagctagcagataatgataccaacaacacccgtacaactagcagataatgatacttcactgtggctcctctgtagttgaaatcagatgatctgacttagtttgcggtgcagccttgaggagcgaggatcaggcaagaatggtcatcctcgagctgtgatgttgatatttaagttgttttcgctgtctaggcactgatttttttttataaaaaaatcaaactattaacaacaatagagcctcaggtatggagatacttgtgggagcatacacaaatacaccttttctattgttcatatgatgaagacatactttacaattgtttgctagtttgatgttgtaataacctatgggcatgatagccgctggtaattaatagaagttgttacaaaattttagtacaaaccgccatgagttaaatatgatgctaggatgagctagcatggcttgaccagtgactacttcatctatcataaaatatgaatacttctagagatttttcacagaaattaaggagcgaggtggaactaaatgagggatgattttgattgtttgatatatgaaagtggtggaaaaaattaacaagagacaatcattgatgggtcaagatgagatagtggatagagaagttgttatatactaaaaatttacaacggaggaagaactagtttgttgcatgtgttgcaatgtagagtatcttgtatgacagctaatgttagaattggtattagtcagatactcacagtgtagttgatgtaacctttggtagtacttcttagcagatttggacatttttctaagttatcttgcagagaagaacttctagttagacttagctataaaaaatgacatttaccttgaatatatggtcaaaataagaaacacatatttaccttgaatatatgatcaaaacaagaaacaacagatcccctataagtcagtgcacaaccgtaacaacagctaacatgtagcagtaattgtaggcaattcctgttgcaaaacaagcatccacaaaaaggggaaacacttttaaactctcgagatgatatcttctcgttgcttaaataatacacaaatagtatactctacattatcaaaacttttcagttttttcttacaaccatttgcattgattttttttaaaaagtatacatgaaaagacatcccctctaaaaattataatccattccccatgagaagcacgttgaatgaattatctagcaaagccagcgtagacatagatgggctaagcaggacgtagacggtgggagtaacatgtctttttttttttacattggagtacatgtcctttgcggtggtaggtgtcattttgctctgtaacctctataaatctctgttttcaccctcctacttattaaatttcggccggcttttgctctgtaacctctataaattactccatatgtattattataagttgtttaactttttttcttagtcaaatttctttaagtttgattaagtttatagaaaaatatactaatattttcaatacaaaacaaacatattattaaaatatattcaattaaatttaatgaagctaatttagtgttgtagatattgctaattttttctataaaacatgataaaacctaaaaaactttaactaagaaaaaaaattaaataacttataatatgtaataattataatatgaaacgtagggagcatctagcaaagaaaacattcggctttgctcgaaacgattggccaatcggtatgtccttatccatgaataaaacatcgtcatgactcatgacgattcttcagcatgactttatctcttcactcggcttgctggaatgctctcaaacaaatacaaagatgcagtcgctgttgataaagagttaacgatgcaacatcactctcagataactgtaataacatactgtattacactacttaatttgtttaatttaattaactcaacacctcaacagtgagcagaagcaaatcatcgcttctgatcaacccattcaccgccacggccatgggcaaaagttgtagccgcgccaccgccaccgtgctgctgcttctcgtcgtcgtcgtcttcctctcgtcgtcgcgtccattcccgtgcgaggcgcgccgcgacagcctcccccggggcgcctccatcgccgtcgaggaccacgccaccgacgtcctgctctccccggacggcaccttcgccgccggcctctacggcgtctcgcccaccgtcttcaccttctccgtctggttcgcgcgcgccgcgggccgcaccgtcgtctggtcagccaaccgcggccgcgcccccgtccacggcgcgcgctcccgcgttgcgctcgacggccgccgcggcgcgctcgtcctcaccgactacgacggcgaggtggtatggaactcaaccgtcgccaacgccaccgccgctcgcgcgcggctgcacgactccggcaacctcgccatcgaggacgcgagcgggaacatcctatggcagagcttcgatcaccccaccgacaccctgcttcccacccagcgcatcgtcgccgccggcgaggcgatggtctcggcaggcaagctcctcgccgccggcttctacagcctccgcttcagcgactacgccatgctctcgctggtgtacgacaaccacaagatgcccagcagcatctactggcctaacccctactacagctactggcagaacaaccgcaacatctactacaacttcacccgggaagctttcttcgacgcctccggccatttcttgtccagcgacaatgcgaccttcgacgccgccgacctcggcgagggcgccggcgtcaggaggaggctgacgctggacacggacggcaacctcaggctgtacagcctggatgagatggccgggacatggtcggtgtcgtggatggcgttcgtcaacccgtgcgtcatccacggcgtgtgcggcgccaacgccgtgtgcctctactcgccggcgccagtgtgcgtctgcgtgccggggtacgcgcgcgccgacgcgagcgactggacaagaggctgccagccgacgttcaaccacaccgacggcggcggcggccggccgcgggcgatgaagctggtggcgctgccgcacaccgacttctggggcttcgacatcaacagcagcgcgcacctgtcgctgcacgagtgcacggcgcggtgcatgagcgagccgtcgtgcgtggtgttcgagtacaagcagggcacaggagagtgctacaccaagggcctcatgttcaatggcagaacacaccctgcccatcttgggacggcctatctcaaggtcccagctgatctcgacatgccagagttgcacgtccaccaatggcagacgaatggccttgccattgaggaagacattgctggatgtagtggctcaagctcatcagagttcttgctcgatgtttccgatatgtcgtcgagctcgagcaataatcagggcaagtcaatatggttctacttctatggattcctgtctgcaatttttgtcattgaggtgtttctgatcgcgatgggttgctggatcttttccaacaagggagttttcaggccaagccaggtttcggtactagaagaagggtacaggattgttactagccattttcgcgcatataggtactcggagttggagaggggaactaaaaagttcaacaacaagatcggtcatggtggatcaggtatagtatacaaggggagtttagacgatgagagggtagtggccgtcaaggtgctacaagatgtgagccagagtgaggatgttttccaagccgagttgagtgtgattggtaggatttatcatatgaatcttgtgagaatgtggggattttgctcggaaggaacacataggattttagtctatgagtacattgagaatggatcattggccaaagtactatttgataggagagattccagcaagtttcttggatggaagcaaaggttcaacattgctctaggtgtggccaaggggttggcatatcttcacaatgaatgcctagagtggatcatccattgtgacatgaagcccgagaacatattgttggatgaagaatggagcctaaaatcactgactttggcttgtccaagttgttgaacagagatgggtctggttctgaaatgtcacggattcgggggacgagaggatatatggctcccgagtgggtttctagccttcccatcaccgagaaggttgatgtgtatagttatggagttgttcttcttgagctggtgaaagggaggaggattacagaatgggtagtggatgggaaagatggagtagaaactgatgtgagaagcgtggttaagatggttgttgacaaactggacagcaagaatgaatcatggattatggacttaattgatgatcaatttggtggtgaatttaatcatttgcaggctcagctagttataaaattggccatttcatgcctggaagaagatagaaacaggaggccaagcatgaagtacatagtgcaaatgctcatttctgctgaagatgaagctcatgcctttacctaatcctgagggttccgaaataagtatgtgaaacttaatacgaggttcactcctcatctgttccaccctttgtatataagataatatgactgggtaccaaactttgttagttggaagattgtaagaaactgcaggttctcatagacaacttgataaacaccccagacctctcatcagtgccggttcagaagggctataactctcggttttgacggttttggaactggcactaatggccctcaagcaccatcagacaattccgtgtggggatcatcagtccctgttagggcagagaaccgccactgatactcattttttgtgcaaaaacaaatacaatcaattacttacttaatccacagacacattgatctagaacacagctttcttgcatacacacatttgtatacaacaatccagaatcactggatacagagattgttgcatttcttgcattcattcctcatctattgcaaacagtggagaaagcaggaagatgccaagtgcatctataatacagttatgtaatacagcaaaaattttgatgaacaaaagtttgttttattctgcaccgatctcattaaaatcgccgatcaact

SEQ ID NO: 8732 - DNA, 20791 bp, Oryza sativa
  unsure (1)..(20791): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacaaacttcaatacaacggcagtaaaagaacttgtcgtatttgctctccagaggaggaacatcaagtattgtgatatttatgtaacatggtgcggaaaagttctgaaaggagatgagatcttgagctccatacctatccacacgaatacgcatattcatgtgacacccagactgaggggtggagagtacgtaccgcgtaacttatctatgtatatgtattttatcacttcctactttagaggtgtaacaagtgttcatttgcaggttaattccaatggaatatgagcgtatggatgaacttattgaccgtgcggtccgtgacaataataatgaccttttctattatgtgaaccttcccccagaattgataaacccttataaggatacatgggtaacttttctaagtgatttctcgagatatatcatacaccaactattggtatgtgtttcccgtgatggtcaccagcggaacattacttggtatggtacttttgatctccgggacatactgattcaagcgggcatgttaggatcagcccccatatcgtcgaaaatacatacacccctattggtggtagacttgattatcttaagctagtttcaattctaaaggataaattcgtcgataatttacaaggttcttcctccccttgccatctgaacaatttactttctgtattgtgcactacttcccatgaaacttatggaagatccgatctattcattacattttttataaaccatccgtgcttgttatcatgtggagaaagagttgcacgataccttcaatatgatcatatgattacaaatcttgtgcaacgcgatcttcgcaaatttaagcaatatttgaatgatacttttggagatcctccttcttggatcgctgatatcagctgggttcctgacatgtggaagacatacaattatagtcctaataacaactcaacgttatggaccccacgatatactttggatctaaacagttgctcacattttgccaggaatttcttgaaccatttcggtcgtgaggttagtctttttttaattattattttaacttttctatatgaaccggtttaggcttttgtttgagcttagacttttaagcaactttttggctcatgtgatttatacaccaatattataggctcttatatctgccagttgtaaaaccaacactgatgaccatcattaattggtgctgctttgtaggtgacggctgccaatctagcacttatgctaggttagcagccaacacttagggtttatttactagtgcttttaagggtcctatcttcacttcacataaactaaaaattactataacttagcttttagcttaacaatataagagtagcttatggtttattggttttaaaaaagccaaatgaaaaaaaaaactaaaaaactgtttgtttgccttagattttttagattataagcaggcgtaagcctataaataaaaaaaacttatgacatatacaatgataattaataacgattcctagtcttgctaattaggaatatttgatgatatggaaggaagagaagtgaggagaggccaacgtcgttgctacagttaataattgcttaggaacgacttttaacctctatagaatgaaaactttactgcatgtgggtgtgaacaaggaatgaatagtaataaaaaaagttttattaatactttagagcctttgtagtctccaccattataaagacatagtttttaaataaatatgcattatctaagagtttatatggactctacctttaaacatacccatactgttctattcttgcataggtttctttgcaggcagctgaggctgccgtttctcagaatctagagtttctgcttccaaccatcatgatgctaatgcctgtgtacagtggacctcatcattggaacaatgacttcatggagatgtaagggaaagtgatcatctatttttccttgtttatatattatcttgattcttgagtactagacaatttcttgttgtagattgttaaacacaaactccgacagaagtaacgggcaaatctcctaatatcaagggataagaggccacgacaaattgtttatcagagcgagtacaataacaggctacaaattagctatatgcacatgtggagaagataagataagagagagaataaaagcggtctatagatttggagccaactgtaacatagactccaaagcgttatgtgtggtatgagaggtgggaccatattttaattgtgtagtatatatttatatataactattgtttagatgagttattaaatgggctatatatgatttgggtaatagttggccatactattaaacttgctctcaggtgcaacgagacacatgctttagtaattaatcgtttaattgcaagtacagtgatgtgagttaagcagggatgcagtcagcatcaatatgggttcattgggcatttttttctgtattgataatgcatagtgcccatattaccaaatttattacgctttgatacttgtggtgttaacagcacgtaccattttgctgctatcttgctttctgaggtggaagaggacggtaggtacaacagcattaaagagaaggccacatcatatggatctggaataaaaactttccggacaatttgtgcaagctttattgtatttttaccccccccctccgttttgtaaaaaataaatctattacacaacgtaatactcccttcgtttcatattataagtcgttttaattctttccctagtcaaacttctttacatttgaataagtttataaaaaaatatagtagcatttttaacacaaaacaaacatatattatcaaaatatattaaatgctagatttagtgaaactaatttgatttttaaaatattgctaattttgtttaaaatattgctaatgttcttattatattttccatatctatttcacctgactaacaaacacacattgcgggagaagtgctctttagtccctgtttgtaacctctttagtcccgggttgcaaatgggatgcccaatccaggactaaagattcctggcccctgacaagaatataaccgggatagttggtcaccaatcgggactaaaaattataaagtcccattgtgctaatgtgatttttgaatgacccgacaaagatcacttctacagtagtgaaaaggattttctagtggaatcttgtttgaataatttgttaacatcgtggaaatattgctttgccctctctctaaatggaagtattgctttccagcaacgtatcccgtttgcataaactatgcgtacaattttgaaggtacctttttcataccaaaggtttcatggagtccttttagacgaatccttcgtgcccctttttggtttttttttcttatatccaaatcaagaataatacttgaatgcatgggaaccctaaggttgcaaaccgcccaattcctttgtatggctgtaccttttttttatatataattaatggtgcgattgtaagagttttgacccaatttcccttgtactataggtcaaccctcccttttcacagtgaattgcaaaaactcactatctcaaagtagggatggatactgagttggtttggctcggtctagttcgttaggtaacgaggccgacggctcgagctagctcatttagcttgtaagccaatacacccatgactatctttccttaaaagattagcatcaaagatacagtagctgccaggaacatcctgtgcaattgaaaaaagaaatcaagcaactggcaaataacaaagtcttgacacgaaccttttgtacacatcaattcaaaatattgcatcatcaaaacaatcgaactctaattgaaaccaaccaaatgaaccatcaaacaaatcactaagccaaaactaacattccgatcaacttacagtatccaactgccgacgacgacgataacaagctctattaattatttgccactcttacggatggtgatagatgatttgtcactaaacccacatgtcatagatagtgagtgacaaaataattaattgtcacatcttaaaagtggcccaaagttaaatgtcccctaatatttgctccgtgatttggatcttggtggcgccggtggcggagttgcttgctcgtgctcgttccttctccatgatgatgatgcagaggcggagtggcacttgttgcggagtgagacggcaggatgacacaacgacgagagctcgtggcctcactcgccgctggtggtgatgggcatggagagaaaaagcgatgtaccatggactacgaagtggggggaatggatcgatctcttgggccttggctatcactggggagcagagctacagtcggtaggtggcggctagggttttctgatggggaggggatcgttctcgatcgattgagcgagaggagtgacgggaatgccgttttttttaacaaattgatccttttcaaaaacttattttaaaactagtccctacaaaaaacttcaaccaaaaataggccgtggactcagcgccatagacattggcgctaagttataacgtatcagcgccaacgacgttggcgctaaactctaatccgaggtggcatgaattcgctgagtcatcagatctcagcgtcaaggtatttggcgctgaggtccagacgatttaaatagctgcggcggcatttaaataagagtgagtagtcaagagaacagaaattattttgtaaaatacattaattctaaaagaatgctaggaggaagagaaaaggaaaaaaattgtaaagaataagagtgagtagtcaagagaacaaaaattattttgtaaaaattatttgtaaagaattgctagaaatgccgccgcagctatttaaatcgtctggacctcagcgccaaatacattggcgctgagatctgatgactcagcgaattcatgccacctcggattagagtttagcgccaacgacgttggcgctgatacgttatagcttagcgccaatgtccatggcgctgagtccacgacctatttttggttgaagttttttgcagggactagtttcaaaataagtttttaaaaaagaccaatttgtaaaaaaaaggggacgggaatgactatcggggacagctaactagggtcaggggatcgatcaattgagttgggtctttcccagatgagtttgggccgccaagctgctgcaatgtggcatgctaaggttgcagcttataaagctcgtgactcgctaacaagctatcagttcggctcgttagaaaaacacaacaagtcgagttgagtcaagctggtcaccagccatgagttttttcgtccagccctacctttgaggtgcttgaaaaaagcatggcctagtgggggtatccaagtttatttactgctatctcctttcagaaggaaacaaattattcttaccattctaccgagactcttctgccattgtatcgagggctgttcccaatattttggcggcctaggatcggacgaggtaaaattagaggcccttggttccaacaaaatgtaggataatatttattttattagttgcaaatatcttcaatatataaatgatacatcccatatatataatacgatatcaatctaatccttcattaggttgctctagacaaacaatatccaactagacaaaaatgaaattatcaagtagggaataggaaaaatgaatctaggagcaagaggaaacttttaaaaagctcagtcgtcgtacatcgagtgatccgagaagtggtcaactgaaaaatagatttgaggaactggtgcgaattaaaggtataatttagtaattagtagtagatcctttttaaaattttaatataaaaatatgttaatctagttaatgacatgattttataaaactttaaaataataatacttgaagtcatatataccaccttctaaaattcgtatggttttgtatcatttatatatcgtataatagagaatcataagaaatgtggttttataatataggccttgtttagttccaaactttttattcaaacttccaactttccatcacatcacatcacatccaaaaacttttctacacacataaactttcaactttccctaaacttccaaacttttccaccaactaaacacacccatatttacttaaaataattgcttacacccaaatttagtacctaggatcgaaataggaaaaattgccaaagtttggggctctgccgatttcctccagagagggccggtctgaccgctatatgtgggccggtcagaccgacaccagagggccggtcagaccggcgggagttcgagtcagacgccgtttttgtcgggtctcgggtttccttgctcgggaaggcatgtttcaggattccattggtttctagctcgagttggacgtggaggagggcctgtagagggcaagatcaacccctatttaagagacaaggccggttcaattgtaacccccgaacacataatatacttgaatcgctttttcttttatctttacttttagccatgttttttactttaccctagtttcagtctatctttgtcgatgtacgccgtaaatcatccgccgccgctgtgagagtgcgacacctctttgtaggtttgtcatgaaaaccttctgtttgcccacgagacaagtagttatcctcatatcgatctaaatcggcctagaggctgattttgatctctagatcagctctgttagccggtttagctctttttctataaaacccatcttgatttggccgtttggctagatcgaggtgattggcgactccatatcatcacaaggcgtttaggtactgcgatcgtgcttgtcgacttgttaaaaaagttgccaacacaatttttgacgactctgctggggaatcgatctattcgaccatattatgaccgaatttggtttaatttagttgtcttgagagtttcggccgaacggccgaaatcaatccatatgctgttagtctgaccgtctgtattactccggtctaaccgacgtaatcagtacggtctgacctcttgtacgacgccggtctaacctacttggtcggtccggtctgaccggagtagttgccgatctaaacggcagaaagctgcagcagttgtgcatcgggacagcaacaagcggccggcatcatcttgctgtacacggtctgaaaatcagaaatccaatcctattcagtttgctgtctatacgtgttctaaaaacaaaatcaggctattagagccgatttacctagaatagacaaaaccaaatcggtttctgttattgtgcattaggcaactgtcaccgagaaaaaaaatcatcaaagccattgcagcgcattggctgttattgtggaacatcaatttccaaaatttttgctagaaccacacaaaatttctgctattgttgtacacggaagatccgccgaccaaggctgctgatcttttggttttcggaatttgttacgtgcacacatcaagtataacaaggaaatcaagaccatatattaatctattcggtcatcgatttcggctatgagttatatggccgaaattaatcaaggagtttcttcgtcaaccataacgagcggaaacgagatcaacaaactcactaaggaggatttgaacgaggagtagcggcagtactttgaagaacaaatggcagtgttgaaggaggaatatcttgcataatacattaggaccgatcaaggtattctcaaaagaaacgtcccgctacctcaagtcatagtttcactaaaggtaacctccgattcgcccaacccatccgttgctattcaaaaagttaatgatcgttgtctagatgcatctgctacttctgttttgcttctatacaatatgcttataatgctatggaaggatcaatgggtgtttatacagccaattgcacaggaatcggctatatgcaaaatcgagctgacggtatgaccggtcgtgacaccggtcagaccgtgcccaccatggccggtcagaccgtgcccaccatggccggtcagaccgtgtattataccggtcagaccgtgccaaccatagccggtcagaccgtgccaaccatagccggtcagaccgtgcctatcctggctagatcgggcctcttttggccggtctgaccgcaccattgaccaccggtcagatcgggccataggccggtcagaccggatgcttggccggtcagaccgggctatttatagccggtcagaccggttccttggaaatttctctaggttttcataccacgactagcagtactgattttaactattattcatcacctgttaatactggtagtcatgctacttcacatatccctaatacttacaatgatcctaatagaggatatcttcatgacaccgggtatggccaatataatcatattgcgccgcaacaaccacctcttaggccactaaacccaccaccaaatccaccaaggcctgagactatggaggagttgattagtgtcattattagggataaatttggaattgaagcaaggaatcgtgctagggtttaccaaaagccgtatcctgattattatgacaatatcccatatcctcgtggttatagagttcccgaatttaccaggtttagtggtgaggatagtaggaccacataggagcatgtaggtcaatttttagcgcaatgtggtgaggctagtagttcggatacatataaattgcgcttattttctttacctttgtccggtactgcttttacatggtttacttctttaccggcaaattctattcatacttgggctcaattagaacaaagattccatgattatttctacactggtgaaactgagcttaggttgtctgatttaacatcggttaggcagaaacatgatgaatctgtcactgattatattgagaggtttagagatgctagaaaccgatgttttagtttgaatataactgacaaggatttggccgacattgcatataatggattgcttgattctattaaagagagattgaatggccagatatttcttgatgttgatcatgtgttgcatgaagctctggctcaagaaagccgagtggatgacaatagcttaaatgctagtttggatgataatgcaataaccaatatagccgaaccaagtgttggatcggattgtgttactagtttaagcaatgatggaatagccgaatcaagtgatggtttggattgtgctagtagtttagacaatgacaccgttgaaaatatagccgaactaagtgacggttcaaattgtattacaagagaaagtgaaatagtattgtcacctaaaaccgagtcacaaatcgatcatgtgaatgttggaaaagatagtgacaatgtcttgcgggatggtaatgaaatagaatccaaaatagctatgtatacatatcaaaggccatatcctgaacacatagattcggtcccatacccgcaaggatttgatgtgcccaacttcacaaaattcacaggtgaggatgctagaacaacaatggagcatatcggccattttgttgatcaatgtggtaaggctggtagtgctgatttgcttaagttaaaattctttcctctttctttgtcaaactttgcatctacatggtttagtttacttgctcctaattcaatttctacatggtcataaatggagcttgagtttcatgattattttaaaaatgcaagcttgatggagcaaagaccgattgatgattcatcggtcacttatgatactattttggttacacctattgctaagaccggaattgttagtaatccccttcctattgctcctattgattttgacaacaagaaagtagtgattcggcctagtcaagccgaatccacaaaagggaaaagtgttattattggggatcctcggtccgagacaattaggattaataatgctaaggccgaagatcataaagttgtaaaggatgagtcatctagttcccagaagactaaaaagccgaagcttacttttgagatgcttatggctaagtacaagaaaggattagccggtcaacgatttgataatcagactagtgattcaaaaagactaagatcatctcgtaggaagagaattggtcaaacgctaaagcaattggagccatcaactataccaacttcatacaaacctccggttgtgatgccatggtatccatatccaatgtcactatatggttatcttttttatgtattacatgccatggatggctcaatcacctatgccatttgatcaagaatggaggggatcacctaagtcaaaatcaagtcattcatttaactctagacaagaccattctcacaaaagaatcgatccgatggatcaaaggtgaaaaatgtgaagaaggtgtgggtgagaaaagaagccaaagcttcggaggtcgttactatcaaggaggagtctcaagatgttcgagtacctactggagatgcggtgaaaactatacaagcggagaagaccgaaggcgacatcgcgactgtcaacaatggtggtctgaccgggacatctagccggtctgaccggcggcttactgccggtccgaccgaacctcctggctggtctaaccgccagtctatggctggtctgaccgggcctagaggtggtatgaccgggggcaccaggggtgagtaggcaatctgagaacagtacaggagcttccacttcgactaaaaatataaagaatcatcatttagctcttggaacacaactacagccaaagtggataccttctggcttatcttctcaatagaagaggttacaacgtcttcgagccataggtcaaaaagaaaaggatgccgaagatgtggagaacaaaacatgtaacaatttagagcctcgaacacctaagcaagtgtggagaccgaaggaggcaaaagataagagactagtgatttcccatagtagtgataaatccaatttgataagagaagaatcatcggccattagagaaaattctcctccacatgatgctatggatgttaatacggtgttcatcttgcctttgaaatcgtgcaatcaagaaagccgattttgctcgggggggggggcaagacattaatatgctcatgaagaaatcaagaaagatgaacggcgatggatacaacatcacatctttgagccgccgttcgttagatgctaaggcaaggtatgtgtttattgtgttcatcattatattatatgcctatgccatgttagaacattgcttgctatctagcacatgtgtttgctcatcaaattgatattacatatacatgttgtaaatgccagttctgagtaatggaattggtaagttagcatataatttgtttgaagtatgatttggctcatgagtctttgatatttgtttaaagccaaatcatatgtgtttttatggatcaccatatgagatatagatttcataattattgcaccatgaaagttttacttcttagtaattcggcttatgtcgatggccaatgtgatgatttgttctaatattacctaaagttatcatgttttagaacagtggccttgttataatattttgcatacatgcttaaaccgattacttacattttattggaatcatgtgtgtgagacataagactttggtaattcattattaatcacacttcaagtggctaagtgttttgatgctttgatgattattgtttcaaaagccacttgaattagtattcatctatacatatcagtcggatgttatagtttttcatatgtctagaaggaaggaattttagtccaataatttgatacactaagcatctggctataatgtgaagaaaggagtatttttgatattagaaaagccggtgcttgattttagatctttggacgaaattggcaaagtcatagaccaggggcggtctgaccagtggtaacctgcggtctgaccggctttgcttggccggtctgatcgggcagatagggcagtctgaccggcattgcgtggccggtctgaccggcttcatacatgaggctggggggcacgttacatctgatttagaggccgaattaattgtaaattcggacatttgtgcccaggagttagaagaaaatatgagaatccctttgatagaatatttgaagtatcctagttttagggttgatcagaaaattcggcggtaagtattcaaatatactttgcttgatagagagttacatcaccgaaatatagatggagtgctattgaagtggttagacaatatgatcaatctaaagttgctaggggagaagtgcatgaagggatttgtggaattcatcaatcggcccgtaagatggattaatttcttaggagagcggggttctattggccgaaagtgattgatgattgtttcaagtactatagaggatgtgaagcttgtcaacggttcaataatgttcaattggcatccaccgctgtattgaatcctatcatcaaaccatggccgttacgaagttgggttttgaatttcattggtcaaatttatccttcatcattaaaagggcataggttcgtgctagttgcaatggattacttcactaagtgggccgaagccgtgccttcaagaatattacttacatggaggtaattgacttttattttgaagcatattgttcatagattcggtattccttaaactttgactacagatcaagaagcttcttttatgtccaaggaggtgagaagttttgtcgaatcttatgatattaagttgttgagttcttctccttattacgctcaggctaatggacaagccgagttgagtaataaaacattattgaaattagtcaaaaaggatattgaagaacaccaaaagaaatggcatgaggtgctttcagaagcattatgggctcatagaatatctaaacatggtgctgctaaagtcactccttttgagttggtttatgcagttgaggtaaatcttggctctcttcggtatatcaagcaagacgacttgtcggttgaagattacaagaccttggtgggaggcaattttgaaaacgtcatcgataagtgtttgaaagattgggtaatattttggaaaagatggagacacttcaagaacaacatttttagagagcaatcaatgagaaatacttgaagaaatacttccctagcgtttggcaagatgcttaggaagtactgtggccggtaattggattatcgccctaagacaacatgttctatgcttttagattcacgatgttcataaaaaggcagggggcatgtgtttacacccaaatttggcacctaggatcgaaataggaaaaattgtcaaagtttggggctctgccggtttcctctagagagggcccggtcagaccgccaccagagggccgttcagaccggcggcatgtggccggaccggcagagtctgaatcagacttcgttttcgtcgggtctcgggttttcttgctcgggaaggcatgtttcgggtttccattggtttctagcctgagttggacgtggaggagggcctgtagagggcaagaccaacctctatttaagggacaaggccggttcacttgtaacccccgaacacacaatatacttgaatcactttttcttttatctttacttttagccatgttttttactttaccctagtttcagtctatctttgtcgatttgcgtcgtaaatcgtctgccgccactgcgagagcgcgacacctctttgtagccaagggggaagtggtgtgacagcaggcatgtcactggcaagatccaccactgtttattcgccgagatccttatcgtctcacactcttgttttctctatcggtctctctcgagtcactctccaagccagcattgttgctcgcacggatccggtgccggtgcccctattgcgcggattcgccgtcggcggcgacaggaggggcggatccggtgacctcttcccctcccgcacggatcccgtcgtctctccgctcccctctcgcacagatctgccgccggcgcctgatcccgttgtccgcccccctctcgcgtggatccaccgtcggcggcgacaggagtggaggatccagcggcgggcgaccttttcccctcccgcacagatccctcgtctctctgccccccgctcgcgcggatccgccgctggcaacgacaagatggatggacctggcagcctcccctatggcgacgatggcaatggttgcacgtgggctgacctagcttcccccatctatggcggtggcggcgaagttgttgacgacggcatcacagttgttgacgacggcatcacatgcgactttctgctcaagctgctccgggcagggagcatggtgggcgccgacgcggctctgctacacgagctggagtccagggctgccgtggtatcctaactcaaagtttccttcttttttagaaaacaatctgggtatttgatgcaagtacagtatgatctaatttggtcagcattgttatataatgagctattctttgtaatgagttacaaagttatagatataatttctttgttaaaaccatagtatattttcatcacatcagataaatcagtgggcttttccattgcatgcaggaactaatgccggcttctttttcatcacatctggtaccgtacataaacattttgaatccttttttcgtttataggcttcacgacgctttttaagtatttcttgtttctttttgtcaggtatctctttgtcgtcttcgtgcactgggatccaagaacagggatgatgatccagatggcgtagcatcaacatctagcttggaagatgaagctgtacataatcattatcaaacaacaaaagcaggatgtatcttcttgaaaacaacggtgagaagcaaaacaaaaattgaataatattttttatttttgatccctcatagagatgatttttgccatgtttaccccactttatttgctgacactattaatatccttctggtaatggttagatttcctgttattcattcaatgttataaaatttgtgacacaagtacaaatgctagacccatcacctaaaagtctttaggtgaaattaaattgcaaaatttagtaccatagcttttcaggtgatataccaatatgacctgttcgattgcagattagagaggatgttagaactgcttgtgtctatgttgaatcattgacaaaggagttagttttcactacaaaggatgtaacgcaactgttggtgaaggtacatgcacctcaatattgtcgtctgaagattcgctgatatgtttctcatatgtttgtgctgttaacccatgcatttggtgatcgcctaaaagaagcaggaaatataaaccacttactttcacaacttgcgtatggttctgtttatacataacactaaagataaatgtttatttaacacataatatgaccatctttgtcctgatatagtctttattgattatctcatagactgttatgcttaagatcagtatttaagtaatgggttgtagtttgtcatgcatgcattgcctatatgactgatttcttttcgtgctctgttttccaacgtggtacaaatcgtggtggagccattcaagtgaatgatctagttatccagtcaagtactattaagcatctatctctatccagtacatatattcacttatcatgtctggaaccgttccactgcaatatggtattcacaattctttatactcttaaagatatccctttatcatccagatctgatgtgtgtgttgccaggtttttaaggagacaagagatgagatttgttgactttgatgggttggacttatggaatcgagatggttgccaaaaaatattcagggtaattttttttgttcaaaataagtttggttgcatggctaaattggaacctaccgtatttgctatgccccctttaatgctttggaatttttaagagctctatactgttgtccgctggttctgcatggaccataggtgtttattttttctattgctgcattaagcagtacttttgcgcactgagttcagagaaagataggggaaatagaaataataaactctgaaactggtttcctttaaagtagaatatttagtcaatattaatgatttgatttttcaaaccatgttggcatatgaatgtgatgaataaccacctacagtagtatatgcagaacaagctactgtaactcaaggcattaagggtattaagtatttccagtggttgattaagaccattaagggtattaagtattgccagtggttgattaagaccattagattgaatatatttatgtatctatcagggatattgtgtgtagtttatgcatgctttcagtttttaaatcagtggttgattaagacggttagattggatacattcctgtctctatcatattattatgttatgatttttttaaaaaaaatattcagggaattactgccaatatcatcttgttaatataattatttaataattatgcaaaataaataagttgtatttcttttctcctggtacatgcatttaataccacagagtttatactatttattgcatatcctgattataattgctcctaaagttacgcaaaaaaacaaatctaattgttaagggttaaagaatcaccttccgtcgtcataaatgcaacaaacgcagatgtatcacgtccaacagaaaattgcttgttttttaaaaaaagaagtttgggcgcatatgagtagcattgagaagattgctcaatatccacaccaaatattgggtgtataaatgagctcttctttgtgttttcagtttctttatataggttgagaagatgtttgtatcctacttggccatgtaattcttattgttagattctgtatgaatgtaattcttgtgttgtaattgtttagctatgtaactgtataagaatctatttgggattcaatcattcaaaaaaaaacagcggtgggaaaaaaccgggcccaccaaaaaaaattgtgacccaaaaccgtgccaaaaacgcacgcgaaaaaaccagttggatggaaaaaccggacaaaaaccgtgtaaaaaaagaatcggacgaaaaaaaccggtcagaaaaaccgcgcgttgaggaaaaaaaccgcgtgcggtaaaaaaaaacgacagacgaaaaaaaaagctaccagaagccttgcgtattttttaagtagatatagatatagatatagatttttaaaataccaacttgatggtgttcttttgggatacggcatgctcgtcggtcatctctgtcccgttccacggttccaccataggatggatagggatggcttcatcgtagaaaaacaattgattccccgcacaccccgaccacaagtccacgcctcaacgaagaaaatctcagatccctgttctcccctccccctcgattagccgaagaaaatcctcgcacaaggaagtctcatggattcagatccagccatggtgctgcttaatcgctccgtgctcttggtcaacgaggtaacagatgtaatgaaggaaaaaggctggtctcttgagctcgacgagaaggcaatttcagacgcatgcgacggtatcacggattggcaggagaaagagaaggcaaggcaaaaggccatacgagcagagatcaagaggtttcgagccaaccaagatgcggcggaggccattttgcgcaagcgcaaggcctccatgccccccagcacggtgaccaagttttgtactgacaccgacctccgtaaggttttggatggcatcgaactagatcctcaagtccatgatataccaggtttgtccttctttcgcctccggctgtcgtctgcacgacatcctcctgatttgcagggcacctccgtcgccggtgcggaccacaacatcctcgtcttctatgtcggcccctaccggcccggtttccctgcaccgggattttatctggtttacgacgcatgggccaactcactgtccgccatccaccagttgccatatttaggcggcggcagtattggctctgaggttgccgtgctgcgccatgctccggccagcgactatatcctcgccgagctcctcctcactggcgaactccccaaggcaagtctctggacgtggtgttcgtctggtccgtccgctcgccaatggatccacaagacagtcatcctccctcctgaagtgtgcacgcccacctacatctttcatgccgataccactttctctcttgggaagtttgcgctctgttgggtagacctcctcgttggcatcttgatgacctgcgatacccttgccccagaacctgttttccagttcatcccgttgccggaggggtgctatatggagccgcccgaccctcaagatggacgccaggtaccacaggaataccggtctatgtgttgcggcaatgacggtatcatcagattcatctccatcgacggctatcatcaagacctctctatcaacgatatgaggaatatgttcctcaggacatggtctcttactcttaaccccaaggagtggaagcaagaagcggcactatgcattggagacctctgatctgacacaacccaccagaagctgccagcactaatgccgacctggcctgtccatagcattcttcatgctgatgttgtcttcttgtacttgtccggccctaatactgggaataatactggggagacagagcggtacatggtcagcatcaacgtgcagcacagggaggctatttcaatctccaagttatctcctgatgatagttcccctcctccacgctactttcccagcagcttcaattcgtacataaacaaggtaactagctcattttgcaagcaagcagcaggaaatataggtagaaatagttcaaaaagtaagcataaaaatgtagaggctaacagagggtgttacgtacaaggaaatcccatataccaagtactttattttattagggcatgaggcattcactactacacgagcacatcagcgcccccatcataaatgccggtttgacaaaatgttaaactggcactgatgatgattttcccgccctaaccctcgaccaaattatcacaaaaaagtacatggaattaggagtgtgtggttcatggattgcaatttcggaatacttcgaccaaattatcacaaaaaagtacagatttacagtgtatcacaaaactacagatttagtaccaaatctatctatttatctattatattattaaaacaactttgaaagaaggcaccacgttcgctgtggaggctagaaattcccacattaatcggaggaaacgaaaaatatctacatcgttagatcacagtaagactatattataacggcggagatcgatcatatataaatagatattagagttgtgaagataatacatctggtccaaacataaatatttgtttcagatatgcaacgggatcaaatttctatttgaaagggattaggagtgttgtgtaaaggtctcgggcagcttgatgtatcggaataaaaaaaggaaaaagagagcgccatctagcgtttcatacaggacaataatttagaaaaaaatagccttatacaactgcacacattggtgcatgcacttcggcagcgatgcgcacatacgagatggcaggttattgcaaagttaacagtccaaaagtacgagttatctgacaaatcaatttcttaggactacatatttctagcatattatattatagagatagctcaaaagtcaactattaccttcacgatcaatcaaggattagaaaatcttatagtaattataaaaaatgattttaaccgttagatcatagcgagtttaaattataacagatcgatgggagttatatagaaaatataaattgtatcagtagagaaaaacaaaagttaaatataataagatatttcacatagaacaaaaccgagtatgactaggacatggacatgacagtaggtagcgaaatcctatatggacacggatcgaattggtgagcatgcagaacatgttttgcagtcctttacagtttcagggtagcatgtagctttaaaacagaaaagcgtagaatcctacatggattaaaatttatagcagcgaagccccttagacggctaagcgagcgaaaaaattacatcaacgcagcctcacacaaccaaacccatgcacaaatcaatatgacacaacttactcgagcattaaggctattaagcagctgtgaaaccttggcttgatgtgtaggtctgggatgccgttgatctgagattaaatacgggagcgattaggctaagcacgtacttgcacatgcattgctctctgtgtttaatcatggtaacaagcaggaaaagaaaaggctaccataaaagaggaagaaatgaatgtccatatacatctatggttcactcttttatttttttttaaaaaaaaagaatctcaacataagcataatttgtcccctgcttctggaagggttgtcccttcgtactaattaatctttgtgaacgcaaatacaactatagatcaactaaggtctacacgatgaagtaacatgcgtagatgtgtgtactatatttacatttaaatgcgacacactactcatcagtgttcatgg

SEQ ID NO: 8733 - DNA, 16024 bp, Oryza sativa
  unsure (1)..(16024): unsure at all n locations
aaaaagcggctaattccgactctgtgtggaggcacttcttgccgaaggactacctctccatcctggctcgtgccgacgatcgtgtgcatttcacttccgagaagaagctcctcgtcagccttgtcaaagaccacgtcctcctcgaccaacacagcaaggtacgtaatagggaaaatatttctatcccttaaaaggacattctttgttttttccgttttacctaaatagctatcaaattttctttaaaaaaattatatgataggtcaatataaaatatgtcattacacggacatgtaatttcaaatttaatatatataagtacaaacaaaaataacaaatttgattgtgaataatgtgtattattcgtagtggaatttattatttccctttctatctataaatgttaaatttgaattgcatgttttttttataacttttatggtgatatgcacaaaagaggatatcccttaagttctagttcgattaattcctcccgcaaaaggattaaggagaatttggagaataattccacgcctattgaggtatgggattaatcctctgtaatccctctctcttgagattaaccgaacaaagtctaaaggatgaaaacccgcttcccacgtactcccttcgtcccgaaaaaaacaaatctaggcctgaatatgacatattatagtacaatgaatctggacagaggtatgtcaagattcgtaatattacgatgtgtcacatctagtactagattggttttctatgagacggagggagcaataacataaagctttagtatgaatttcttcaatatagtattaccaacttttgttatcgtaatgttaactgaatgaaggcgattcattatacattgcacgcagagtctttggttggaaagaacaagcctagccaagtgctacttgctatcatcgagatcattaccgatagcatgggaagaccatcccctgaaatggagatggatctccttacccgattccaggtacgcgttccaacctactgtagcaatgtacaagataaatttaacgttagctcatttgtttgtttcccttttgcaaagataggtatatatatatatatataggtaacatatctcatgcacacaaaccttcacgtgtacatatcatgcacaccaactaacaaatattactaaaaattctataaaaaaattgtacatattgaaatactttcaatagtattatacatacatgtaaagcatcatcttcaaattcattttacatatagagaaaaaaagacaataatgatataaactcgtagttttaaaactgtcagagtttttgttttctaggctaaagtatatggacatttttttctagatttttagtgacgtttgttagttggtatgcacggagtgtgcacatgaaacttgtgtgcatgtgcatgggatatattccctcatatgcaatgcacatcttttagaaatgtttgtcaaagaagtacgtagtctggacgaatatacaaaagcattaagaaataaactacaaagaaattatccatcagataatctttaaattcaatataataataactagtattcggtttgatttgattttctttttatcaatttaagcagaaaccaaagttttctccctgtttcaggtttgaagaagtaactgagcttctaaaggtctgctggctcgatttatgtggcagagtcaactgcagagagctctcacccaacacagaatatgcagcctacctcgtcttcaaattgacagatgattcgtacggccttgattgccagacacaagaggcagacatcaccatggacgatcaagtagtgtctgccaagcggaccatctctttctacccacgcccacgcccacgcccacgcccatccacacgagagacactttctaacatgggtagaatcgaagaagcaggacaagcagaggagccaagctacccaagagaacgaggtgatggctggctggaggtacaactagggcacttctacaacgacctagaagacactggagtggttgttatccgcctcaaggagcatatccagctcaactggaagaaaggacttatcttggagggtatggaaattagacacaacatataagtctttgaggaagatacagaaaaatggagcaagtatgttagaagacaaaattaaataatgcagcattgaatatgcacaaagagcagtcatgattcaaccagtgttcaaaaatcctggctgtaagcaattggttaccgctccaaagccgatgaaccaacattggcatactgaacagaacaatttaaattcaactttggaagtatgccaacttcttatctttcatggttatttgttgttatatttctaaaggaaaatgaaatattcgcattcagttctataattatatcaattgccacacttgtggtggaactattgatatgttgtatgtatacttctgtgatgcatgtctttatggactattgcatcataatcattatgttctatttgtgatgaattcaataatgctatatatgttggatcttgaatttttttcccttttcttatgccaaatttctggcaggttactgtgatttcgaaattcaaaatttcggaccgacattttgtctgataaaaaccagttatctgttttcaggggtaccaatatttaaaagagagttttttttcactaagttttcacttaatcccttctatatccctgacttatgtttcgtcccttgtgtgcctttaagtttcatttcattaccctatgtttatgggtatgtctcggtaattgcacttcatttactgaaattatcatatcagtgaaaacatgtctataattggttaaagcaagtatgcattttgtatatctacaaggtataaaatcctttcctaccagttccatcagaagaaccatgatgaatgtccacaaccacaagcatccattgaccaaaaggtgacactagatttcacagatgcaacattgccaggatgacgctgaccacccctcaaagtaaaaaaatcaacccaatgtaacagcagattatgccaccaggtattattattacatgaaaagaacatgcagacatcttaagttggcagtagtacttgcagccaactgcaatcatcttttcactatttggcctccattcaacagctttaacatcgttttgtcggtcacttgttagaatgtaggattctttaatatttgtttgaaggattctttaatattctttaataatttttctgtttgcaaatgaagacatattattcgtaagagtggcaaataattgagtcactaagatatgataaagaaccaactcacatcgcacgaagggaagagcatttgtttgaaggactcagctatggtggaagctaaacttgttctggggacaatctcagaaggctcagcagcttcagtgatagcaggaggctcgtgggtggcaacaagagcatccgactggaaaggaatcgggctgaagaccatttccctggaaaccccaaattgaagtttcaattagaggcctaataataaaattagtcttgtgaatgaaaaaagaaagacgaaattatgcgaggcggaggaggaagggggaagatgggagtgtactgacgaggacatccccgtaggcatccttggctccatcgtcggacaccgcatccgccgcaactgcaacaaacagacttggaatgagcttggagacagcagagagagggggagcagggagtggagatagcacacctaggtcgcggttgatctcgcagatggtgacggcgccgggcggagggaagctgggcatcgtcgttgtcttgcgtcggcgagcggcggccggtgctccgcgtcgcaggacggcgggttaaacccttgactcccccagagacctgagtgcccgcaggctacagcccaaggcgacttgggccggaagcccacaagcatactgggccgatattgtatgtgatggaattggagttctgggccaaaaataggaaaaagtccacctcgattcccttaattgttcaccgaatctaattcgtgacccttaactagaaaaccgggtaagacgactcccccaattagtaaaaccggtacaaattgactcctaaggcagtattgtgggcggtatccgatgacgtggcaccttgaccgttgtcaacactactgactcaactgagtatggtgagaaatagatagctgacagtgggccatcgtgagctgagtcagattaggaccgacatgtgggctctttttttcattgaccgatggggcgactgcttgggcggcgctggggggcgcgtgcgcgtcggtagcagtggactgcggccgtccctccttctcttctcatcaagatccagtgatagcggcggcggtggagaagaccagcgcgaaggccgggtggagtggtggcggcgacggtggcgcccccctctccctctccttcctgggggccggcgttgcatgcgagaggaagagaggggtcgggcgtggcgatggcggcgacgggcgggggtgtgcgcgctggagcggaggtggtggtgtgaggggccggaacggtggcggagaggcgcggcaccatcgtcacgatccggtgatggcggcgacggtggagaaggccagcgtggaggccaggcggattagtggcaacgtgtcacgcccagaaattcccgaatagaattctaagcagaatgtgcattaaaatccctgtccaggaccggccggggtacataaacaacaatgttgacattcagatccacgtcttacaaacatcataaaagtcttacataaatgcagcggaaaaacgaaagacaacaggagctaagccttgactagaactgcagcgggaacaccactccacaggcatcctcgacggcacggacaaagcctactcctcggagaaacctccatctgacacatactcgtactctggggttgggaaaaatagagcaagactgagtactacccactgtactcagcaagtcataccggaataggggtatgatgcagggaattatcaaaggagagctagagtggttcatttgcataaagcgagcatttataaacagaagtttaaagaagaaaacagtcgtaataattaatcaatattaatcatccactgtccaacgctataccatggtgcgacaggcccaaccatccacctatactatccaatttcaatagactaaactagggtgagactaatcacggtgaatctggttgaccacccataaccgtgggcatggctattcgaatagttttactctgatcagaggtgtacaactgtacccacaagacacagccccacgacacgtttccgtgcgccgacatgccaccacgacataccgaaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataggattttccccattgtgtactagttgaactaagcatggctaagcaactcctagtccaacgtctattcatgttataacccaagctaacaaaggagcaaggtaccaaaatagcatagctgtaacaataggtaaacatcccataataacattataaaacgatgcagtatttgaagaaaaaaagtagagcatttgcaatataggatcaacatgttcaagtgacaagcatgacttgccttgctctgctgctggaggaacctcggcgactatttcgaagtacaccggagcgtcggaagaaccggaatctaagcgacatacaaagcaaacaatgcaaacaggctataatactactgaaacagagaacaaaaccatttttaatggattctacacatttttcttgatttactgagacttgaatgggcttaaacggagctcggatgaattagttatgaattttagaagattcactgtgtttattactataacaaaaagtccttaaataatttattgcgcaataatttctagggctgacgtcatcaagggggggtggcgccgacgggcggggcccactggtcagcggctcaaaggggggagaggggcgccggcaagtggggcccccgggtcagcggcccaaggctgtcggtccaccgtggaccgggaccacgcgggtgatccaccgccggtccacgggactgacggcccagatcggccccgagccgatcgggcggtggcgatagaggtggccgccgggctcggctcggcatcaaagccggccggacggccaaggctagcggcgacgacacgcggccgacggcgacggcgaccggcggcacgggaggcggcggcggcggccgaaggcgacggcgcatgacttgaagcggcggcgcggcactaggagggagagggaggggagtaaaggggagaggacgcctcaccgagggtggtcggtgcggaggaagacgacggcgaacggcgacggcgagccacgggaggacgacggcaactggcggacgggcttcggggtgccctaaggaaggaggagagagagattagagagagggagatgaaccacggcggccggcatccatggccgaaggcggcggtagaggtagaactcaccggagcgcgaggggatgcgaattccggcgacgaatcccgacggggaaggggcggaccccttctagaagtaatctagaagtaagtaataatactactatactccctccattagaaaaaaaaaactcaatccgaccccttctaggatcatgaatttggataaaggtagtccagatttattgtattaggaaagatcaaatcttcttctaggttgatttttcttttttacgaaaggagtatagcactagtgattacattagtttaatcgtcaaattaaacatatggtgatggatttagtatgatgtgtgcgcagattgcagcggcatatggagtgaatgggccatatcacggtgcatcggcgtggcttcctatatggaaagttggggtgggaccctctaaattctccaagagctacctcgccatcgccagtccaacagtcagggaatttacgccaatcccaagcaaagatccacccaacattgacaaccaaattgctctcgaaatcgccgtacatgccagttaccatttctatatatttatttttgtactccctccgtccgaaaaaaaacccaatccgtatgtccagattcaaacccaggattgggttttttttgggacggagggagtatgtgtatgttaccggccagttatcacttttatatgtatgtataccatatgtgtcacgtatataccaacgtatgttacattaatttgtatgcaggtttaccctcaatttgttggtgacgatcttcctcggctctacatatactccactgtaaagtgtctctcctacttcctccgttccacaatataagtcattctagcattttccacattcatattgatgttaatgaatctagattatattgatgttgatgaatctagattcattaacatcaatatgaatgtgggaaatgttagaataacttacattgtgaaacagagggagtaccttgtaacgaattgcatacatactgttttcattagaagtacaaaaattatttggtcacttttatttaatttgaatatatttcacagaaaattgaatgtttgaattaaataccaaaaataaatattcagttgtttcttgacatgtaggcccctatgaatctcctaattcttagtacgataattattattattattattattattattattattattattattattattattattattattattattattattattactactactactactactactactactttcctgtgatgtattaatagaaggatcacataattcttttattcaatattgcacatgatggataatcaactttcaggatcagtaggagtcctctactcctcttacctgcatatatagtggtaagatagttagatagagcactagctagatttaaaacagctagctaattttcttaaaactcatttttttttctttaagaagatgacacaaattaattaggtgcatgctagttaaagttggtgatgtcagctggtatgtacagcacagtctacagtgctctatagctactcactggtgtaattgatgcatgggatatactatatatgcagaacgatggtggcgtgaaattaaagtgcttcaaccttgagtgttctttcgtccagaccagcaaaaagcacgccattggtgctaaatacgacaagttttccacggttggtggaaccacctacttcacccacgccgtaatatatacagggtgcgtacgtcctctgtcctaaaacatactttctttctttaatgtatgacatcattgactttttttatcgtttaattatttattttatttaaaaattatgtaattatcatttattttattataacctgatttatcattaaatgctctttaagcatgacataaatatttttatatttgtacaaaaatttggaataagacaaatggttaaacgttgtttaaaaattcaacagcgtcatacattaaaatacatagggagtatataatattatcttgttgcattgtgtataaacatcactcagctgctagctagttagaaatactttttttaagtatctagaaatatacttatatattaaggatgaagaagagaatggtacgcggcacgtatatatttattgcaatgattatgggatacatatatgtaataaaaggagattgattaattatatactagtaattaatatatccatgctaacgctacgacgatatttgacaatataccttaatgcattttgaataaattttctttataagaaaattatttgtcatattataatgtcctaaataattatatactttgatgcttatctccatatgaaacacatgtgatattatcttgttaaactgtaagtctatatatataatcccaaaaatcacaatttagaaatcacatctcaattttcaaccagcaaacataacaataaattacatgctccacacattttattcaataaaatcaaccatagaaatcacaaatgactaacacttgtgtaggaagacatagagctagcatgagtaatctatgctatatattgggaaagggatagctaggaggcttctcaatccgtatcgcaggaccattaattttgttttatcaacagaacttgttttagtattcagaaattaaattgattaattatatatgagtggattatgcaggatgatgggccggcggtgtggtgggtgtcgctgatggatgagccgatcggctacttccacgagagcgcgttcgcggcggcccttcatcgagagcttccacaacgagatgggagggcatgtgctggacaggaggccgggagggcggcacacgctcaccccgatgggcagcggcatgtacccctccgatggcctccagaacgcagcctgcatccatgcctacctcgccatcgcctacaccggcgccgaccaggtcgacgaccccgtcaacaccatcgtcacccaccccaagtgctacgacgtcaaggacgatggccccgacctctaccgccccggcatcaatgtcgccttcggtggccctggtggatacgactgtgatcacaattagtaataattaattaactacctcatctctctttcattatgtaacatgaatgaataattcatgaatgtggggtagtgtttgaaaaactaatgaaaaatcaagtgttgttttgggaagatgttcattacacagcgacaaaagaagtaaaaaatatacattatttttagagtttttgcagttatatatatgtttatgaaagaattatgaaaatatacacataccgtggtacgaggacgtgtgactaattgtttggcgcagtaggggacaaacggctaggtcaatcttcccaatcggctaccacgtgccacggcgcgggattgtcccaaccatcggtccggcaccttcgcgccacgccaaataattggtcgtacgttcacacgtaacggtacgtgtatatatttttctatttttttcaagagtatgtatataactgaaaaagccaaaaacaatgtataattttaatttcttttctctgacgtacaccaagtaatggtccatagctagcaatagctatgtattgtgcatacatatagacaagtattttttttaaaaaaattaaataactatagtggtatgtgagaaatgaggaatatttcctcgaatgaaacagttttcaacgtttcttatccatcgagagacaaggaagaagtgttgaacccgtggcgtcggctccccgctcccccaactcgcgcggttgctggttgctgccgccatcgcttcctcccattctcttctccacgacggggttaccgagctccggcgaacccgccatggcggactggccgacggcagagccgaggcgaatcagcggcagacaggagaacctccccaatacgctctccttttccagtttccccaactctagctagaagccaatcagaagcgccagccaggggaaagcggggagtcgtcgatccctctcgtcgccgttgctctcgtcggcatcacctgacattattgtgcatgagcattcgacgacctaacacccggtatagtttgcttcctccacctcgagcacaagctgttcgatgaaatgcctaccaaggttaaggttctgtcaccttttttttttgaattcattgaatatagaagggaacaatatttacaagtaaggagtaatgggatttacagaaaagacgatcggaactacggcaacatctctgctagtcgtttggctcccgccaaagcccaagatttcgactcctggttctgtcactttcttgttccaaaactgatgagcatcctgcgttcctttgctattttgcacaaccttgtggaacaataataaaagaaaataattagtcttccatatttggttgtagttctatagatgacaagttaaagttagttcatctttttggtatattacacataagaatccttcgaattcgtttgttgcagattgataagtcgacattgattcacatatccatttttgcatgctgatggtgttttctgtgctctaagtaaggtccggatctgaatataaaactgaatggcatctgtagtgtttggtcaaaggaatgtgtgtgtctttcccctgaggaggcacatattggatgaggtgtttcagcatggtccttgtaattgtagcacacagaggaggtggaaaaagccaattgattcagcaagaactcgtctggagggcagaataagggatcataaactggacaagctgatgattcaactgaagaacctgaggctagctttggatttgcatgagttcatatctcagcagaggaatggctacgcatctctccaactcctctccaggtggagacatgaagtcgggctaaacattgagattggggctttccttaagaaatatccccacatcttcgacatttatgtgcacccaataaagaataaccaatgctgtaaggtcactccaaagatggctgatttgattgcagaagaagatgctgccatctgggaaaatgagcctgctattgttaaacggctgaagaaactcctcatgctgtcgacagatggaactctgaatatgcatgcactgtggctcataagaagagaacttgggttgcccaatgactaaaggtgctctatactaccaaaccatcggtcagagttttctctaggttcccccgatactctgacatttgtcactagggatgaaaatttagctgtagccgatgttgaagaatggagagtgaaggaatatacagaaaaatggttagctgaatctgagaccaaatattcttttcctataaactttccaaccggctttaagattgagaaaggttttagggaaaagcttggtaactggcagaggcttccctacaccaaggcttatgagaataatgaattgcatccaatccataatgtgagcagctcgagaaacatattgttggcattcttcacgaacttttaagcttgacagtggaaaagatgataccacttgagaggttctcccatttcagaagaccttttgatatggaggtaaacctgagggaacttattcttaagcaccctggcattttctacatctcaaccaaaggaagcacacaaactgtcctccttagagagagttacagtaagggatgcttggttgatcctaaccctgtctacaatgtaagaaggaaaatgctagatcttattttgtcaggatgccatgggattgatgaaacggatggtccaattcagttagttgaggagcacaatcaagaaagcagtaatgtgtcatagaatcacatgtggcagacagattccggatgccttgtcggaagctcaaagtgacatttatcaaagaattagctattttaatctctgacattgtttatgggcttatgggagtacaatgttgataatggtatgaacttgagacgtcggtggtggagcatcatcggttgaggaatgtactgatgtgcaagctaagaaagtcagctgtcctgagggcctactctgcacccagggaagaatggatgcatcacggtgcttagcagctaacaaaggaagatgcgcttgagcagaatcagttgtcaaccttggttcctgttcgacagatctactattatttttacggtactccactgatttattttcactgaagagataggtccaatgaagatttaagggcagtcattgatgctttgaactggtctatcataaatgttgaaacagaactcacgagtgttcaactagtgtattgctctcgatcccccttcagagggtaacatttacatatttatactagattacatgcaaaggaaattacaaccctacccctatctctgtagctaccctgaggtggctgacaagtgggcctgccaacggtctgggagtccattcgccggacagggagacaacggcgcccattaaggggggcggtatggcgccatcatgatgctagcctttacccgggtaatagcgggcttcgggtaaagactagcatcggccttcacatcgccagtcgtgccatgacgtcggtggtggttggaggatgagtaatgcgcttttatggcgccccatactcgttcctggtgtcttccctaggctctggcctcggagccatgtcaagagctctggagcccttgagctggctcatgggcctctggggcccccgaaccggcgccggggcctccggtggcccatggctgggctccgggatcctccgggccttccggttagcttcaaacttcccggagccaactgccctcttcgggctcggccggcttcctaggccatcggaatgggtcctccctacggagacgggctccgcagggtgctggcggcgggcctccgggcggaggccctatctcctccggagccaccagggagtgaatggcgcaagatcgcaatccttcccccaacaataaaaacacttatcatttcttaagtggaatttttttaagaacaggagctgtgcatagtgcaagacctgtcaagctaactggaatatagaagagacgacagcagccaacagaggtcagaagctattgcacccaattatcatcatcctcaaatcaattgaaaacttgctgaatgaaaggtgctgttgataaggagtgcaacaatttcttccatacataaatctctatttagctgtgttgtctataaatttgttgaccaatgaataatattttagtaatagttataatgcagttgtttggaatatgatactatgattcttcagaagtgaatcacttttctagcatccatatttctacatgcatccttaccaagagtcacctggactttggacttactttccataacttgcatcacactaagttacagtgtttgttccaagctataatataatcgtagtattgtttgtccccgtatggacggacctggacctggacctgaagcatccacagaagcatagcccaagatgagagatattnnnatagttctctggacagtgatgtggcatcagaagttcagaactctcaagttcatgtccctgttcaacagcgacttccctgactttgatccatctatttccttgaccattccagcaagtcaaatgaagagataagagtcatcctgaagaaacgtcattcggctgtaactatatgcatgagggacctaccgattgatcaattgtttcaagcactgccgaatgtttcttgggcaaatactacggacacttgttttggcaatatattcaaggcaaatgtcatttctcatagaaaagtccaattagaagtgctcctctgcagcataacaatttttaaaaattcaaaatcggcagataagtattccaaaatgtcacaccagttgcactgtgaaattatgactaaagaccagttctttatcatgcaacaaactagtagtcaggctatgctcatccaaactctaaagctcagaccatctctccaaggctgcaacaatggatgctccatttcttactacttcccttgctgttctggccatcctctttttgcttgctctaccatggagtgctgcaactcatgatattctaccactgaaatcctctctatttgttgaagagtatgaaaccaacatcctgcagtcatctgatggcacattctcatgtggcttctacaacatcactaaagcctacaacatcactagcgccttcaccttctcaatttggtactccaattcagctgacaaggccatcgtatggagcgcaaaccgtggccgtcccgtgcactcaaggagatcagagatcactctgcgcaaggatggaaacatagtcctcactgactatgacggcacagtcgtgtggcaaactgacggtaaattccctaatgttcgatatgttcaattattgaacactggtaaccttgtcttgaaaaactccagtgaaaacattgtttggcaaagtttcgattcaccgacagacactttgcttcttactcaacgcattctcgctacaacaaagttagtctctaccactgggttacaggttcctggtcactattccttccgtttcagcgatcagtagatattgtcacttatatatgatgacgctaatgtttccggtgtatactggccagatcctgattacctgtactatgagaataataggaacctttataacagtacaaggataggtagtcttgatgattatggagaatttttttcgagtgatcttgctaagcatcaagcccgtgttgcctctgatagaagtttggggattaaaaggaggcttaccttggattatgatggtaatcttagactctatagcttgaataactcagatggaacatggacaatttcatggattgctcaacctcaaacatgcatgactcatggtttgtgtggtccatatggaatctgccactattcacctacaccaagatgttcatgcccacctggttataagatgaggaatccgggtaactggacacaaggttgcaagcctattgtcgaaattgcatgcgatggtaaacagaatgtaacatttttgcaacttcgaaacactgatttttggggttctgatcaacaacatattgaaaaggtaccctgggaggtgtgttggaacacttgcataagtgattgcacatgtaaggaatttcagtaccaagaaggaaatggtacatgctatccaaaatcttttctctttaatggaaggactttcccgacaccttttgtgcgaacgatgtatatcaaacttccttcaagtttggatgtttctaaaaaacccattccacagtctagtat

SEQ ID NO: 8734 - DNA, 14015 bp, Oryza sativa
tttttaatagatgatagtgttaatttttatacacgtttgactattcattttattcaaaaattttgtgcaaaatgcatgatataaattatactcaaaatactttcagtgataaaataactcacaacaaaacttttttttagataatgaaatataacatcccggtctttgcttaagagagctacaatctattattacaatctagcactccacatcgagtgtagttcaaaaaagaaagcaaacatcacggaaagataaaaatgaaccaataaataataaggtgaatatattattgaagtctatttgtgaatctccactcataattggcaaaaaactgcataaccgtcgactcaagcttgcggcatgcaacttttaggacctctccgtcttcgtcacacctttgtaattgtgcccaacaccagagtcaataaacgataactacgtaaacaatttaaataagacgaattgttaacttgtgtcaaaaatcaacggtatcgtacgtgcattaaaagacagaaaacatgatatttatatgataagctagtttattttagctgatatggacatatatcgaagattatagtttcttcttattgaccttgcgcttagtatttgcaacatcagtcgatgcgtatctggatagggtatgcacgacgtcgcgagacgcgagctagtttgtacgtacgaatttcgattgagggtgggggatagggtatccatcgatcggtggatcgatcagatctttgaccgatgtacgtacgtaggtacgatccaatcatgcaaagctaggtgtgatccgattatgtggccggccatctgtcatttgcattattgtggtcggaggccccagtttattaataaagggatttgcaaatcaattctaatcctagcttagctactaatctgttctcggttagtttctcaattattgtccaagactatacactccctatcttccagcagcgcggaaacgtaagcggtaggcggtacgctaaggtacgaatgtgacttgagcgaattaatatatacaccctttccgtttcatatcacatatttataaaacactttaataaatactccatcagttacatattataaaattttctagcattacctacatcaatataatcttaatatatatatctagattcattaacatatatatatgaatgtgaataatgctagaaaattttataatataaaacagaggaagtatatagtatatttgttttgtgttaaaaatattattatcactactagaaaaacgatttttcatggcgttaccatataattttcgctggcggccatacgcaaaaaccagcagcaaaaatataacgaggggaggggagttacggaccgctagcgaaaaccaattttcattggcggccacgctaaaaggttcgccataaaagaaactctatttttcgttgcggacctcttaagtgtccgccacggaaaatccgattttaggtggcggaccgtgaagagcaccgctacaaaaaaatatgtttcagcgctactaaaaatccaccgcctgcccaacgcatcactattaaaaatcacccacccacccacgtctcctcggtctcctcggctcccccacccacccatgtctccttcctccttcctccaccacccacgtctccttcctccttcctccactccctcctttctccctcctagccttctccctcccacctctccccagcggcggccggttgtggcaaacggagaaaggttgcggccggctgcgccctctcgccagatatgggggcgacggcagtggcggggaaggggcggcggctggctgcggcaaagggcgacggtagcggcggggaagggtcggccggctacggtggcaggcgatgagtccggcgaagagctctccttctccctcccacctctccctagcagcggccggctgcgccctcttgccagatatgggggtggcggcagcggcggggaagggatggcaaccggctgcggtggcgggcgacgagtccggcagcaagctccccttctccctcccacctctccccagcggcggccggctgcgccctcttgccagatctggggcaacagcagcggcggggaaggggcggcggctggctgcggcaaagggcaacgatagcggcggggaagggacgcggccggctgcggtggtgggcgacgggtccggcggtgggctctccttctccctctccctcctccgctgccgctagctgccgtcgccaccaccgccgtgggctgccgctagctaggggacggccgaatccggtcgccgcgatgtcggggaggccggatccgccgccgccgacgacctgggaggccggatccgccgccgcgacgacctgggaggccagatctgccgctgacgccgacgggggcagcgccgcgacgacttcaaattttttttctgatgcttgaatgcttgggtgaatggaaattttttaatgtaaattgttgatgtaattttctgttgatttttgaatgcgtggttaaatttctgtgaaaattttgaatggtggagcattgacggaggcggatagagctccgtccgtcgctttttttaaaaaaaaattggccagcattttcactagcggctggcacagtgaaacccgccagtgaaaaaacattttcgctggcgaccgtcttgtggcgagcttaagacgaccgccagcaaaaataaattattgctggcggtcgataaccgctagcgaagatcttgattttcactggcctttgcttcgtggcggctaggaattccgtcagcgaaaacccaaaatggcggccatgaaaaatagttttcgtattagtgttttattttttacaaatttgattaaattcaaataaatatgaacgaaatgtcttgtaatataaaatggatgaagatttttttttatacagtacaatgatgctttgtgtctgcatggccgtcgacgctcctagctagtttagctgctctggataaagccgatcggctggggttcagccagctaaccaatcaccattagtcgttgatcatgtcataatcgagctacatttctttaatggaaatgccttctgctaaaaaaattcatttaacataatcgagtacgtcttcgtcctactaaacaaattagcatacatgcatgtatatcaattttcaaaatcacacgagttgcatgcacaaacagaatatatatattaggatatcttattattaggtgatctctgtcttgcttaattcccttctgggcagtacagagatgcggatatccattctacagtactacaccggaaaattgacctgcagcaagtacatgcatacgcatgctgatctattctaattaatctatctgtccggccggccggaaagagagagatcatgccgcaaaagtcgtacttactcttttgagtcgctgtttgtaattatttaaaaaaattatgatattattatttatttttttacttgcttcattattaaaaatattttaagtatgatttatttttttatttacactaattttttacataacatggatgatcgaatggtcaaattggtcaaacattttaaggaaaaaaaatcaaaacgacatctaatttagaacggaggtaatacgtttgattttgactgaaactagcttgcaggataaacagagatagtagatacagatttgagcatatataaatcatactgcctagctagccacaaacgtgaatgaacaggtagggagaccgatggaaataatggattatgcatgtgcatagtaataaacgtgagcatgcaatgcaaggtcgtaagtaacctgcaggaggcaacgattaatcattaatcgacaagattggagacgtgaacattgcattgcccccatctccatgatagaactagctactagctagtactccaatataagggcatcctactgctagtctgctagcagcatgcagctgggccatggcgccatgtatcagccatggtcccatggatgcaaacaaaacacagtgcatcgatcgttcggtgtagtcgatcgttcggtgtagtcgatcgtctctgcatttgcatcaatgtacaaaaaaagtgctactgatccgtactttaattttacagttattcaatcaatatttttattactcactccttccaaaaaactgagacctatttcttttttcatcaaaaccaaaaagcaattaactcactcaccatgtggcaaaaccaatgaacattcaaccaataagtactagaatggcttcttgttttctgattaacaatttaatttagcatatagtgactgtaaataggactcagatttttggaaggagtgagtatatatatgattactacatctgtcttatataaatatataattatatattttcctatcattggagtatatcttttcttcttccaagtaggtaaataatcgtttttatctcttaattctcttatgttatgctagtgagtactataaatattataataatatggcaacttttaaactttacaatgcaattacaatgtaaatgtatacgtataatttatagtgtaaaaacaactctctctctctctctctataaagaagatgtgacagaaattgtgatgttataaatatgagactgtctatacatctgttaacagaaaatcccacctctcatctttcaaattctggaccgttgaatatgctttaggattcatgcacagctttaactctaactttttcctcccattcccctcctcttcgcgcattccgccgccgccgctaccctcgcgtgttccatctcgccactgctcgatccaccgccgccagcgccccactgtgccgccgcccgtctcgccgactggccgaagggcgtcaatggcaccggtgaggccacccggccagccccctcccctccccttccccctgtccttcccctccctttccttttctttcctcaagccgatggcggcgctgtcgtcttcctcgtctccgaaggtggggcgccaccactgaccgcctcctatctacctttccgctttgcccccaccgccagcttccgaccccgcagctttagcggcgccgccgccgccttcgccgcccaccgccggactgttgcctcccacgaccatccctctaaagctggcgaactccaccctcttccccctccctctcccacccctcctaccaccaccccaactcgggaccctaacccgtagggtcctctgccggagcctagggtattgccgacgccggagaaaaagaggaggtcgccgaagttggaggagaatgcctggagcacgaatcataaagcttatccagtggtccaaaatctgtaatatttggagaaaaatctgtaagatttggagatgtgttttctatcgagtcgacaaggttagcaattccgtataagggtaagatagttagccagtattttttatttggggcagcccaaactgcctaactagtttaaagccggtaaaggcaaagcctgcttgcagcggtagtccttccgttgtttgatttgggctaggcccattagcccactaaggcccagcccgtgtagctagcggccggctgcatgcattgcatgcttatgctgacgattaccagtccttttttttgggagaaattttcaggacgattagtggagtggagtacggtacgaaccttacctaaatatgtacctaatcccactgcaactactccgtacgtagcaattttaagctgaaacacaatgtggtttaatttgattcgatcgagtcaagcacgtacttacatgtatacttgatgacaacgacgactaatataatcgaaggcaaattgcacagaccaacaatttccttctgtattaaatatttgttagctgctgctacgtataattaaggaggccagacctgcatccaactgcgtagtagtgtctgcatcgtcgatgatcagaggcagagcaaaagcaagataacggcttggtgtaacaaacaaaactgcgaagagatcgagctaaaggcaagaattgtgacgacgacgcaccgcacttgcacggctagaacaaccaaactcatcatccatcattatttcccattcttttaaagttcgtctttccggcgccgtaaccaacacttgatactaaatcccagccgcccatgcttcaatatcgatcgataaatggaagcaagaactactatataagttagccgatcgatcgatagatatatatatagatagagcgcgttttgcacacgcatatatccatcgatcgattgatcatgcgctttagtcgtcacttgtccaactagctagctctacttccatatatcgatcgtccatgatggcggcggcggcggcctgcacgaagctgccgttgctgctcctgctcgtcgccgtcgccgtcgcagcgtcgtcggcgtcgtcactaacgccgcagcacgcggccgtgccggagaagggacctcgccccggcggcggcggcgttaccttgcacctcgaccaccgccaggtaattaactatacgcgtatgtgcttaattatattagcgatctgcagttagtattagctatcgatcagatcatccatgcgtttcgaccgaattacgcgtacgttgtttaattaagctgactgatatatactgcatctgcatgcatgcaggtgatggtggacaatggcatcgtgcaggtgtcgctgtcaaaacctgggggccacatcaccggcgtccgatacaacggcgaacgcaacctgctccgcttcgacggacaacccaactccgcagggtatattacactccatccatctctccatcggtgtaactactatatatagttttcttgctctttaactaattactcagttctttcaatttctcaaaacatacttagtacatacctgcctgtctttttttaatttttttctcaaaaagttcaaattcaacttctacatgttataaaaaaataacaaatataattattatggtacgataactattttcagttaaatttgttgtttctattgcaacttgtaaaagttgaatttagccttacatatttgtgaaattatatatattttatattaatctatgttatcatatttttaatttttttttgtgattatcttagatgacacatgtaaaaaaaaagatgatattcccttgatagatgaaaagccatctttatgttacataccagttacatctaaccatatataattaatttgatcttggtctgtctgcaggtactgggatgtggtatggaatttccccggatccaataatccaagaggcatgatcgatatgtacgtcattacttcttaactttattgtaaattaagtcatttatatatcgcctgctaactatactttgcttggtatatatgcatgcgctttgatctttcctgtgtttaaggtcctcaattcattttttgttctaaactgaaaaggatgcatccatatgctactttaattagagtcatccaaaatcatcatctttgcgtgtgttcttattccacatttgtatatatgatctgactactgttcaatctcaatttatttctaatttataccacttttctacttggaatgtgcaaaataaatgtcagttagaaagttggataaactaatactctcgttctaactgaacaactgaagtaggtacataatctgaaagtcactaccagccagtgagcaggtacttgcctagcttgctgtagttaatagtgttcttgttttattgccttgatctgttacagctcataacataattaacaagatcaacctacccaataaccacaatataacagtactagttcgatttaacaccacttgaacatatagctaccagcctgttaattgtaatcaatattatttcttttgaaccacccatattcatatggattgaagaacttgccttcaggccagataacaaacaagctcttgttgtgagtaaaatatgagcaagcctttgcagttcatcactctgcaccgaaagatgcctcctaatagcaatagtaccaagagcaacctgtaactgtgacttcagttcttttctgataagcaaacggtgttaaacaccgtcagaaattactgcctaataaacagaggatatgtacaagagctcaaatgattttctttctggaaaacataatttcacagtaatgtaaaatagtatgcactgcaccttattacgggctacagctgaacgaattatgcttttctctcaaaaaggatgaactaaatgactgaattttcacaggctggatagtactgaattcaaggtagtatcctcaagtgaagatcaagtggagctttccttcaggagcacctacaatccatcacgtccaaatagtgtcaggctaaacatcgacaagaggtactcctttagaattttcggacctatattaataaatttggctataatttatcctgccatatagtggtagtatacaaatatcactgccattttacgattgctgctctaaaatttgtgcaggcttgtgatgctgaaaggtagctcaggattctactgctatgccatctttgagcatgtcagggactggcctgctctcaacatttcagaggctcgcctcgccttcaaactgaacacggacaagtgagtattccttctcaaaaattgttctctgaagacattcaatatttgcttgatctgcagtctaatcttgaaaacatgtgttcatgaacgttttgtcaggttcaactacatggcgatctcagacgatatacagaggtttatgccgagtgcgacagacagagatgcacctcgcggtgctccattggcatacaaggaggctgtcctgctcgttgatcccaaggaaccacagttcagaggagaggtaattaactaaccgaattctgaaacatcttgcacgccaaattaatcaggctgtcatcttttaatcgactgtttgatgtatgcatctggtgattttctgaatttgtgatgtactaggtggatgacaagtacgagtactcgctggacaacaaggacaacagagttcatggatggattagcagcaatcaccctaaccccatgggattctgggtgatcacccccagcaacgagttcaagagcggcggccctctcaagcgagagctcacctcccatgtcggcccgacctctctgacagtaagatcaatcagttcaccctacaactaattactattcctccccgcaaaaaaaaaaaacaattactattcctaataacgaactctgcacttggaatcttggtacagagagaaaactgaaattttggttcgtgtcagatgtttcttggcacgcattacgtcgggaatgacattgttctgaagattgaggagggggagtactggaagaaggtgatgggcccggtgttcatctacctcaactccaatccgaggagaggagatctgcattcgctttgggtggatgccaagttgcaggcagaagctgaagctaggaaatggccatacagcttccctgtatcccctgacttccacaaggcaagtcagagaggatcagtcaccgggaggctatttgtcagagacaggtaagattcattactttcatagtttcaactccacacaggtacatgatgacttgcatttcatgggtcaagattgttcatggatcatcatctctgaaacgttgataatgtgtttgttttgatgttaattattattttatttcaggtacatgagcagtaaggacatggcagctgggatggcttttgttggcttggccactcctggacaacccggttcttgggtgacagagagcaaaaactaccaattctggacgagggcaacgccctgcggcagcttcagcatcagtaatgtgagagcaggagtgtacaacctctacgcatgggttcctgggtttcttggggactacatgtacacctcgcaagtaacagtaacaccaggttaagttagcactaattcagatggcatttggtattactccctccgttctaaatatttgacgtcgttaactttttaaacatgtttgaccattcgtcttattaaaaaaagtaattattaattattttcctatcatttgatttattgttgaatatactttcatgtatacatatagttttacatattttataaaattttttaataaaacgaattatcaaatatgtgctaaaaagtcaacggtgtcaaacatttagaaacggagggagtatttaacatgataatctggatcagaacaactctgtttaactaccattgtttgtctgaatttaagcaggacgtggcatcaacctcggtgatcttgtgttcgagcctccaagatcaggcccgacactgtgggagatgggtgttcctgacaggagtgcagcagagttcttcatccctgatcccaaccccaaatacctgaacaagatcttcatcaccaaagacaagtacaggcagtacgggttgtgggagaggtacgctgagctataccctgacggcgatctcgtcttcacgatcggcgagagcgacatctccaaggactggttcttcgcacacgtcacaaggtaattaaacaacaacgaacaaaacaatcaatcaatcaatcaatttcctctcgatcgattaacctctgaagaatcatcaagataaccaattgtgttttctttccttgttgtgcagaaagcaaggcgacgggtatgcggcgacgacgaggcagatccggttcaggctggagcgcgtcgtggcggacgccacctacacgctccgcgtcgagctggcggcggcgcagatggcgagggtgcaggtggtggtgaacggccgggcggacgaggcgttgacgacggcggcggcgttcggcgacgggaacgcgatagcgcggcacggggcacacggcgtgcagtggagcttggagttcgcgatcaaggggtacatgctggtggagggagaggaggagaatgtggtgttcatcacgcagacgagggcgttgagccccttcttcggcgtcatgtatgattacatccggttagagggtccttcttcttcgtggcgagatcctatgacgacgcgaggtcgatgaactagctcatacatttgcaaggtaggtagggctagtagctcgagagtatggtcctctttgtttaggcttataagccaacttataagccaaaaagtttaagcctaaacaaacaaacagctttttcgtttggcttttttaaagctataagccactcttacactattaagccaaaagctaggttggagaagcttttttttgcttatataagatagatgtatgacttcaccactaaacttaggacattaaattcactggcttataaatcatataagccaataagctgacttaaaagtctaagccaataagcctaagcctaaacaaagatggcctaaagctgatgcaaaatgactccctcaactatggtggctttttgttgatcaaagaaattaacaaaataaatatagggtccacatgtaagtgactacatctctcctcccttcccactctttttctctcggttccctcgccaaactgtgaaggcagcctgtgtggtggtggcatcttctcaaagatagggaagtgatggggttcggtttggtagttgagctcaaacggtggttaaccaggacaacgacgacatctttggatgtgattgaggagaaggtgatagaggtgccagtgggaactggacaccatactatactcccttgactcgatggccacctccaagcagttgctctgtccccgcgctactccttgtgtcgagttgcaccatcgacatcatggcaaggtgcctcagctccccgagccttaagtccttggcaacatctcgctcgagctcgagccccacgcttgccatcaccacgtcgaactcgagtgactcttcctccgaagtgagccaaccctccttggccctctccgttccaactgccagcatgattcggtggcatgcctctggtgacggttggcgagctagggttggcttccaggtggcggaggttacaccctaggaggcatgctcctagcagtagcataaaacacggggccatgtaccactcggagatgatccatggcggccctcccctatacgcttgtgtactccctccgtcccaaaaaacacaacctaggcaagcatgtgacatcttctaatacaatgaatctggatagccctttgtccagattcgatgtattagaaaatgtcacatcccctcctatgtttagttttttttttgcaacggaggagtacacttgtagtggagtggcggtggcaatctctctctatactcgcagggtgagagagaggagtaggagggagataagaggggaggatcccattttttttccaggagacttacattgggtcctgcctatttttaacattttattttattttattattggaatggtaggtaagtgccacgtcatataaaaactaggccaaagtgactcgtaaactcaacaccacagaggaggaaacctcaccattagcatcgcctagggagttaaattgatctggttttaacgattgagggggtctttatacctgattttaggattgatggacacgacccaaaaccgccctatagttgagggagaaaaatggactttctccaccaaaatatggttagtacacttgcattcgaaatttgaattttaccagcagacctacttatggtatttaattaatcaatcatgaattttacagaatacaaggaagcattattcctcctttccttatttccgtgtagtaatgtaaaaatgatagcaatggattaatacataattatcttatcgatgcaccacaaacacctctatataaagcctccatattatcttgtttgccaacggtatgatcctcgactgtcctgaagatcgactcctagagaatgatgtctcttcttgcattctttgcagcaaagcatattgttggcttcaacgacaactactgttcatggtgtacaaatcgatcccaatgacattatcaagaccatagaggtaagaatttctacattatgttaatcttctttatttaggattggttaggttaccacttcgcagatatctattaactatatatcatagtataaatctgtttaattttaatcacacaagatgaattctcaaatctaatattcctcatcttgatatatattcgatctggttgaattcatgaatttatatatagctgaacaactgaggtcattttggtccaggtagtaatttttccagtgatcattgaccttaccccccaaaaaagtttcatgtgctaattaagtctcactttggtttctaattgacagagcgagtgcggtgatattattgactgcgtggacatatacaagcaaccaagcctcaagaatccattgctcaaagatcataaaatcctggtgctgtacatacgtctgaacattttcattgtcgattactactttctcttcacgttataattataactacaaaatatttaggttctgaatagattcatgtatatgtttcatatatatacccaaatatatatggatgttagcaaatttagacgagagatggaaagatcaaaatcaaaatgttttaaatataaaacatatagaatattataatagttttttaaggaatgcgaccatttatatatgtatgtatgcaattgttagaaagaaagtaatactacctccatattttccatattttaatgtatgacgccgttgacttttttccaacgtttgatcattcatcttatttaaaaaatttatgtaattatcatttattttagtgtgacttgattcatcaccaaatgttctttaaatatgacatgaatattttcatatttgcacaaaaattttgaataaaacgaatggtcaaacgttggtcgaaaagtcaacgacgtcattcattaaaatacggagggagtagtaattaaggagagaattaagatcgaagaactaattgcagtctaagagctactagtactgatgtatgtgatgaatatatattgttcagttgaaaccaagcgtggatcgtcccaagatagttgagaagatgatggtgttgggaagaaacaactcgttcaaattcgcggagcaggcatggcatcgaagcggtaggt

SEQ ID NO: 8735 - DNA, 8757 bp, Oryza sativa
cccctgactggctaacgaaaactgcagtgtcttccctgtagatgggaccttgtctgtccagcaagtcacttgcaacctccatagtcacaggaatacctattgtccaaataatgcaaggaagaagtatctgggtcaagaaacaggtagctaatacatattgtcactgatgttgacatctaaaatttctacataaggagtcaggacaataagttggcataccagttaattcctccacaaaaggtcttgcagccaaggcagcattgtaacttgtaccacagccaatgaaaactaaccttctactgcgcctaatagttttgaggtactccttttcctttaatcctcctaaaagaacaccactatccttcactctacccctcatggttgttgttaatgaatgtggctgttcatggatttccttttgcatgaagtggtcataacttcctttctttatctgctcaacttccatctcaaggacagacaatgctcgttgcacagaagctggcttctctttctcatggtcaaacttaaggatagacacactgccatcctgcaatggccaaattgttaaagcttggacaaggcatcaaatgtaaggctaatgatgtcaaagaaacaaaagaactgttgcactagcgtgttcacatattatttcagtcaataaaaaaccagtgacacaataaaagtacaattgtcaaattggcagaaaaaatggtataaaggaaatagataactttaggtctagaaaagatagattgccccccattaaaaatgatctttctttctaaaaaagaaagtaaaggcaaaatagaacagataaggcaggtgaatcaacagagaaagctgaagagtaccttaatatgaacaatttcatcatcttcgatagccaaataattcttggtatgctccacaatagcaaataaatcactagagaagaataattctttgggcttcccgtttgttgtcagagctttgacatcatgaaatggtttcccactattttggccacttaattcctgaaaatagagacaacagttacaaatataaaaaaaatgtttccaagtcaaagggaagcagaatatttatagtatctataaatatgtgtaaaaaaatgattacacaaaagataacttctaaccaaaccaacatcaccataaaagaaaattatttaatctgcaagcaatctactgcacagtttctcacgtttgcatttttatagaacaaaacatgtggcagttaaccagagcaagtagttcgtagttactctattgagtgtggattttatcgcaggttccactctatgggaagaaaaaaatggtagttcttagcaccttttgacaagccaacatttgtgagaaaatgcacttcatgttttctagtttgacacttttacctaatacatgtttgaagcagatggagataagaacggtgaagagacaacagagttaaagttaacttttgatgttaggtctagtactacataataaagtcaacttgaacagcaaaagatgtagctcaagagcataacacataattcttacacaaaataaaaatcactgttttactatgcttgattagaacctagctgatagtttaagacaaaccaggatgcacttacattgacaccgagtatcagtgtgctgccccgtttgcatgcaatcaattcattggggtagtgtgggcttttaaagataagtgcgtaggctccttcaagctgcctcatgacttccataacaacttggctaaatgtcacatcacctgagaaaataataaaaagttgccttaactagaactagtacagtaagaccaacatatagaatctagttaccgatttcttttccttttgaattttgtaagaattctcctgccttgttaagagtaatgtattgcctaaataaaaatttctgagcgcgaaaagcataataaggtatatttattgcctcatctagttcttaggtggcaaatctagtttccaacatagatcatagtagtataattcttgctccaaagaaatgataatataattataacttgagaatgaaaggtttagctaaagatcagggagtacatcttgtctgttgtcaagaatataaataccttcttcatcatgcgccttatcaaaaacaaactttgccaacttagggatgacttctgtgtcagtatcagactcaaaggtgaacccgtgccggattagtgtctctttcagaacctgagcagatacatcagaaataccaagttatgatggaaatttatctgtttacatcattatcatctcttgctacattaatttgagatggtatcatgaggttacacatgatcatgaaaccaagtttgagatggttggctgattcataaatgtctaataaacttattgtgaattcagtatattgtcatttgccacttctataagataatattctctgcattacaacgacaataatctagcaaaatgagatagaactcactgatattctagttgctagttaatctacagcagttattttattccagtaaaagcatatgagctttcaactaaacggcagattatttaacaacaatagtgaggcgtctatggagattggagacagcccatgtgcagggcttggaagataacatgttggccaatagcataaatccaccatagttgcaataatgcatgtggattccccagctgtaaagatgatgagagaaatactatacaagaattctagtacaatatcagaacttcagaagagcaaggtaaacaagaacctcgtagtttgtgatgatgccattgtggacgaccaagaactcatcgccggcaccagaagattgggggtggctgttccttggggcaggcacaccatgcgtggcccacctggtgtgggcaattccagcatgcacattgaaggcggcgtccaggttcacatccttctcatcaacctctgaaaaatacacaaacatccaacatgacaaaagatagagtacaagagagcaccaaaattgtagccgagactaattgtatacggtataaatcgtcaggaaatccagagagaaaggaaatcagctctccaagtggtaaattgaataaatcaccgaaaatgccataaacccaagaagatttagagttgatccgaatgggtcaaattctaccttttctgaggagatccagaattttgggagctatgctatgccaatcccaaaaatgcaaagtgcgaacagaagaatttccctcgcaaggataactaaacccaaaatcgctaaacgacataatgatattccccaaaatgtgatatggatcccaatcaaaatccaaagcttttaccaagtgatacagccaagtcagaccacatagcacatggaaatcgtgcaaaaatccatcccaagaacccaaaattcaacccatttttcagcataatcaggagggaaaaggcactgaccggagtagacggatcgtacgaggttctcgatcttgccctcctggcggaacaccagcggggacgccccggcataggccggcaccgccgtagaagaagaagaagaagcgcaggagggaacgtcggcgtcgacggcgatgccggaggagtcgtagccgcggtactcgaggcggcggaggccattgaagaggacctcgaggatgtagcggcgctcccgcgacacattgtagttgaggtacgcgaagatcccgcacatcgtgcgccgcgccgcgctgggctgggcttctagaagcttccagaagtttccgggttcgggagagagagagagagggaggacgcggttacgacggcggcgaggagtcgccggccgaggcggaggaagaagaggagaaaaaggccgcgtttttttttttttgataggagaaggccgcgtatttgggtacgcggagtcaaagcccaaattttatactgatcgagtacagcaggacaggctgacgtgtagcctgtgacccagtagccgcacgatttggatcggacggctactgtagcgcacagctcttcgaaaggaaaaatggaaatctaggtgctccttactccctcaagttccatttctgtgcctaacaaactttgatcatatatcttatttaattttatttataattagtacttttattgttataagatgataacacataaatagtactttatgcgaaacttatgtttttaactttttttaaaaatattttaaataagacaaacaattaaagttagacacggaaaatcatggccatcctccttaaaatggaagggagtgagtgagtactcattacgggcggctgtcacttgtcatcacgtcaatgttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttaatacatgtgtagtacgtgttaaaaaaaatgctaatacatgtgtagatttgtcatgcttgtgccacgcgtcgcgtttctgattaatttggacgtcgatttttactcgtagttgcagtagatgacaactgagtgcgtgttttaagccatagtatggatcagatattttttggagagaaatatgcacacgtgttaggattttcagtcgtgttaatttgacactgagagattgtgtttattgctaattggagtgattaaagttgtagattagatggaatggatgcatggagtaacccaagtcagagtagcaaaggtctgggactggtcagcaaagggcagcgtggacgtagctcctctttcttttcttgcttgactcattctccctaaaaatctcctaccatctgcctaccagtttccaagaaacaaacaagtaccccccatgtttctgaaatttgatacttgtctattttgcttatgtcaagtatatagtaatgactaaactacgttctcatgcgataccacgtgattaatcaagtgtataactggtctactatttctttctctaatgggcactacccgagttctaaaaacacacacccaaatgaataatacgataattatcactggatgatgttgcttcagtttccagcctcccgaaaagaagcttccattactccaaagaactgttcactagagtacagataaacagagggaaccatacaaccagtccagagggacccaacgcagtgccaaacgtcaccatttcatgggcaatattgttacaagctctaggacagaacgtacatctctttactacatcaaaacggaaacaaagtccctagcttcacggataacaacagcatttgaaccgtcatctcataaatttgtcatccttaagagcttggaacagttagttgcttagattcggtttctgatataatctgacttgtacaaagcaaatcgccaattaagagctccaataccatagcttctgcttgtaacatatctttgtaaataaattcattgatctttcagctccttgacagcactgcatcttttatcatacacttacatggagttctgccctgcaggggatcacagagcagggcatagtacagtcaagaataatacagggaagcatatactccccttcgtcccaatttaaatgcaaccatgattttctgtgtccaactttgatcatctgtcttatttaaaaacaataaaaaaaacaaaaaaaaaacataagtcacgcataaagtaatattcatgttttataatctcataacaataaaaatactaattataaaaaaacaaatcaaataagacgaacgattaaaattaagcatggaaacttatggttgctcttaaaatggaacggatggagtatttccagcggggatcacggatggacatacatacagtacagcagatatattgggggcgccggccagtcctcagctttgtccacacctgtttctcaacatttttctatgctagttgctcctaacttggcctactgtcctccatctccaacaacacaagagtacaagacaagtactacaacggcaacaactatgcatgacatcaaaacgaaagctgggacctcgtcgatcaaagctaagcacaggcacataacaccctcaatgcaaccagcagcagcgaggaggccatgctgccatgaatcatgatcatggcgtcatcacaggagttcgaggctaatgacccacagcagctgcacgccaagcccaagaggctctaccaagtctggaagggaaacaacgtacctgctctttctttctttctttctttcttgctccagcgatctggctacagcttcttcaacttcatagcagcgaggtagactgattttccttcattttgcagatattcctgtgtggtggacgccttattattggcccggatgcagcctccctgctgctttccatgtttctcatccttggcccggccatcgtcttcagctatcagatggagtccacaatccaccgctctcaacaacggatgcatcgagctgcacagctgatagtcatcatcacaacagcagcggttagtgaatccccaaatcatttataagttgcttcttcacatataattttgattgccaatccgttctctagtgacatataccaaacaattaatccgcatggtagtcacagtgatttcagcttcaatatctgaaactgaaatcagtcaatcaggggttcaagattccacaagtctaatttccactatacaacatgtctagcactgtacagtcatgtgaatttcaccttcaaattgcaggaccttttcttcctcttcatgacatcagccagggacccagggatagtgccaaggaacacaagagcccacctgaagtcgatgaatttcttggctcaaccacaccatcgatggagtggagctcagggagaactccgcggatgaggttccgtaggtcaaaggatgttacagtcaatggcttcacggtgaaggtgaagttttgcgagacctgcctaaggtaccgcccaccacgatcctcacattgctccatctgcaacaactgcgtcgaaaagtttgatcaccactgtccatgggtcggccaatgcattggacttgtaagtaaacaatcaatgatgcagtaatcagtatagtcatcagcctaattcaatgtgcagttccagtactatttgtttccatagtgtttttagaaatatggtagagtataaccactatgcaatgaatttctcttaaaaaaaagctctatgaatgaatgaacttactttcaagtttccataagatgctggtaaatatgccaaaagagttcttcctctccaatggttaatgtccagccaaattccttccagtcatcttcagcatttgactatttataagttattcataaagctacagagcttaacaagacatttacgcttgaatttgtgagttataactttactttttagctaaaaggactcctcaatcatctaagttgaattacaccaggctcaatgtaagctattttttaattacaaaatcatcaagaatgagttgttaactagttccactgtttgactagacgtgcagataaggttaggcacctatgggaacagaacaatgaaattttcagagcaagacctaaactgtacctaacatacattttttaggactaaagcacatatttcgaaaagaatttctcgcaattaatgcagtgaacctaaggtcaaggaataacttatgtgaaagagcaggttaaccaagcactaatgatcatctgaactctatatttcagcaactcacaaatctcttatacagaaatgatgttaaagtattcttaagtgcgtgatcaatcattgcactctcggatggtttccacttgcttatcaaaatcatgccattttctattttttcttgcagaggaactaccgctacttctttctgtttgtagcgacatcgactttcctgtgcatatttgttttcatcttttcatgggtgaatgtctactatgaaaggggatacaatggcggatccatctggaaggctttgcgaaaggaagtatactcatttgtgctaatcatatatacttttatcgttgtatggtttgttggtggtctcacagtatttcatctttatctgatcagtactaatcaggtaaacctactttcttctttagctattctagagactttgctatagttactggttctcttatactgtaattcagtaaatgcattttaatgagtagacagtattaagagtttgagatagttctgataacttcaactagcagctccatacacggtgtttagttgtgtactgaatgtctaactagatccaactgcaaattctgcagacaacatatgaaaacttcagataccactacaacaaggacaacccctaccgaaagagcattgcagcaaactttgtagatgtgttcttcaccaagatccctccaccccagaacaatttccgttcatgggtaggtgagggcgcactggaagctggattttatactccatatattgcgctggatttgactgatccaagggaaaagatt

SEQ ID NO: 8736 - DNA, 14969 bp, Oryza sativa
tcccaacagtgcttcagaacatagactatggttcctttgaagataatccagatgacaagaacaggaatgaagatgatagactagtgccttttgcttcaacttgggcacaacaagcaaatgaaggtgctcgaacatctgaaatagctactgtagaatataaggacgaaataagtgaagatggtggtaaggaaattattagttcaaacacaagttcagaacaaacatcaatagaagctaatgcagcagcatctgaggatgaaagcaatgaggacaatgctggaaaaagtaacagttcagatagaagttctacccaaaatttgggggatgtgaactatagctctgtattactcatctaaattgataatctgttcatatacatggccattatgagttgacattattcttagcattacacatgataaataaaaacagaaaatgaatgactgtatgcctcagcaaaatttttagaatgtattagtttacgtctagaagcccatgttgcactgttcacgctttcctgcactatatgtttctaatttctgtagcatgtgggccgtaatgtggacataaaaagaaaagagttctgttgattgattactaccttaatgatgcaacagttcagattgctctactgcctttatggtactacaaaggtgaagctaacgatgcagatgtggagcaagtcacagaaggggcttgacattcacaaaataatccataaagcaggaccaagataatgtaaattgttaagtaatgattccattgctcattatttggtaaaaaaaaatacagctgcttacagcttacaagctaaactttccagactaactgaaatctggaatttgaaagcaaattactggtcgctaaaaggcagtaccaaagattgcacatttctgcaaaaatgaaattcctcacgcctgatagacatctggaagctgaaggcctacactggcagcagatttgttcaatatcttcttcatctcctctgatcggtccacagctatattatacgagaatagcaggtcctgggcaatcaaacatgatttacagagttaacatggtatacagtgcatgaacaaccaatctaaactaggtgtgatgtactgggaagtgggaattagcaatgaagcaactgcgagtttgtatactaaaacacaccgaaggaagttcaattcatcacgttaatcagagtttgatttggggaaaaaaatagcaaggaacccaatagaaaggggagtttcagtcaaaaaaaaatagaaaggggaaagaagccttctagccatttcatcgaacacatttatctgctaaaacaatgcgcaaaacaggagaagattatacgcatctagaaatggctccaaccttgtggtggtggacgctggcgaggaggtaggcgtaatccccggcgagccgcagccgcgctctggcgtcggcgtccgtgccagtggggcggcggaactcggaggcgacgaactcgcggaagtgcttcttggagtccccccgccgacgtgcttctgcaccgccttgagcacccgccggtagacggccgccgacgtggccaccatcgatctgtccacggatccgccgcgagaggaggcaatcggacgcggagactgcgggtcgccggcctcgccttcttggccgtgtcgatcgaactggaactgtagaggaggaggaggaggaggaataggtaggcgtccccttgccggagattctcctctgcagttgccggagttcgccggagcttctccgccttcttcaggaaggagtaaaggacagagtaaagggactgaagtaaaaaaaattgcaaagaatgaaaagggctattctgcaaatatccatcttcatcctgagcctcaatctgaccgtccatcttcgatctaacgcccaaaacatttgcaaatcagaccatggtttggtttggattggactgctacgagtttgcatataaccaaaaatgcttctcgctcgaacatttcagcataaaataacttttttctttatttgaagatggcttatcaatactttattatatctattataaagctttaagtttttccagggcggatccaggaatgaaaaatagaaggggctcaacatacgggaaaaaccgacataaacatatcatgtctcatacaatattacagtatcaacaggtacccctatatcatggtctgcaatttcgattctaaaaaatttaggaattctgcaacaccatcccccaaggaaactatcacacccaaataaaatcatttttcttgtgaagtttaacaaaatctattcaattttggtaaaaaaaaaattcaaatatcgaaaaactttcttgcctaaaaatttcgaaatttgcagtactaatcttgaattcctagctaatctaagctccctgattcaaatattggccatctttgtttaggcttaaacttattggcttagacttttaagtcagcttattggcttatatgatttataagccagtgaatttaatgtcctaagtttagtggtagagtcatacatctatcttatataagccaaaaaaagcttctccaacttagcttttggcttaatagtgtaagagtggcttataactttaagaaagccaaacgaaaaaactgcttgtttgtttaggcttagactttttggcttataagttgacttataagcctaaacaaagaggaccttaatagtggaagggatcgccaatatatcgggttttacggttatgtgatacaaatcaaatcagatttgcccaataattgagcgagtaaaaacgaactttttcctactttttgcagcacgcctgatgatgcgtttgtgatatcgtgggcctcaaccaggtgccagcactcccgtcctgaggccatcgacgcttcccatataattttggcccggaactccaattccatcacatacaatatcggcccagtatgtttgtgggcttccggcccaaatcgccttgggctgtagcctacgggtactcaggtctctgggggagtcaagggtttaacccgtcctgcgacgcggagcaccggccgccgctcgccgacgcaagacaacgacgatgccgagcttccctccgcccggcaccgtcaccatctgcgagatcaaccgcgacctaggtgtgctatccactccctgctccccctctctctgctgtctccaatccgcttcgcttgctagctgggctgctcattccaagtctgtgcgttgcagttgcggcggatgcgctgtccgacgatggagccaaggatgcctacggggatgtcctcgtcagtacactcccatcttccccccttcctcctccgcctcgcatagtttcgtctttcttctttttcacaacactaattttattaggcctctaattgaaactttaatttgggatttcttctccagggaatggtcttcagcccgattcctttccagccggatgcgattgttgccacccacgagcctcctgctgtcactgaagctgctgagattgtccccagaacaagtttagcttccaccgtagctgagtccttcaaacaaatgctattcccttcttgcgatgtgagttggttctttatcatatcttagtgactcaattgcgaataattaatatatctccatattctgtttatgtcataatatcagttggcatagtatactgttagattgaatttatttatttatttttaatataagggaggaatatgcctctggtcagcgtcatatcatgacaatgttgcatttgtgaaatctggtacctttcctagaggttctagtggccaagggatgcttgtggacattctctattgttcttctgctgaaggtagtagcctagtaggaaaggatcctatggcttacaaaatattgtatactcgcttcaacaaattatagatatcatcgtcgaaaaaagtacagatatatttttcatccatatgatttcactaaaggaggtaaaattactgaaggcgtgcagggtattgaaatgaacactcaaagtcatataatggatgaaacataatttatgtcatactgagtgcatgcactgtatcgaaatgaacactcaaagtcatataagtgaccaaacattaacttatggcatagaagggattaagtgaaaacttagtgaaacataaagaacattctcttttaaatatcggtgtccctggaaacagataagtggtattttcaccagataaaatgtagaccccagaattttgcattccaaaattagttaccagtaatcggtcagaaattttaacatgagaaaagaaaaaagatctgacatataaaatacattaatacatcacaaatagatcataatgattgtagggatataatccatagggacatgcttcacaaaaaaagtatataacatacaatagttccaccacaaatgtggcaattgatttaattctagaactggatgtgagtatttctttttccttcagaaatgtaacaacaaataaacttgaaagagaagatgaagttggcatacttccaaagttgaatttaaattgttccaatcaatttattggtactggttcattggcttaggagcggcaactgatcacttaccgctggctgtatcatgactcctctttgtgcatattcaacactgcattatttaattttgtcttctaattaacatacttgctccatttttcagttcttccttaaggaccaatgctgtgtctaatttccataccctcgaggataagtcctttcttcgagttgagctggacgatctcttgcaggttgataacaaccattccatctccttggtggttgtagaagtgccccagttgtacctccatccagccgtcaccccgttctctcggatagctcactgtctcctctgctcgtcctacttcgcttctacccatgtcaagaggtgtctcttgcgtgcgtgggtgcagagagacggtgcgcttggcagacactacttgatcgtccatggtgatatatgcctcttgtgtccggcagtcaagcccgtatgatttatctgccaatttgaagatgagatagactatgtatcgtgtgttgggtgagagctctctgcagttgatgcggccacgcaaatggaaccagcagacaaatacaagcgcagctactctttcaaacctgaaacaaggagaaactttggtttttgtttaattatcgagaaaaaaaatcaaagcaaatcaaagaatagtatgtatattgaatttaaacactatctgattgagaatgtttattatagtttatttcttaatgattttgtatttctaaaagaagtgtcatgtatatgtgattatgtttgcaaaataagtgcttcagatttatcctccacgtttgggatgcaaacctggaatcgggtaagtagatccatctccagtaccgggcatcatccccccatgctatctctaatgatctggatgatagcaagtagcatttagctccgcttgttctttccaaccaaaaactctggatgcaaatgtgcaaattagtcgcgcgcattcatttacttagcatcaagataacaagaagttagcactaatattgaacaaaataatggattttccctggcaacattgcgtggagctagattgtaatattagactttgatttaatatacaactcgtagctcctcaatacaattgtattttgtatatagtagatttaagaatatagaattgaatttgatttacaactcttagtttctactttcgtaggtacaattatttgtatacaatacaacaaaagtgggattggaactaatatacaactgttgacatttatttatgtgaatacaattattttttctttaaaaacaactatattgatgtaacgacccgcctctcccaggccaggaccgcttacatatgacagctttcataggtcatatactatgaaacgttttatgacctattttaagtgactacatatggcagctttcatgtcctcccagagagacacaagtcttttatgcacactatatatgacagctttcatagtcttttatgcacactacatatggcagctttcataggtcaagtcttttatgcacactatatatggcagctttcatagtcttttatacacactacattatgcacactacatatggcagctttcataggtcacatgtcctcacttgtgcgcacccgggaggtcttttatgcacactacatatggcagttttcataggtcatatactgtcctcatagagacacacaagtcttttatgcacactacatatggcagctttcatgtcctcacatgtcctcacttgtgcgcacccgggaggtcacccatcccctcacttgtgcgcacccgggaggaccctggagttctttggagatcagcttctggaaaagaagttgcaacttgttaatatgagtactctattaagcaacttgttgatatgagtattctattaatcctattaagccctaggctagaatgttctggcagctttcataggtcatagactactctgtgtggtatgttctagcagctttcataggtcatagactgctctgtgtggaaaagaagttgcaacttattgatatgagtattctattaattctattaagccctatgctgggatgttctggcagctttcataggtcatagactgctctgttctggcagctttcataggtcatagactctctgttctggcaactttcataggtcatagactgctctgtgtgaaaaagaagttgcaacttattgatatgagtattctattaatcctattaagccctaggcaaaattgctccaggccaagcacgtttaaccctggagttctttggagatcggcttccagaaaagaagttacaacttattgatatgagtattctattaatcctattaagccctaggctgggatgtcacaattgataattctgcaccatcataatttgaatagatcaaaatctaatggtttaaataattttcttttttcaattaatatggtacggtttctatgccttccgagtgaaactaatgattttctttttcgagctatcttaataatataaccaatgaatgtttttttctcgcaaacttttgtgcggagctagataaaagtaggattagaatttgataaacaattcatatcttatgtttctataaatatatgatttatatatgatactaaaaatagtattagatttcatatacacctttatcttatgtttccgtgcatatagttgtaatttgtataaactattttaaaagtaaaaatagatttaatatataaatcttagcttttgtttcaggtactcatattttgtatacaaatttatcaatcaatctatgcttataaggctataacttatattttgtatacaattgtgttttgtttttctctccgactaatgcgaggtgtgatggttcttttttaaccatcttaactgtatactactccattaggttacaaacgttagacatttagggtgtgtttggttgggtggataagactggatgggagatagccgcttgattttttatggtacatgtggatggggcggtctagaaaagggaatatttcctcaatatgctagatgagtgtatacggcttatttggccggatgaagccatccatgctttcgtatgggtgacgtgtcatattctgattagttgtgcttggtttgatttttttctcctaaaccgtttatctaatttataatttgattacaccattatattagttacaattaaatatttaaaacaagatctcgaatgattatattttgattaaatatatatatatgacaaatgggtcccactaaatttggcttatcccatccatgctctatccctccaactaaacaagaaatttgatcatcctatacatacaaaccaaacaaaaaaaaattagatcgtcatatccaataaaatatggatgaccatatcttatccatgcatgatcatgaaccaaatgcacacttaaggccaagattcggtcatatttttggaacttgaccatcaagtgatttctgaaatggttagtttaaaaacaaataattacggtatgtacttatttgcctcaaagagtagctagaattataaggtttaaaagtttgactaaatcatgtccaaaacaatggggagtattaacagtggtacagctgtggggggtgccggagggggccaacacctcctatccaaacaccaccaccgccaccctcacctgtttttactctatattgaggttaactaagatatgtatttatctagtttatttgtgtagcttgaaattattatcagtttagttagcaagtctaaaaaaacattagcaagaaacatgatctacaaaattagtttgtgatttctcatctttttcaaagtaaaatagaatatacttatttgtgagattattcaatagtttacattaaaaggatttaacaataaaaactagttccaaactttcaatgatattattaaagagctaattaagattcaagtttttttaaaggattagtttacacgcattgattgttattgacagtaactacttgacctcctttgctatcgatattggtaattcagtcttatggcttatccccaccccccacaccccctaatcttaaatcctaggtattatacgtaccttgctgcgttggtcgagaaggacgtggtcctgggcgaggctgaggaagagctccttgttggaagtggtgaaatccacaggatcgtcggctcgagcgaggatggagtggtagtccggcggcaggaagcgctcccacacggcgttggagctcgccgctgcttggaagtcggcggagacggcggagcagcggcaggcgtccgtgggagtggtgaaggagattgcatgagccaggcatgcctctgggaggcgtgagatgctgctgctgctgcagtatcctgcttcttcctccttcttaccaacgctcacatcgtcgtccacttcctcccttcgtgattgcttcatggccagcggcttcaacaactgtcgttggagatatcacaatctagtatactgtatattggactataggtaggcatcaggcatgtctgtacacgatagaacttgtacaatctagtatgtgaacgcatgtcttatcagtaaggaaatttcgttgttatgagtaacaactgatcttttcccacctaatttattattaatcaaccgtacgttacatcatcaacatatacaattgtatatccactcctacccaaattccacggcgcgccatcaggccacggctgccacgcgcttgtgctcgacgcgttgacgaggaggaaaagagctgcaaccatctagccctctcgtggcaggtggatggactcgtgggtccggagccattcagccaacagtttaatcaggcgataggtaagtagtagaatacagcatttaggccagcgttcaggtggttcttccccaaccagacaattcctccaacagatcgacacaagccccggccgccatcgtcaaggccactcgcctgtgctatatttcatatactagaaaaagactgcgttgcaacaggcaatggcggatacataaaatcgattcgttggtgtcataacgtttctattgatgtcatagtatgctaattatgtttagatcatattgttataacatagataagcagttatgctataggttttgccgaaagtcgttggtgtcgtctgacaccagtccgcccctggcaacaggtaagtgttttttaatatacaacaactattaggagctaagcaatatattgaaacattaagatcactatacataagtggagctgcagacccagctagcatagccgatgtctcctcttgctaccaagctagacccacacgtttcattagcgtcttcaacctccggacgacagtcatgtgctactatgatgctgtagcctatcctttgcatcaaatctggccgaatctttctcgatctcccaaatttagttgtggatttttaatccactcaatcttctgtttctatttccccgtaatcgaagcgaatccataaaactgggggataaaaatgacctggggaagcttgtcggccgcattattggtgaccgttaaacgaagattaaatctggtgaattaaagccagatttataaggaaaatcattggagaaataatgagggagttctttctgtttctcaataattgaagcgaatctgcaaaattggggataaaaatgacccggggaagcttgtcggctacatcattggtgaccgttaaacgcagattaaatttgatgaattaaagctgaattaatagggaaaatcatggggaaataatgaggggggagtggggaatcgatttttgcaatcaattggaggaggaaacgtatgaggcaaatcgacgtggcaacggtgctaggatttggccggcagctagaggcgcacgtagcttgcagtggatcggacttattaaagaaaatacaaaatcctcctaaaagaaaaaggtgaaataggtgggagagaaatggaggtccggaagactgaaagggagagaaaaaggaagcagggctgactcagagtcaatgacagacgaaaaaaagctatgaaaatctttcgtatattttaattaggtatagatttgtagagagagaaagatggcggtggcaatgatgcctcgagagcaactacaattttccagagcaatgccaaggagttgcttgctgaactaaaggccaagctcaccatggtgaaggccatatccgaggcggcagacagccggctcatcaccaacaccaaccttctccactggctgatgcgcctacatgcggcggctcaggaagccaaagatgtcctcgacgaattcgaggtcgacggctcaaacatcgcccgcaagcgcaaggccagtgacctcatactgtcatcccgatctctcaagaatctggtcattgctgatgaaagcctgaaaaggttggaacatgtcgtcaagaccctcacatagctctgcgcaacctcagccactttcattgagctcatccaggggcggatctccagtgtaacggccggtgttaggcgaaatcaacaactttcgataaaacatatagttaaactatttatccatttattataacaccatggtttaagtataattagcatactatgacaccagtagatacattataacatcaacgaatcaatcttctagatccgctgaaccagtagagacatgtttcaaggaagaactgaagaacataaagtgctaaggaagaaaaaagctcagaatatatttgcatgtgcaggagatgcatatgccttttttttttccgtgtatgacttctactcggacatctatatgtgcgggttcgatctaatcgatatggtcagactctatccttctatccttgtatgactctatatgcaggagcctatatctattgtttctcctgtttccataaatacaaagttattctgtatcaatctaagaccaataaaatatggatctactataatctaacggtcaatattttttctttttcttcgattaatgtggtaatttataggctccacagtgaacgtggtatcttctttcaaagctgttttaataatataattgatagatagatagatacaaaatcctcctaaaagaaaaaggtgaaacaggtgagagataaatggaggtccggaaggctggaagggagagaaaaaggaagcggggctgactgagagtcaatgacagacgaaaaaaagctatgaaaatctttcgtatcttttaattagggttgtgtttagattgacccaaagtttggaatttggttgaaattggagacgatgtgactggaaagttgtgtgtgtatgaaaggtttgatgtgatagaaagttggaagtttggaaaaaaactttggaactaaacacaatttgcctcgagagagaaagatggcagtggcaatgatgcctcgagagcaactacaatttgccggagcgtgccaaggagttgcttgccgaactagaggccaagctcaccatggtgaaggctatctgaggcggcagacagccggctcatgaaggggcgggcctacaatgattcatgagtattcaaatgaatacccaagaattttaaacaaaaaatacatatatgaagtatatattccatatgtatatatgaaaaagaaaaaaagacctaccattcaaaagaagcccaagctaaaaacgattcatatccctcccatcatctcttcctcccactatttcacgcccattggcccaatagcaaaaaaaaaaaaaaaaaaaaaaagagcccaaacactttctaaccctgtctcctcaccacccatcccaactctccccgtctcctgactcccgatccagccaccaggacagccgagaccgacgcggcgacgcgccggcgccggcgccggtcgccctgtgcgctgcgccccatcgccagctacccgcctggcgcatcccccacgtcgccaccgccgcgtctccaccctccaggctccagccacggagccgctgcgcacggtgcatccggcatcccccgcgtctcgccctctccaagctccagccgccactcgccggcccgccgggacgccgccgcgtgccgcctggcaggctccaccgcaggtggcaggccgctggccgcattgccacaggcgctgtggctgtgcacagtgcgctgagcagctgaccgccccctgcctccctccactcaagtactccactcactaaggtaactcactaactcttcccttcaatcctcgcctagatggctagatggttaggaagtaggaacaatttggattaggaaaacaaccatacaggagattaggatttaattcatagttgaatctagcctgttggatattgttcatggttgaacattttttatttaaaatttgaatccacgaatgatttatggttgaatagagtatactgttgttttgtaggtttgaaacatgaaaaaaaggattggttacattcattaaaagggatttcttcttgcaagttcaggataaagataccatcaatcattttcaaaatatcaagaaatggaaagttcttctctaaattgtaagatttcttatcattttgccattttgtatactctataaatttgatatgttttcgcaattaatagtttagtattatactctaatatgcttaacacattcaatttatgatcaattttatccatccatctatgactttataaaatcatgtttataccgttatatattatacaattattagactctgggttgaacaattttttctatctcttctaatttcgaatacccaagttgaaaatcctgggcccgccgctcatcaccaacaccaaccttctccactggctgatgcgcctgcatgaggcggctcaggaagcgcaaggttgacggctcaaacatcacccgcaagcgcaaggccagcgacctcatactgtcatgatgtcatcccttagatctctcaagaatttggtcattcctgatgaaagcctgacaaggttggaacatgtcgtcaagacccttacacagctctgcgcaacctcagccactttcattgagctcatcaagatggatgattccaaaacaaaccagctgcacaaggcagcagaggccagctctcatctcccggtagatgtccctgtgtttggccgggatgaggtcaaggagttcatcctgaatgtgattattggatcaccgtagcatgatcatccagaatccagcattggaactggtaaagtaagagcagccaggcacaacattcttgttctcccaatagtcggtatgagtggcgtggggaagacaacacttgcccaggtcatctacaatcatgccagagtgaagcaacactttgagcatagagcttgggtctatgtttctgaggatttcaccatcaaaagaactttgcaagaaatcctgcattcgttccaaggacacggtggcgctattttcaatggcgatgaaagcatggaagctaccatcaccaagctccgtatcaagatcagtggaggatgtaaattctttttggtgctagacaacatgtgggaagagatgtgccaggaatggagcgtgctgctcacagcattatccgatgaggcacgtcagcatgggagtgtcctccttgtcacaactcagagctaaagggttgcacaatttgccgccacgatttatcccataaatttaaaagcattgccgtgggagagcttctggcctctctttcagtaccacacatttggtggtgtggaggttccccaacaagatgacaaccgaaacatgctattgatcgcccaagggattgcaaagaagctagatggattaccattagcagcaaaagtaataggaaacctgctgagatgtaggttctcctgggataattggagaagggttgccgagagtgattggtggaacttggaagaagctctccagggtattctgccatacctcagggtcagttatcagcatctgtcaccaaaacaaagacagtgcttagcctattgttcaatatttcccaggaattacctgtttgacaaggacagggtggtccagatgtggcttgcgcacgattttatccagtggaatgagattgctgacgttatgaggccagatgatgttgggaggcagttatttgatgagctcgtggaaaggtccttcttccaacccacatttgttagtaacaagtatgtcatgcctgatttggtccgtggtttagcaattcagtttctctacaccagtgcttcttccatggtgaaagatcaacaggagtatcgtccttagcaccaggaaatattcgccacctggccctgcaggttaatagcctggaacaatgccaggagctgcacaagtacagaaatctgcgtactctcctaatatttggccgttgtgagagtgatgcattttttaaccttcttgatgggatgttggagaagtcaccaagtatccgtgtgctagacttattgatacggggaaagcccgaccttctcgacgtaggatccggatacacccgtgaaacctcacgaactggatgaacaacacgctgcccgtgcaacgcacctttcaccacgaatt

SEQ ID NO: 8737 - DNA, 12225 bp, Oryza sativa
agtatcaccaagctgaccaacctacggcatctgtatgtagatggttcagcattgtccaagattcaaagtattggacagcaaactgaacttcaagagttggagagcttcattgcacgaaagggacaaggattcatgataagagagttaaagaacatgagggagttcacggggaggctgtgcatccgtggtatcgagaatatcagaagtaaggatgaagcgatggaagctagattgatggacaagaaacatgtgggtgccttggtgatcgaagggaaaagagtgcccaagtttgcacttgaaggactgcaaccacacacaaacatacaggaactcaccatcaaattcttccaggaacaagattttcctgattgggtgtgtccagataacttggttaatctcttacaggtaaatcttgaaagctaccacttcttgtctaccattccaccattgggccatctgcctttgctaaagctcctcaccctaagaaagcttccctcagtgaagcatgccaacggcacatcattcggtggtttcccatctcttgaggagttcgagcttcattcaatggagaaatgggaggagtggacagaaccagatgcagcagctcatgcttatgggttgtcgcttttccttggacacctcaggaagctccatcttgcatactgtccatcactgagacgtttcccgcatcttccatgctttatctgcattgaaagagctgaagatctccaagcctggaagctggatcctggcattaccagcatgttctcaagtcttgtcatccctaataaccttggcagtcgagtactgcaaccacaacgttgtaatgtccgcgcaacagttcaagtccctagaaaatattgagcttatcaaaagtgaagggctacgtttggctgatggattccaatactttagcaaactgagaagcgcatgggtggagggttgtcctcaactcctaagtgccatcaccacctctgtctcagtgggctttggtcaagattgttgtgcggcacatgatgagaagcagcagcaggaagctagccttttaacccacctcagagccaatgatagcttgatgtatggtgattacttcaggaccgtgggaaagctcccatcactgcgcaatctgacaatctgcaatgaatcgaatggcactaatttctcggtcaagcaagaactgtggtttcagcaacaaaactcgctagagcacctctgcattgaaggttttcatgcattgcaacgtctcccttcattcttggttaccatgctctccattaagatactagagcttcatggcttgcgtggcttgcagtccataccagacaatgctctgcccctgactctccaagagttcaatataaacaactgtacttcgtgtttgagtactcgggtatctaaagatggtgccgattggccatatgttgctcatgttccatacatccgagttaacggaaccacggtccaaaacttatagacttttgtactgtatatatgaactcctgaaaaatctccgatacaaaaatagaagagaatggcttttggtattcagtaatccagtcaatgaattcttttacctgagccatatgtttccttgagcaggttgagtatatcctcgtagaaatgatatgtatataagcatgcctatgtaactaaagaaggtatagacaaacaaacaaaagttggaacttgatttcgattttcatatatatgatccccttgccacatctgaaagggcatcaatgccatatatgtgtttctgttattgtgtgtgcgcctcccgtgtcagtgcattatttgatttttaattttcagtcaaagcagagatcggtaaacagttctcctcatcattaggcagattcttttggtaaaagccacctacaacttccaacactgaattcattgtgcgagcatggcatctgcgattcctaaattttcactcttccctcgttgtgctcgacagcaagctagcacttgcatttcttcaatggcatcctgacaaaataagacctggcattttccttcttaggttgtagacagggggctcaagcagacatcatactgtgactccccctaagcaggactgtatgtctgcctcctgttgagatgtagaaaatgtagggtgcttaagaacaaattcttgcaggtttacttccaaagcagaaggtattccgaagtgtgacaacctttcaaatggtttcatattttccgttatcaagcacaaattttcatgaagaataccagcacatttctcaagctgctcaacattgcgcattggatgtaaatcatcctactcatagatctggtaaagggaagctctccagctcttaaacttttctcctaaaaccattccaaaaccttaaagccagtaggtaagttcattggaaaattacattttgtttcagatgcagccagccacttaatgtgttactccttcccttccattcttcgacatggtctgctgctatatttccatccctggtgaccaacggttggtactaaagagcaactgtagttgtcgagcagcaattcccttgcgagccacaatgcatgcatactcagagtttcatctgttgacatcatgagaagcttcttcaactctgaacaaatagcaggttcactatccccggtgacagggtctttttctaccatcaaaccagccatcttttagaccttgaaacattcgttcctttcgaaagggtgcatgtaaactttggggtaaagtgccaacctcattgttcaacctgacttcatgccacttccttgagacaaaacggagagacgtgcagcctttcccctgctgaaattaaaaagaaagaaaagaaaccccaatgaggatcgaaaccatcccgtgttcttcataattcttctcctgctacttgtcatacttcctctgatatttgttgattatcttagccgaattcacttgaaaaccctttgcacggaccctatcggctgattggccagctgtatgtaccatattaacaggaaaaggattactatcgaccttcattggcctcttcgaatcatcaaacttgatttttcctccctcaatagccgtttggatctgctgcctgaagaccttgcagtcattagttgtatgagacccagaattatgccacttacaatacctcttcttacccaactcttcagccgatggaattgtatgtccggcaggaagttgaatctgtttttctcgaagtagcaaatcaaatatcttatcagccttggttatgtcaaagtcatacctctcctcttttcctgagttcttcacccattggcacggtataacctgtttgctcctaacccactcggctgcagctatttcggaatcatcatcctcctcatccgacccatacatataaggatagacatgattaatctccctagagttcttcctagcttccgcaaacctttgttcatgcaaagctaccttctgtgtaaggtgcgacaagctttcgaaattttcatatgagaatttttccctgatcggagcaatcatcccttgaaaagccaaatcggataactggcatcagtcaaactcaagctgtaacacttattcctcattttcctgaacctttgaatatactcaccaccggctcatcatgcttttgcttgattgacgtgagatcagacagtttcatctcattaatcccactatagaaataactatgaaactacttttctaaatcggcccaactattaatcgacccatgcggcagagaagaaaaccaagtaaaagccgacccagccaatgacaaccggaataacctaaccctcaaagcatctacaaccgatgcctcaccacactgagctaaaaatcggctaatgtgctcataagtcgatgtagtgtcttgtcctgaaaactttgagaaatctggtgctttgaaccggttaggtaaaggaactctttcaaaccattcaggataaggttgtcggtacaaatttccagtctcttttggtttaagcccaaattgctccctcattacatcagctatcacatcagcccatggtcgctgctgaggtgttccttgaggttgttgtggtgtgggctcaaactggttgtaaaactgaggttgaactgatcctgcctgttggtactgaacttgtggtgatggaggttgatattgataactcaaattgccccctggtaattgtgaaggttcggctgaataccacgcgccaaatgctcaggaataacttgaggtactactgaaccatctggttgcacatgatgaaccaggtgttccgggacaacctgatttgtagtgtactgcacaggctgaccaccaggcattgcaaatccagccgacgcgttcattgaggcttgctgctgaatcggctgaacgacctgctgtctcaacggtgtctgctgaatcggctgtaaagccggtcgtcttggtggcgtctgctgaactggttgcacgacctgctggattggggatgtttgttgaataggctgcacaacctgttgcctgggcggcgtttgctgattcggctgctgctgagccgaattaatagcattctgaggaggtagaaacatagatgcaaccgggtcttgtgttatctgagtcacattcggtccaggatgctgtgattgctctcttaccaatatttgaggattgactaattgacctgaggccgacgacggcactgcaggtgctggagccgatgctggtaccgtcggctgagctgatgatgtaacaggaggaactccctgagtaagtggatgaacatcggtaatcaaagtccgataatttggaaaagtacccccttgcaaataaactgggcctgcagcctgatgttcagctattgaaccatcggctaccgatttcatcatatttgacaaggtattagttaatactccagattgattgatcaaagcattatacacggcatagtcaacccgatcttgaaagttattgaaaaaatcttggaatgcattgtcattctgattaagatttcccctttgcggtccctgagtgccgtcaccttgaactccatgtacttcacgaaagtagtcaccctggttctcctgggtcgacccatctgtaacacctttgtcactcggctgggctgatccatctggaacttgtttcttttctccctctttaaaagagccgatcccaggatcatcaggaaccaccttcaccttgtacttctaaacaaatgtgcccttgcgagtctgcatgaatgaacttaaaaattgatctcgtgcttgttgcatcattgcatcgaagtctttcttctgttcgggagtgagcttctctggatcaatgggcacaacgtttccttcatggacgtcagtcaaaccgagcttctggatcgtttctttaacattactcgggctggccgacgacggcgacaatggtggtttctcagccatgagggaagctgccttctgacttctaatcagtcccaccaggcatgccaaaagcgtgttgacagaaaacacgaggcctgggagatctgcttaactccagtgcaggtccaaaactcgccttcggatgtatgagcgtgccagttgatttgatcatgcaatcaacaagaaacaaagacaaagaaaccgtgattaaatccataaatgatagccgatcggctaaatgccgatgacatatcatttatctttgagccgatgtcatatgtaaatcgatcggcatgtgttaagtaaacaaatcagaattaaatctactcgatcggctgtagatatcaataatatataatccttatatcgatatatacttgaatcaagtgattgggatagatcggtcaccttgccgagacagtataaatcacttagatcgaaatatatattaataatgagattatacatatattcatagcatagccgatcagatagatctagcatgtatcggctaatactccgataccacatcgtgttaagatattaaagcaaatagaatataccaaacataagcctaatatacttaaatgcaacaagatcttaacataaagggtagatctaacatgtcaatcgatcatataggataaaagcaattagatcagataagatcggctgaaactccgatactaccctaatcggcaaccagtaggcaggctagagattgaaattcaactgatacaacattaagtatgaaaagaagaacaatatctagacaatcaagctgctggatgtttcgtagagtggtggatatctcatataatctaagccaacgtcgttatttaacctaatcggttgccttctggtaacagatgttagccgattgtaggttagatgacgatattgtcaaggattatgcaagatataggataacttgacggattacatgaacaagattagagtatcataaagatggaagcactaatctcgagaacacaaaccgtcataacaagttttacctcatgttgaagatcgaaaccgatgcagctcaacccgaaagtaagaactcgtcgaaataaaactaaagcaaaaagggtggtgatgcgccgaaattgttttgaacgtgtgtgttctcaattacatagggctcggggactatttatacccaagaattataaaatatgtccatattggacacgactcttatccctaacaaactgtaagataccataagtctttgcggcagacttttgcccacatttatctctaagtaatttacataaaatatcctaattaatagatacaattgccttcccaggactctatccatgcgtggcaatcatcttgaagcacatcaattcgaacccgatgtcgtacacaagttgtattatcggaatcggctgtatcacttaacctaatctgactcagacttagccgatcccaatcatagtcgatccggactccagccgattcttactctgtttccgcaacaacccttatattcgattccgcttcgatcccatcttcatctccgatgctgatattaccaaatttggtcgttaacagccgcagacgccgccgccgcatctcttgggtgagagccatcgctgcctctctctctctctcgatctcgatctctctctctctccaaaccgccaccacctagctcgttgcccacgccactgccacgccacggtcaaccgccaccattgatgaccgacttcgacgcggccgccaccgccgacgacgctgtcgccactgccactccgccgtccccgcctcgagctcgccacgccgccgcccccacctcgagctcgccacgccgccgcgccacgccgccgcgacgccacgccgtcgggcccccacgccgccgccgcggcacgccgccgccacgcccgcatgccgtcgggccggcccacggcgccccgacgccgctgccgcactgccacgcccctgccgcccgcgcccaacattgccgaacgtgaacgaacgtgattgaaacgtgaccgaacgcgaacgaacgtgaacgaacgcgaacgaacgtgaccgatacgtggacgaccttgaacgaacgtgaacgaaacgttaacgaacacgaacgaacgtgcacgaaacgcgagtggacgtgaacgaaacgttaacgaacgcttaacgaacgtgaacgaaacgttgacgaacgcgaacgaacgtgaacgaaacgttaacgaacgcgaacgaacgtgcatgaaacgcgagtggatgtgaacgaaacgttaacgaacgcttacgaacgtgaatgcacttgtaataaaagtgtgagaacgaacgcgtttagactaatacattttactggtaatacatatatgattatatatgtaacttggcccgtttagactaatacattttcctggtaatgttgcagagaagacgtcgtcgtcgtccctaagccgaagtggtagctagccatcgaaggaattcgcgcaggcaagtgatgtaaagaagtgattgttagagatttaatataagattgttagacttagcatatatgattattacaattttaatataagatttgtagcgatttaatataagtttgttagacttagcatatttgattgttagagatttaatataagattggtagacttagcatatatatatatatatatgattattacaattttaatataagattagtagcgatttaatatgagattagtagagatttaatatatgattattacaattttaatatgagattagtagagatttaatgtaagattagtagcgatttaatataagattgttagacttagcatatatgattattacaattttaatataagattattagagatttaatataagattgttagagttttaatattacggttagcaaatacatcctatagacctaataaatattttttgtatgcacagatggctgatcgcgatgaggaacagatactatacgatacaatcgcagagggaagcagccagtactggaacgaagaagaggggaacgaggatccaaaccagtacttgaacgaggaggggaacgtggagagggatgcggaggggagcgaggaggggaacgatgaggaggctagtggaagtcatccctcctacggacagaagagggcacgcggacaacgaggtgccgcgaagaagatagagggtcggcacatcataactgaggtgaacgaagacggccgacctagtgccccggcagaagcagccaagaattttgtacgccacagcggttgggttgtgagggacaacgtgcctgtcagcacggtgtactggcgcagaacaagggcacgcggggataatgacagctttgtcccggactcagagaaagagatgctgtagaccacaatgctcgagacgttcacgctacccgcgggtacggagaacatagtgaaacagtggactctgaagaaaatggcagacagttccagagcttcaagggagatctctacaagaaatacatcctgaaggggcagacaccgaacttcgacacattcccaaagctaagggatcactgggacgagttcattgcatataagacaggtcaacaagggcaggcgatgatggagagaaacaaagaaaatgctgccaagaagaagtaccatcaccacttggggtcaggcggctatagcgtcgcaatgccaaagtgggaggagatggaggcaagtttgattgagaggggtatcaaaccagccaccgctaaatggccggatcgatcgaagttctggtactatgctcacggtggaacgcttaactcagttgatggctcccttgtcttcagcgatcagatacgcgaggctgccagtcgactaacggacgcagtggtagcctcttctcagggcacatttcgacccgacagagagaaggatgagctgtcactcgccctacagactccagagcatccaggacaaacacgagggaaaggcgtgattcccaggaagattggatttaaggaggacatccacacgtacaggagttggatgaggagcaagagagataccgaggcgaatattgcagatcttgagtacagggtatcgagctacgagctcagcatgcaagaggaggtggcaaggaaggtggatgaacgtatggccgcacatcggtcctaggatccccagccgtacattaatcctgcaatggtcagtccatcaggcaatcgtagcagctgcgcctcaacggggcaggtcggatcacagagcatggacgccatgcaaacccaggacgaaaccacctgcaccgttgatgagatcacatagtggacaccatgtgagctgcatattcccttcaagaacttatcaatcaaggtatgctcgtagtttgatgatttttgacttgtacattccgcaagttgctgcttaggttgattactaatagataacctcttatcacgtgaaggtggcgtcgggaatggccatcccaacggacccttccgggacttaccactgcaggccgattccagcaggatactctagggtcgaagttgagctggtggaagccgcgtacgaggacctcaagttggactacccaggaggagacggtgagacacatctacgagacacaagccacgccattatactatggcgcaagtggtacatcatcctccctgggcgacaagcggcgtctcgtgtaccatctcctccggctccgccgtctcctccgtctcctcctgcaccatctccttcggttcctccgccacgtcctcctgcaccatctcctccggctcctccgccacctcctcctgcaccatctcctccggctcctccgcctcctccacctccacctctaccgtgtccgcctgcacctcccaagacaaggtctcgccaagctccacctcctgcccgcacaagggcaacgaagaaggtgaaagttgacgccaccaaaaataaggagccgccgtacgattgcagtcaagaggagcttgacacttatgtggcaggagaagtgaaaaggcaactcaagcctcggagtcctaaaaagaagatacctattgacctgagcgtgaagaagttcttccagggaatgtccaccgcaaacaaggatgccttaaagctatcggactatgaccgaacacttaggaaagcctattacaagaagtccaaaccagttcctcagcttggagaacagccaaaccaagaggtcaagtcgttggtgaccggcgaagactttggcataacggattttatttcggacaccggtctaacggtggatcagttggttggagccgcaccaatcccgaaggcggaagtggcatacaagtttgaactcggtaaaccgcttgtcaggcctgagcagctgcagtccctaccgacacaaatgtacaaattccatgaacggtacatggaaatgagcgccaatggtagagaggtgttcggagcgaggattagaaactccaacttcttgcaaggagaaaatgttctatggatccatttcaaggatgtcttcgatctgtaccatctggacgccctcgacgtctctcttctgagcgcatggattttgtaagtatctttgagttcgatttgtttcgttcaataattagctcctggcatatatgaaaacaataataatttcctttcatcgttgtagaatggagattcaaagggcccgacggcggggggtttacgatactgggttcatcgaccctcggaaaatcaacaccgaaatgatcgacaattacgagaaagacacagaggacaatctcgtccatctcctaacgcagcagcatttcaagacgttcatactactgccgtacaacacagagtgagtttttattgtcgtttggacaaatttcattcccatccatataacatatacattctgatatttatcttatctcacgcatattccagattccactgggtcctgttatttttcgacttggacgcatgcagagtcactgtgtacgactcaatgaataaagaggagaaggtttttgaccaggtcttccaactgatagacaggtaatataatgccatctattccaaagtggcgggactctgttgctattatgttgatctcgagtaataattaattaatcatagcttgcaactgcacatgtagggcttgggatcggttccgtcaattggtccgcgagacttgaaaagaaaaacttggacggaggtttcattttccagtgagtacatgcatgatccaaaattatattgaattgaatctctaataccagttaatataaagagtatattaaatctctcattttttctcatgtagtgtgcaaagcaggaccagggaactaacttatgcggctactacgtatgcgagtatgcccactgcctatcaaaccaaatatacccacacgagaactcgatgtacgtatacataaaccattcaaaatttcattgcgtatcgatttgttagttgtttattaatttcatatattgatatgtcattatttttcgaatgatagcgtattcacatgagggaaaatctcccacacaaggattttatcacggctgttcaagaacaactgatggggttcatcaacgaagaagtccttaatcccgatggtgaattctactacgacggatcgacaattcataacgtcggtccttcctcttgtgacataacgccggcgtcgaagtcgtagctatagctagcgagcaaatgaattgtactatacatgcatgtatatatatttatatatgtacgtacatttactttagtgttaatatatattttggtaacatatatgcacataaaatgttaagtgctttaaattataaatatgtgtgtaatatatgtatttatacatatacacatatgcacatatatatatacacacacacacacacacacatatatatatatatatatatatatatatatatatatacatatatata

SEQ ID NO: 8738 - DNA, 711 bp, Oryza sativa
atgccacaccagagagcactgaggcgtgcgttgtaatcgtgctcacccaatgtacattttctctttaacttgaattctcccaagcatggagaatgaaaggatatctctgggcagaaactatgaaaatgcaaaatttgaagaagattttccagttcagtcgatcatatcaatatgccatcaagtttattggttgcattacaggaggcaaacttgcatggtcaatttcttgctcgttcttgagaaatcagaaactgccggttgtttcagtggatggtgaatcttaactgttactgtctactataattgccgtttttgtcatgactcattaaccacatggttttaaattcttatctaatcacctcttttctctttcctttgttttaattcttgatttttgtgtagagatatttcttgtatgagaaatagtttcatctttttacctcttttctcattaactttcttgctatattagatttttgcttatgtgatagtggatttaatgttatgaacactagctgagattgagggttggggccttaagcccaagcacaaaatgcattgcatcattttcagttcaccattcgtcactaaactaatccttgtcaggttgtggcatgtcactgtctgcattggcctagatatttcacacgtaggaactatacacatgcgttgttctattgctagtcatgatggcattttttggtcagatta

SEQ ID NO: 8739 - DNA, 5004 bp, Oryza sativa
ggtaagtttccatgttcatagcggtggaacatgacctggaattttccaaggaagcatcttaaaaaaaagcattgccactaatgccctatcgcctaatctcatgcctatgcacgttttataggacttatttagtggtcagctaattacttaacattatctgaaaaataaacttgtcaagttggactactcctaagcaaaatcgaccaaaacaacttccatttgcggatttacatattactcaaaattagactttagtagactactagaagatcgatcttagcatgcgtcagaaagtccttgataattatgaatcggcctgctacctgctaacaaccaagatcatttaccatcaacatcaaccattcatagttgcttcctcagtggtgtgcgatgacttaatagcttgcatcctgtactataccactgctaatccatgcagatgaccaggtcagcagcaaacagaccagccaaagaaagtcagagtcagagagcacaacttgtcattgacaaaccatccatgccatgccagagtggactgttgtgttcttgacaacagcctctaatttatgtccaacaacagatttgaagttgatctttgttgaccagttgcaagatgtatagataatctactagtaatggtggatttgacacatcataagttgatccaaatcacctgctttcactggctagtactagtagagagtttgcaactattggttggtcatcatgcatggcatgagctcacatcattcctaagcaaagtggttttcagtccaatttcaccatcagggaagaagaaattaagatcaccttccaaccatatgcatgctaccagtagcatcaattgctgatctttaggaaaggtttggatcctcttttttcatcttttggaactaggaaagagaagtggcacttggctagcagtggcgtttggttctttgcacaaagagagttcctgtggactgaaatgtcaaacatcaaactaggtatccactttaattagtccaagtagatgaaggggaatggcatgtttttagccaagccagtagtagaatcacatgcttgggttgactggtgccacagctgatcaatacagtttttggctccattacatgcactgtatgtctgtatctggcagaatgaagtggatggtaatctaccacaggttgagagaggttacacggaagatgcacaagcatgcatactactaggtgagatcggacggtggacagtagcgatgactgataggtaattaactggaagcatagggatttttttgcaaaaattacactcctaatctccaatgtgcgggggctaatttgcaaaaggaaccgctgaagtggcatcctaattcttcaaggatcccacgcggtttaaagaagctaatgaaaaatgttttgagccgaagctctattttctatggaccaagcaatgcagtcagatacgtacatgtgctcaaaaccgttggaaggcgtgcaaggttaactagcaggggttggctatcggggtcacgtgggataggttaaactctgtttttaagatgtgacggcctcgtacattcgtttggcacgaggaatgaaatgatcctaatgatcctacttttaaaaagatatcttatatatcagccagataaaaaaatggtttggaatagtccatcaatttaatccgaatcttgagggaatattctcctgagatcatccttcagagatgatagagagaatagtgggttagatttatccgtcagttctaataatattttctatgagataccatcccatcccacttatccttaagccaaatactcgaaaaaatagattctaacctaacccaacctatctcatcccttaaaccaatactttagatctatcaaaatgtgtgactcctactacctccatcccttagtataagggatattcactattttcttgtaacgtttgactactcatcttattcgaaaaaatttgtgcaaatataaaaactaaaaagttgtgctcaaaatactttggataataaagtaagtcacaaataaaataaataataattctaattttctttaaataagacgaatgatcaaacagtgcaaataaaatattaaaatcctttatattagaaaacggatggagtatattttatcaagcctaaaaaaatcaaaggttgtactctaagattggatcgtcgacaaaaggaagatggagtctagcctcgatgtggtttgggaaaccttcggagatatcatctctttggtttttttgtcttttctaaattatttattctatgttttcaaaacatgtgctatcataacactttttactgtaatacgtacgaccatttgtttggattatttattaaaattttaaaaatatttaatttatctctccagtctgtctaataatcaaaatcaaaccagaccagaccgtacttaacggtatcaatatgtaaactagtactatatccgtcctaaaatacttgtcgttttgagtttttctttctaatatttgatcatttgtcttattcaaaaaattatagaattattatttattttgtttgtgatttgctttattattaaaatattttaagtatgacttattttttttataattatactaattttttaaataagatgaatgattaaatattaaaataaaaaaaatcaaaatgtctaataatttgggacggagacactagtattctcgttgttaataaataaaaagaaagacaagttgaccggacgtagaaactgtacagtagaaagaaattccgtactactcctacttcttatccgcgaacaaaaaaaaaaaaacacacgatcagcagcagtgtcagcgcgcattaagcgttaatcccccagctggtcaaaaacccgagcctgctgcgatatggcctaccgccgctgcgccgcacaaccacaacccatacgcaactccacccaaaaaccagcgtcgcatcgcacgcgcaagcgcagcacgagcacagtgaggaggagcttagcttagcctagctagcttagctctaccaaaagctctctgtagcttgcttgctgcccagtattgggaggggccgaagggcaatggtgggaggcagccgtctgttcctcctcctcctcctacctttgctgctgctgctgctgggcgccggctgcagagatggccgccggtgcgccgccgcggccgcgcagactcagaggctgccgcagcaagaaggtgagttgcgtacggcggcggcggcagctagctagctttcctctcagattttgctcttcttcttgttttgttttttggttgttgttgctaatttctttgttaattagaattaattactgtagtaagcatgcgcctaagtgtgttttcgcttagctaagcttgagctttgtcttgagattcttgtggatttttttgctgctcccaatctgtcattgcaaccgcaactacaaatcgatcgatggcctccacacgctggtagttgatttttattttactacttcgtatttacaactagcagcctctaccaatccccggaaacaagaataataaaaaaatgtttgtttattttgatctggagataaactgccaaagatttcccttttctttaccgctgattttggcgtctcaagatcatctgcaaaattcacccagatcgcccggaagggcactcaggcattttttctgctctgccgcatcagatccatcagtgctgctcacttggggggcaatgcctcaagaactcgtacagtcgtacaccgtgcaaaatggcgaaatgccatttttcttcttttcttattgcgcctgtgatcctcgggtgaactgtgttcaggacgcatggagttcgtgccgaattgttgcttctctcaggacgtttctaaaaaattctctcatccagcttaagtgcaaatatatagcattccctgaatcattcagggttgaaatgcaaattggtattcctttaggggcataagagcaaatagcatcgccatttttcgccttttcggttattcccccaccaaaattgtttcctccaagggcccccaagataagggcaagctgtgcgatcttgtcgatggcgaatctgagcaggaagttgttttggcttttgagttttgacttggccgctctcttcgtcttgaagatcccatcttgcgccagagctgcgggttaggcatatgcagtggtgaacagattgatctagtccaatgggtgctgcacgccaactgtttgatgaaattgctgagtacccagggtgcacgccgggcaacttcctaggagtgccaaagttggctcggtgcgctggcaggagacgttggctgctttggcttggctttatgtgcaatacaaaccatggtgacaatgtgttgtatgcatctcatgacattacgacaatatgttgcctggtgattgtattgagttggtaacagcgatggtttcgcaaagccttcctcttgcaaggaatgatgaaccggagaatggcagtgcacaatgctccgcgcttgcaatttttcggaggtttagttgctagagcgcaatgagtcatgggcttgagctgatgggtgagttgtgcaaagccatggcctactgtgcatatatgcgctacaagaaattgggcacttgagggaaagaaatggcatgtttgatagctcaatgactcaaagttaatgtcatggccatggcctatgctggtagctatgtgtggagagaaataatttatgaatgtctcacttcacttgctaacgaggataaatatggagttctgggaggctgctaccatcaaacatgaggcttttgtgccaacattttagtttttttactctctaagcaaatgagaattgcaataccaaacttccttttatccactgcttgataggttctctagctcactcattatgcattgttccgtggctttgtactgtttaagtcacaaattttgacaatttgaccctttctgaaaactaattttacaaatgaaccgcggccaaaacttatttcagaaatgacccttttgttcggcgccaaa

SEQ ID NO: 8740 - DNA, 2352 bp, Oryza sativa
tcagcgccatacgatttagcgttgaacaaaagggtcatttttgaaataagttttggccgcggttcatttgtaaaattagttttcggaaagggtcaaattgtcaaaatttgtgtgtttaagttgtatattgcaacattttgaaattctcatgcgggaacacttgatacttgccttgttggtgctggtgatttctatttgtttcttttgagggaagcaaacaaacaacattgtattgagactgctgagttcttacatgctaacagaaatacaagctaaaatttcaattgccttttcttttgcagttgaagcacttaagggaatagcacgcaagcttaacaagatggattgggacttcagtgtggatccatgcactgggtctaaaacttgggttaatgccagtgattccaatagttacccaaaatctagttatcctaattttccagtcagcaatctgacatgtgattgttcattcaagaacaacacagagtgtcatgttatcagcttgtaaggataatacctattattccacttcttttattgctctagagtggttcttatccagaatagttcaactgtttcagtgtctttcgttgttcactaaaatgttttttttattctttgttcatgcacatggcagggaacttatgcgtcagaatcttagtggagttctacctgaagaagttgtcaacctcacttatttgacaaatctgtaagtgcttccatccagctacttaaatttaagaacattcaccagcattcataaataaaagtctcactttccctgcagtgacttatcacgcaatttcatccaaggaccaattccagcatcatgggctagcctacctgtttttaatctgtatgttttgcatgatcctacatcatatcgtcagaatgcctgtaagtagtcatttgttcaactttctagtgcaatacaggtctctccagggaaatcgcatatctggaacagtacctaaggagcttggacgcatgcccttcttgaaatctatgtgagttgtggttgcacgatgattacaagcacctggagcttgctgggctgaaagtgtatactaaaatatggcaacatatcctatgcatagaagctcttacgtatacacacgtgcacaccaactaacaaatgtcaccaaaaaatataaaaaaaatcatacatgtactttcaatagtattacacataatggtaaaatcttaacctcaaattcattatattttagccgtaacaaaaaagaacatctgacagttttaaggttgtaattctgtcagaattttatcttttttgttactctctattggaagatgtgactttgcgcgtagatgtaatactattggaagtacatgtatgaatttttctagaattttttgtgataatttttagttggtgtacacggtgtgtacacgcgagggcctatgtccataggatatgctcccctaaaatattagaggaactaacttttgaacctcaaccatttgcatgcagaaatctagaaggcaatcagcttgagggtcatattccaccagaattcggtaacatcatcagtttggagagattgtaagttcctgtactgatacctttatataattatttacatcctcattgctaaggaggttcacttgtcttgcgttgttgtttaagacatatacttatgttgttaccgggaatggaaattcaaataaccagacttctttatttaaagttaaatttgcaacgactttgaaaactagcatgaatgtgataagtaaccatacctattagcataatacatcgttgctgttcaattgttcccattacagtttatatactgttaattagaataacacgatgccatgttttgaatgattttttttctccttcagatgctgataacttttatcaattaaagaaacatgaatatgccttgaaaacgaagtttctcattatttttccactaaggctgtctaaagtttcttgaattattactcattttcctcttacagtttcatttctgcaaatgacatcacaggagagttgccttcaaccttttccaggctcacaaatatgacagatttgtatgtcccacccttatttcaagaaaatcttttcttgactaggaagttctaatttttgttgtaatttggaacaatttcagccgaattgacgggaccaatatctcaggaagaatacccagtttcataaaaaattggcaacgggtcaacagaatgttagtttcactctgatgtagaacatttcacgagttgcagttgaaatggatgaaaatgacttttgttcaatgttctaatttcgtttaaatcttctctcttgatttttcagagacatgcagggtaccttgatgagtgggc

SEQ ID NO: 8741 - DNA, 11224 bp, Oryza sativa
  unsure (1)..(11224): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactagattgttttattatgcaaactttcagaccttatttttcagcaaaataagtaatggtaccttattagttagttataccaactgacaatttgcctgcctacgtacattttccaacatccgtctgacggtattttgcgacgcggtgtagaccagttctgaacttctgatggttcatttgaaaagcatgatctttttccaatttcacctaacaatccacaaagtaaactgtgctatcaaacctcttacatattttgtgcattagacaaacacttttgtcctatggtgccctgttgtcaggaaaaaggaatatcaatgctttataaaactaattggaggaacatgatggatattaattttaaacgtatttgttattttctttggcagatcactaatctatatttgtagagcttatatcgttattactttggattatgtcatcgaacatgtcaatcatgggaaaattgtcactgtccacaggtatgaaatagttgaaacttcaagaatagaaaagtaagaacaaatttacgtggtaatttcctcgacaatggaagtccattccattacattagtcaacacatgatctgcctcaaagtcgtatgaaattgataagtctggaaatttcaccttatcctttcgataccaatgatgtatctttgacatttgtgactggtttaggcccagtcactgctcattggtcgttgataagaaaacatcatataaaaacttctaaaatttataaataattagttataagttcaaatgcagtggctctacattcgttagactcataattttatgatcttaattactctgaattaaatgtagaacatatagtactactccctcagtcccattttaagtgcagttatgggtttctgttttcaacgtttgattgttcgtcttatttgaaaaatttatgagaaagttaaaaaaagtcgcagataaagtattattcatgttttatcatctaataacaataagattgctaatcataaaaaaattcaaataagacagacggccaaatattggacacagaaaccaaaaaaatacacttaaaatgagacggatggagtagagttaaaacttctaaaatatagtatagctagtaaatactacaattggtcacataacttgtaaaattcatactagctctaaaaatggaaaactcaacggggttgaatttcatagaacacactctttattgctgtaacccaaatctttatagaacttagatataaactatacttagaattatttaacttaaataaagtataactaacatagagcttggtaaattcataactcacaaatgctaagtgataaaatagaattattgcttaggttagaattgttgcttaggtttgagtgatgtgggaatagttgatcttcaggatggttctactaggggcctacccctagtcggtttgctgtgtgctaaggtagataggcttttcactgaacctttatctagttgtttctaagaccatgtttggaaccagggactagagtttagtccctgtcatatcgaatgtttggacactaattagaagtattaaacgtacactgaactacattggacatatagccgattgctcaaaaccctagcgacatcggctggaattaccccattagcttgtcagccgattggctctttgatctgctatttatatatcttgtcagttacaagatcgtactgactggcacgctagcatatcatctattttaggacctgtattggagttaagcggatctcccaggccttcgtgtttttgtcgacttagttcgcgttaacgcagatttggcactatcgaccgagcgcggatttttttatcaacactaccttgtcatatttggtgattaaagaatggaacggctttgattcaagttactcctgacaagtaatttgttttttttctttttgctgataaggaacgtaactttaatttttttccttaattgattctctcggatcgctcaatgtgtacgacttctcaccatgacattgattgtacatttttctaattctacttgtcataaggcttatgtggagctcatggtagaaaataagaatggcgtacttgtataacatacattgtaaagtcaaaaatcggattcaagaagatagctagttataaaactatgatcaagatatgcatgtgtgtggaaatgtgaaagtgaaatgataacccctttgtatgatcctcctccttgcacttatttagtgaacatggctatttttctcccttttttttttctttttttcatgctcgagaatattttgtctctttttctttgtgagcatttctctttttctcatcaacatttttttttggctcatgtctcattttgtatgaatagttagaggtaggattgtaagcgtatgaagtctttatttggtggatggatgactgatgctgattttcagtgtagaagtatcacatatggtagatgcatgcatgacatatttttgctaacctctagtgtagagggtgagaaaatatagtgggtatcagtgttaaggataaaacactgaatatagtaggtatcttctatagttgggtttgtactatacggaagtaccatatacctaattatacatgggaatgtatcttttgattaagagaatacgataaatccaaaaagaaattgtcttctcgggatagaaagtgtcaggaacccaaccgagaatgctcatgttacattctcaccccaaacgtggagcgttggggaccgcatctagatttgagagatattttgcagtgcgccacctcccaaaggcatagcggtggcgcctacttggcgcgtgtgtgcctccagcgcgcgtttcggacgagaaggtatagttagctaatcaattagttttagataattacaatttgaaataatgacggtagtagttaagattttttttcatgagatttttctaactaacaaattgaaaagaaatctatacctgaagtcaaattttcaaaattttaaatctagatttgaaatttttaactcgaaatttaaattttttaagtcaaattttgaaaactttcaacttttcatcttaaatttgaaaacctttcaactcaacttcgaaaactttcaacccagatttgaaaactttcaaatctagatttgaaaaaattcaagtcaagtcaagatttgaaaactttcaagtcagatttagaaacttttaactacagatttgaaactttcaactcagatttaaaaactttcatctgaaaattcaaaacatttaacttaaatttaaaaactttcatctcaaagttcaaaaattcaactcaaatcttaaaaattttcaactcaaatttgaaactttcaactaaaattgaagatgaaagattcaacttctaaaataaaaaaatcacaaaaaaaatgcaaaaagaaacgaaaaaacacagacggtagcttttccaggaaaaaagttacggacgtagacgctacgcgtgagccttatgggcctaaaaacgcgcgcgcccgaattagctctcgtggcggaagttctgcatcgcggtatttgaacggcggcctgaagccgcgtcctcatgcttcgccgggattgcgtcgcctggtggtattcttgattttctcaagtttggccgtgctatatgtgatgtcaggaaggatgccatcaagctcttgctgttgctcgctgtgttaatttgattctttgggcaagctgagagcctgagaatggacttcaacggttgttcggtggaaaggcatgtgtcaaaacccaaaaccgaatcagggagcttgtcaatagggtggtggacggttccgtggagatatttgaggaattgctcgtgcaggtagagctgcagtgcaatatgcatgcatagctgcacatgacttttttttctttttcttccgcggggaagctgcacatgacacatctggctggtgtgtattttagacaatatggttgtggacgcagtgtgacgtcagcgttcgatttacgtgcaaaactattttaaactgatttttcttctaaattacttatccaaatcctgatctaattgcaccattaatttcattacaattaaacttcaaaacaagaccacacgtggatatattccgacgaaaaaaatagcttattattgaattatttttaaatattgcacgatgttccaccaggtatatcggaattgtttcagtaagtagatcgaaaatgtttcactcgtttaaatcagatgttgtttcaccttatataaaaacaatgtttcagaaaatagcgaaagaatgttttagttcactgcaacattaaatctatacatagtgaaacattgtgagtacactatgtgaaacatttttcggtggaataaaaaataaatcaaattcccttaatagggggtttccaaaatacgtggtttttttttttttgttgcaatggaatgtttcgttcactacaacattagatttatacatagtgaaacattatgagtactctaggtgaaacatttttttgtggaacaaaaaataaaccaaattcccttaataaagagttttcaaaatatgtgggttttttttgcaaaagaatattttaattcactgtagatctataaatagtgaaacattgtaagtatactagttgaaacatcttttgtggaaaaaaaggggagggagaagtaggtgggtccagcagatacgcatgtagggggaggggagcgcccgatccggctccccccgcgccggtcgctcagagtagagcattatcgtatggttgtaagttgagacaatcgtttatttgacaatatttcaaaacctaactagtaatctagactttttttttttttgcttatttgaccctgcttttcacaatgaacacctgtctgactctgctttcattgcaccgttaaagtttcattaaaaaaagaaaaaatatataattacttttcataatgaccaaaataccctcgaaaaacccaatccacatataaccatgtcccttcagatcccctctctctctcttgtatcccgtctctctctcggcgagtggtggtggcgacacactgaggggataaagcggcggtgttggctcgtcgagggagggagcggcgggctatggagggaggggatccgcaccagcaccggctcgcgaagggagggcggcgcggagaagcggcgctggctcgtggaggcaggtagcagcagcgtcggggcgcggagggagagagcgccgccgtagagggaggtgcacgacgcacggaggggataagcggtgatgtgcctgcatgtggagggagggcacgactgtggcgccggtccgtggagtgaggagcggcgatggtgccggcgcggggagggaggcgcgggtggtggtgcgcttgcgtgtggagggaggagggggcagtggcgcgtggagggaggtgcgggcggcggtgtgccggcgcgtggagggaggaggcagcagagcgccatcacgcggagggaggcgctggcagcgttggtgccagtgcacgggggagtggcaactgttgcgtgtggcatcggcgactactgttatggcacttgccgtgaatttgttgtttggttatcatctctgttggatttgactataatttgtgtttctacatcattgtatgcaatttgcacggctgcacaaccaatctttaccactggttggcaaccatctgttgtcccagttatacaaccggaacggtgaattcggaataaatatcgctatctttagtcccggttcaatcgatctttagtcccggttggtgtgatgtggtcccggctagagggttttttccttcttttttttcttctctctctttttcactgttcttttgctatttgcccaaatcatctcagatcaaacattcatcattcacggtaatatagttcatcccaaatcattcacaacaacacatattgaatcacacggtaaggacaaaagaaaaaaaaatccaaaagcagcgccggcctccaccgcctaccgctgcactagccttcgcaccggccgcctcccccttcggatccggcggtggccggctgcctcccctcccagatgcgcagccgcccggccgccgcggtgcgaggccgccgccgccgctgccgcctaggggaggaagagaatgaggagaggaggaggaagaggaagagatggggtgaagaggaggaagagataaggtgagggtggaggagatagaacttattaactgatccgtctcctcctcctcgatctcacgcatgcctcagcctctccgccgcgcatgccaatctttttttccggttggtgtaactaaccgggactagaaatatatctttagtcccggttggtaacaccaaccaggactaaagataatagagaggtctgacattgcatgttgttcttttaaccaggactaaaaatgatctttagtcccggttggtataaaaaagtagctctaatctttcgaaccgagactaaagataatctttaatcccgatttttattgcaactgggactattgtggtttttgctcgaccgagtaaagatggtttctccagtagtgttggatccacaaaataagtcaatatgctgtcaattttttaaaattctgccaaattttatttgccttattttgtcaaaaatccgtcaaatataagtcgaatttgttaaattgattcaaaattttcaaatttataaattgaagccaaatctgtccaaacttatctctaatctggtagatatacagattcgttacaaatatgtcaaaagatccaaatatatgcacgttttgatgtaacagggtcaaataagtagagcaaaaggggccatttgcccctttagttaacaccgttaactcgctttaacggaattgggtaagcattcatcttcaattttgaaaagcatggttaaataagcgaactaaaaaaagtatagtcatattaataagttaagcttcgaaataggataaaatgagcaattgccccttttaagttttgagatgcttttgattcttatagtggactaggacatttcataggcttttagtcaatatgattttaagatggcgtagctgcagatgacattttctacccatgctgattgtttgatggtgccagattcttaggtcttgtttagttgggaaaaaattttagggttagttgtcacatcgaatatacggacacacatttgaagtattaaacttagtctaataacaaaataaattatagattccgccagaaaactacgagacgaatttattaagcctaattaatctatcattagcaaatatttactgtaacaccacattgtcaaatcatggcgcaggcttaaaagattcgtctcgcaatttacacgcatactgtataattggtttttttttcatatttaatactttatacatgtgttaaaatattcgatgtgatgggtgaaaagtttttgttcgggaaactaaacagccccttagtcgaatagtcaatgtattcctgttgaacatgactagattccgtgtatggacttaattacggagatcgtgttgaattaagctggaataggttgactattgtttcgataatgcaaactacattaagaccttatttttccgcaaaatgataagtccttgttagtaaaatcaatggagagaacttccggcggtctgactggacctgtacgggcagtctaaccgggcttagaaaccatgacgtggagcaggaaaccaccgagttgtgcgaatggaagtccattgcattagttaacactctcttaataaattaaatattatgaaaataataatttagaaaaagtggtataaacaatgaaatcaaagaaacatttttgagaaaacatttatttttaaagatatccacaacaataattcgatatataactagctgaatggaaggtgtgctgagcggctcaatagtcaattctcagttgtaccggaacgctttaaactttcgaagaaacttcgtatgtattttaacttgtccacagggcgttgaacagattgggaagatcgcgaagaaaaaacatcacatcatacatggaaggtcgatggcttttgaaaaatttgttcggtgatgacttgacgttttcttagttcgcaccctttatattgaacggaaactagcaggatatgtagaacaacgaagaaagaagattaaggctctgtgtttagctatcggtgaaagcggagagatattcatttctgcccctatttgatcatggcttttagataccgcctgtttcttatattcgtgacggtggagatcgttgtgcttattgtccgaagcacagcatcagattttcggtcaggttcatcaggtgagtacaatatgagtcgcccttcacaccttatatatatactatatattagacggttctgtaaaatcgtcacagtttttttttttttactctgcgctctccagggatagccggatagaactatctgagatgaaatcatctcggacgggttttgttcaaggatattaaacttttgagtaagtactctgcagtgttttcttaataatcgtgtaaaaacaaaaaccatcttgagtactctctatctctctctctctctctgtcgtaaaacaacttactttagagttaaactttgtgttaatagattgatttttatcttcttacctacatccggtgcataaatatctttttttttatctcttcactatctccgtattctagcttgtattttgctttaaatttagaaccgggtattgatggtgccggataacgtattacacataatgtatcctatctaatattatttacttaatttatatctctaatacatactaatattaaatatagagagacaattatagtgttaaaaaatagatacattaatgaaaaaattatacaatattgtatctaaggtcgtaatataatgattaaccaatcttttatcaaatatggatgtacaatatattttcatatatgtttcataatatgagacatacggccagatacaagtttttcggtatccaaactatatttttttatgcgtctagatttgaaattggatagtatcggttatcctgttttctctcctatattcttaccgcaagcctcaagtcgagtgggtggtcaggaaatacctgttccattatcactcataatttagagggaacacatatatttgtaggcttatatggcatgatgccttccgcgttttgatagggaattctaatcgattaatcgtacgtaattttttttaaaaaaagtaaagataaaatgattcttatttaatctcttagcactattactatttgtaagtacttaatcccattccaagcatgctatatattacagatcagtgggaggttggcagagggagttcctgttttcaataatgtatatttttcactgttttcaaacaaacatcagaagttatataaaattagaaagacatatagaatagaagcaccgaagaactgtactgacctttcaaaataagacttcatgtaattttaggtcatttcctttagttcttttccttttttttttcttcaaatgggaggattttattttcagttatagttttttggcaaggattttaagttatttttattttattttggcagtcatgtttagacgcattatcttaaatctgtggtaatgtcttttctctttatactagtgaattaagtcgcaccttggtgcgactatgaccattctaatatgaatggtatgtgaaaagaatattaatgatattatacattagatttgaaatcactgtttattgtcccaactcatagatacttatttcacttctaaagatatttcttttccgtatttatgtttgattttaattgttgtcatataatatttttgtctaataggaatcataagctcaggtggtgtttcagctgaacctagagcttgctttcgtgcaactataatcttcctacctattaagtgttgttaaactagattaataccctgccgtgttgctgcggaaaattaagttgcataatatgtacaaataagatgtaatttgattatcaaaactaaaacaatttgatacaattttgagcctaaaaataattaagattgtatgtttttaagagagaagaaagaagaaacaatttggaccatagatctacaatccaaatgttataaataatttgggtgatatggcttaaagagagaagagagaaatatcattaactatacttagtggggattaactatataagtatatatataagtatatataggataacaattaacaataaatacccatctttcggctaaaacaaaatggtgagcgcatcgtataggcttaggatttatattcatcttctccatgccgtttcctccttccgattccccagacccttagcacctttattgttgccacttgagccgccgccttgccaccctattctctatctcaatgacatgtaggtccacatgtgtctatgacatatgggtccagtggcaaaaagttaattgccacatctaaatgtggcaaatggttaaatattcccttctttgttgcacaaccccttatcttcctattattttctacttatcctcctgcttttcacaaatataattttgttttacatacttaaattaatgttcagagaaagtattggcaaagaagtctaggtgcaacacaaatattttatcttgatctgtaataaacgtgtattgtcataaaaataaataatttactatgattatgctaagcttgtgatattatcgtaagaaccaaaattatagaatttcactattcccttggttcttgggtctatatttaagtaaaattgcacaacatggttgtaattataatcttgtaggctgtgtttgagaagttacttttgttctatatattgttttgaatattgctaactaatttaaacttttatatgtaaaataactttatcccctcaatgaacattatttgatggaataagttcatccaaggtcccttaactggtcgacgaatccgattttcatccttcaaccagaaaaccagatacaacggatccctcaactgtcaaaaccggtgcaatataggtctcatggcgttttggacggcggctttagcttaccgtggcgcctacctggcttaattgaccctgtcttcatctgacgtggcatagatgtggcattga

SEQ ID NO: 8742 - DNA, 7018 bp, Oryza sativa
cgaggtcatccctggctccgccgccaccggccggccgtgtcggaagaagacgaggggagtgaatgacaagtggggcccatgtaggacccaccattttttaattaattcttttggtgtagctgacatgtggggtcactctttttttattaatttccaaatcaaattgccacgtcaatgccacatctatgccacgtcagatgaagaccgggtcaatttagccacgtaggcgccacgtaagctaaaaccgccgtccaaaacgccatgggacctatattgcaccggttttgatagttgagggacccgttgtatctggttttttggttgaaggatgaaaatcggattcgtcgacaagttaagggaccttggatgaacttattacttatttgattggtcatatggtccaaaggaccatttggtctgttcgaccaaaccagcccattaggcctatttgagagactaatgtgaggcaaccacttcatcaaagagtgttctcagccttttcctactcccgtaattttgataaattgaccctttgaaaaagcttattttgatattgagccgtgtcaaaaactaattttaaaaataggctgttttctcgcgccatcgtacttggcgctgagctacaacgtattagcgccactttctttggtgctgagatgcggtccgacgtgtcacgtaaatcacacgtcatgcgatgtcagagccaaagaacctccatggtctagtttgtataaatagtatgcatgtacgttcttaccgtacggtatgtctatcctggtggtgaagggctgcctctcaaaactacaggtcaaggaatcgaaccctgtagcttcttatttttctttttttttccttttaggatctacataattatgtagcaaaatagagggtgaaaaaaaactgaaagatgtaaatttataccaactattaagctataaataccacatacataattttgttccttccatatttaaaaataaaataaatttaaaaaactaagctataaatactgcatacataattttgttccttccatatttaaaaataaaataaatttaaaaaacatccatatttaaaaataaaatgaatttgaaaaacatgtgagatttttaaatagaacagcaaaagatgcttgtacttatatgggaaaactttagtgactgagaatcgaacccattacctcacagtatttagcacccagagttctccaccaagctatcttctctttaagtgcaaaggaagcttgtagatagctaatatttgtaaattgaacagagatcagcgcaaaatactttggcgctgccctcggatgacgtgtaaaatccgcgacacctgtgatgacatctcagcgccaatgatagtggcgccgaaatgttatatctcagcgccaatctctatggcgctgagaaaacagcctatttttgtaattcgtttttggcatgattcaattttgaaataagttttttaaaagggtcaaattgtcaaaattacggtactcattgtatattttaccccttttagaagacgtactcctcattttgatggctagaattcttgtttggtattttgtcattttgtgaatccaactgccattatttgatagatgacatgactcattttggttgcttattgagtttcaattttcacttaggtagatgtgtaaattactttcccaatttaattaatatatatagtccagtactactagtagcctctcctaatgtttttcatcaaaaaatattctaaaaattgaatagttattatatttttaatcatgcttacagccaattctcgattcattttttatacggaattcataacttctgcttctatttatcgctagtcattttcaccgacatgtaaacgattcttgcagggtcaagtccgatatgcaacgcatgtccatgctgcccatgcaaatgctgatcattaccatgtcgtcgttgttctcttcgtaaccgcattgatcaaattcaattgttttgatgttttgtatttcctcatcaggttctattttgtaatataccaattcagaagcacatacatgtagtacaattcaacacatcaatcaatggcttaccatcagctgataacaaccaaaaccgtacccttttttttctcttttttttaaaatttttttaggctcttcaagttatcccttctttctataaagttaaggccaaaagctcaaaccttgtgctttcacgtcatcatcaaattgtgaaccgttggatgaatgtattagattgcttctcagacgttggatggaatgcagtatagagcccaacccatcagtcaccgagtgagtctcttcgcctcctcaatgtcaaatatagcccacatgaacacatcggcctatctccacacacatctacatgtatccagtccgtcaatccgtataaaagagttttatggctgaacgctccttcagttgatatgtgctacctaaattatctataaatttttgatagggctgctaaaaaaaattctccaagaaatctatttgtttcttctatttcttcttgagattatatctcttatctaacaaattgatattaaccaagtcccgcagcaacgcgcgggggcatcctctagtaagtttaagagtaggatctattttgattctctaggtagtcccactaaaaaatgattttcctgtacagggactcatttagattgcagacggatcataattggtcgcgtctgtaaaatcgtcctccatttttgtgtgcgactccttaagaggatcacacggaaaaatcgatttttgcatgcagatctattaaatggaccgcacgtgaaaatgagcatatttttcacaggcggacctattaagaagtccgcacgtaaaaatgcccctccctcttttccctcttacccatttcaaattttcccctatttctctcctctcctctctatctctttctcttctctcctctcctctcctccctctcgacggcgacagcggcggtgggcgtaggcgatgacgacggcgcgcggcggcctcctccacgctctaccgtgcacagcgggcccctctagcggtggagacgctggatctggcaggcggcggtcaacccctgtatggattctggctcccctcccctccccttccttccctctccgcccagatctggcagaggggagtggcgtcactggcggtgtcgctaaaaattttaaatctaaaataggaaatataggagtaaaatttagaaataatagaaattcataattaaaaaaacaaagaatgttggaaaaaggagtctaaagtccatatacaaacataattttaaaataacaaaagtttagtattagaaaataattaagaactactccctcggtcccaaaatgtaagcatttttagctatgaatagctaaaaattgatatattttggaacggaggtagtatcacgtatatacaacacaatatgaatattacacatggatagtttggtcaagttagtacaaaatttaaatatgttgttattttaagaaattctaataataaaataagaaaatatatatgttattatatgagagaaaggataagaatactagccgcgtaatttacggggccctatactaatctatctatctattatattattaaaacagccttgaaacgaggcaccacgttcgctgtggaggttagaaattcccacattaatcggagaaaaagaaaagaagagttcaagtaggaatacaatctaaaaatagctaaaattcagaattaaaaatatgcaacattaaaataggagtccatataggaacccaatacgtgattaattaaaattcagaataaaaattaaataaattttgaaattagaaaaagaaaaggaagagttcgagtaggaatataattttaaaataactgaaatttggaattgaaaaataaggaatattgaaataagagtccatacaacaatccaatacgacattagttaaagtttggaataaaaatataaaaaaaattgaaattaaataaaagaaaagaaaataagagttcaagtaagaatacaatttaaaattaatttaaattcgaaattaaatataagcaaaattgaaataagagcacatataagaatccaatagtagattaattaaaattcagaataaaaaataaaataaaatccgaaattaggaaaattaaaaagagagttaaagtaggaatacaattttaaaacaactgaaattaaaaataaaatatcaaaatatcaaaagaacacattacaaaaaataaaataaattctgaaattagaaaaagaaaaataatatatcaactaggaatacaatttataaataactaaaattgttgataaaaaattaagactattgatagaaaacaccatctaaaacacatgacgagattaattaagtaataagcctagagaggagcagagttgtggcggttgataatcaaatagaatcctaatgacaattaaaaggaaggacgatgggtaggtcgtgaagcaatcggtcaaggcggttggcggggacttttagaaagtaaaaaaataaatcccaatgataatcatatttgatttttaaaatctcaattacaataaaaatgagagacagggggcagatcgtataggagtataattgcagagcagccaatgattggtgggtcttctagaaagtaaaaaatgaattctaacgatagttatgtttgatttttacaatcccaatgataatatatagtatgcggcggacgagtcatagaaaagtatagtggcagcgtttgacgggatttctaaaaattataaaaaacatgaaacccaacaagacaataaactctaaaaactataaggttcaatttttaaaggttcaggcttccaaaaaataaaaaaataaaccccaataataatcatgtttgattttaaaatttcgatgacaataaagaagggcggcagcgggcaggccatagagaagtacagtgacaaagtcgctaacgttttggcggaacttctagaaagtaaaaaaaatgaaccaaaatgataattatgttcgatttttaaaatagcaatgacaataaaaaaaaaatcatttggacggtggaaaagaatataatgcaacatttgaacggacttaatgaaattataaaaaaaaagcttaacttgaacaataaactcaactataaatttttggaatcattttttaaaaggtcccaaggaaattaataaaaataatggtaaaataacctttgaccggacttattgaaattaattaaataaagccccacttgaccattaacctcaactattagtttagatccattttttaaaggttccaaggagaatgaatagaaatagtggtagatcgagcaagctaataaagaataatatgacagaagtaaggggtagcaactatgtgacatttaaaaactataaaattagaaacacgaggatgattaggtttggtctttcaaaatcttaagacaacaagataactagttaataaattttaagtaaaatcatattaaaaagtatataattttatatgggtgctagccgcgtaattacgcggctttgaatggaggcaccacgtttactgtgggggctagaaattcccacattaatcggaaaaaaagaaaaggagagtccaagtaaaaatacaatttaaaaataactgaaattcagaatgaaatataagcactattcaaagaagagtccatataagaacccaatacgagattaatcaaaattcagaataaaaataaaataaaataaaatgaaccaaaacggtaattatgttcgatttttaaaatagcaatgacaataatgagaagatgcattggatggtcgtagagaagtataatggcagcgtctgacgggacttatggaaattataaaaaagaagcccaactggacaataaactcaaactataagtttttatatccattttttaaaggttccaaggagaatgaatagaaatagtagtatatcgagcaagctaataaataataatatgacagaagtaaggggtagcaactatgtgacaattaaaaactataaaattagaaacatgaggatgattatgtttggtcttttaaaatcctaagacaatgagataactatttaataagttttaagtaaaatcatattaaataaatatataattttatatgggtgctagccgcgcaattgcgcggctttgaaaggaggcaccacgtttactagggggctagaaattcccacattaatcggagaaaaagaaaaggagagtccaagtagaaatacaatttaaaaataactaaattttggaattaaatataagcattgttgaatgaagagtccatataagaacacaatacgagattaatcaaaattcggaataaaaaaaataaaatctgaaattagaaaaggaaaagaagagtccaagtaggaatacaatttaaaaataactgaaattcgaattaaaactaaggaatgagacaagagtccatataagaacccaatacgagattaattaaaattcagaataaaaaaataaaacaatatccaaaatttgaaaaaataaaagagagttcaagtaggaatacaattttgaaacaactgaaattcaaaaataaaaaataaaaatattgaaagaacactgtacggtattaattaaaatttgaaaaaaaatttctgaaattagaaaaagaaaaaaaagatttcaattaggaatacaatttgtaaataactaaaattggtgataaaaataaagactattgaaagaaaagaccatctaaaacacatgacgagataaattgagtaacatgtgtataaaggggtagagtggtggtggttgatatgacatataaaatttgttaataaacaccaaatagaatcctaataacgattaaaaggaaggacgacaggcaggccgtgaagcaaacgtgcaaggcgattgctgggacttctagaaagtaaaaaaaataaaccccattgataatcatattcgatttttaaaatctcaatgacaataaaaggagaaggagcgggcggggtgtataggattatagttgaagagctg

SEQ ID NO: 8743 - DNA, 4149 bp, Oryza sativa
  unsure (1)..(4149): unsure at all n locations
ctaaacttgagatggatacttatatgtacggttaattattctatagtagaagccacaacaagatactcatcatgacttcatcggtcagaagatatagacgtgggtagggctgaaaaaactcgattagctacctcggtggctcggttcaaaattgctcgccatgatttgatctttttcttttaaaaaaatattcaattgtaaacgaaagttatttgcgctttggcttggctccttacttcattaacaagaataggcacaattgatagataaaaatataataaactagaaaaaaatgcccgtgtgttgcaatgggtgaagtctattttaatcttgttatatggtttagttaagatgaaattcactgtgggagtttgcttggatatatatatttttagaaaatcatgagctgtagttaggagtccgatcgtctcaagttagcatacgagtttttttaaaacatatttcttgtatgattccttctgtattaccaaaagtgaacgatcttaaaaaccgactcaaacacaaatgactaaccgcgaaaacatcttcaatttttataatcgactcaaacacggatgacggaccgcggatagaaacatctttaattattataatagtaatagatatatagatatagatatagatatagatatagatattgattataggaaaataactttgaagaatgctagataaaaagttgaccaaaagcttcttttgcaccggaagtgcgggtgtatgctttcatacaagtgagtgtatatcagtcggtactatgtttcgaaaaaaaaaaacaaagacacgagggtagcatgcatgcatccacggtgtgtactatattaagatgaattgtgcgcataattaagcacgtacgcgtacgtccacacataataagcattggtgcgaaatttcaaatttatgcttgcttcgaaaattaagattgattgaaatttggaagtttcgcaccaatgcttgctttcatttggaagtttcgcaccaatgcttgctttcatagttcacgctaaaattggaagtttgattgaaattggaacgatgcgatgaaaaagttagaagtttatgtatgtaggaaagttttgatgtgatagaaaagttggaagtttgaagaaaaaattgagaactaaactcggcctcattaaactataggatgtgtcacatccaactaaaatctcttattatgggacggagggtataaggttgtactatgttatttttcaaaagttaagggttaggtgagatgattttcttcactactaaattacaaatcgttaggcgctctaaataagttttcacaggcagatagattatcgttcggaactaaaggccactgagaatcgacaatgtttgtaggtttttccacacccacccatcaggctgacctatgaaagcctttttttttatgcaaaaaataaaataaaaatctaaaaaatctagtagtcgttgctccccgtatccatcatgagctccttgccagatccgtcgtcatcacctgagctcctagaattggagctgcatactagcccccatcccccctccccaatcgcaatcgccagatctggcaacctgttatacccaccaccacagtatgtggatgacccctcgcggtcatcgttgtacgtggttggggtcaccatcattctcgtagccttgcgatcaccgccgctggtaattattatggtcgaagtcatggatctagagcagctcatgagtcgccgccccgtaggatcggccaatggtggtcgatccggtgctcccaagcaccgccgttgcaagatctgcttcctctaaccgcatctgccttttgcctttttcccgttcgctttgagtgcagtcatatttcacccagagcgtcaggaccagatctaatacgttgaggaagactgaagcaacggcgataccactggtaggaaaggatgaaaggccgaggagggggtgttgggagagagagaagacgggagtggaggtgaggagaggccgangagagggcanagatatcaaggaaatgagcgagagtggagacagaggaggtcacttgtatggtggaaatgagcgagagtggagacagaggaggtcacttgtatggtggtgttgtagatttttaatagggtatctatttattacgtggaaggtgccaaagttntgtagcggtgcttttcaatcatcttattggtaaattcaaatttgaacttattagtttattagaatattagatttccgtatattgaaactggttcgtagaaatgtttactccctcataaaaaaaacccaacctaggatatgatgtgacctaatccaagactatgaatctggactgattcatataatagatcacatcctatatatctaggttgatttttttaaggactgagggaatatattattatatatagattttaattagaaaaaattatagtattttaaacagagaaagtactgtgcaaagcaatagccgccgacgacgacggacggcatgcagcaacaaccgcagcaaatgcagcgggagtgtacaggtgcgaagctggctggagtcgcaaacaaaggcctctcatctcactggccgcccgtacgtgcttcattcagtaataatggcggctaagcttgcttgccaggacgagatcgagcagccagcctgcagggcgccattgccatcgccaaaatggagaaaatatagttagctgctggcgaggcaggcaacccgtgttgggaggaggccattgataagccgaaaaccttggtgcatgtatgcgtgtgtgttctcgcataattaatcagtaatgctcatcatattattaatgctgtacatgtactccctagctagagctagtacctagtagtatgcatattggatcatcagtatttgcgcgtggtcattaaatccttaaacctaacacttcaattgtcatccacgatctgggtccgttaatcacttgttattacgcacactacggagtggcttgaatcgtactagctagtacaggcttggtttttttttcttttggtttggttttcctttcgatcatcttcatgcagggaccttattgactactgtacttggatagttcgatccgactgctagccaatcgctctattcaatcgactagttcggtcgatcgccggtcggcactgccagccttgataaccaatagttaagggggctgtttggttcactccctcactttatcaaactttgctatactttttaagatatatgtttgtttcactttcaaactcgtggcatgccacagttttttaattcaaaggcccacatgtcatacaactattttttagccaaaccatgtctaaggcgtggccatcaatttataagtcacatatttggctagattacatatttggctaagtttggcaagaaggtttggtaatgtttgggagggaaccaaacaactccttaacctttactatagttctgttgttgggggacgacatcaggaggggatgaaatcaggcgctgacgtcagcgcccaatttacgtgcaaaattaatttaaattgatttttctcttaaattacttatccaaatcatgatccgattgcaccattaaattcgttgcaattaaatcttcaaaacaagaccacacatggatatattccgacgaaaattttttttagcttattattgaattatttttaaatgttgcacgatgttccaccaggtatatcggaattgtttcactaagtagatcaaaaatgtcactcgtttaaatcgggtgttgttttaccttatataaaaacaatgtttcagcaaatagcgaaagaatgtttcagttcactgcaatatttgatccatacatagtgaaacattacaagtacactaagtgaaacatttttcggtggaacaaaaaataaaatgaattcccttaataggaggtttccaaaatatgtggttttttttgttgcaatggaatatttcagttcactgcaatattagatctatatatagtgaaacattgtgagtacactaggtgaaacattttttatggaaaaaaaaataaaccgaatttccttaatagaggggttccaaaatatgtgggtttttttgttgcaatagagttgtttgtgtgtggacacgtggtgggccaggggagtgcagacatgcacgcgcacgcggggggcg

SEQ ID NO: 8744 - DNA, 4735 bp, Oryza sativa
ggggcggggggagcgcatgatttttcctccccccgcccggtcgcccggtgcacagcattatccctattgttggtttggtttcacttactcactgctgaaaaagcgattttcacggatgaggtgcttatgttttttcaagcgaagatattttcttttagcagaaatccgcctgcaaaatggataaataacgggtcgtgggggggggggggttgatgatggcggtccacatgtgaagatcaaggaacatgactagtcatggccaaattttaaatttgtttttttctccaaaaaaatggtgatattattaattaaataaagtgattacaattccggaggcacaagattgatcataaatataaactaagaaggtagcccgtatattcacgcgtgcatatatcataggctgcatttgagatacttgtaagtaatagaccgattgtattagaatgtcgtatttgttatatagcaaactataggcatgtggatctaggcctgccactcggtattcattacccatccgatatccatacccacattatttatgtagggtataggtaaacaaatttacccatttaaaatttggatttgtggagtgtattacctattttacccactttgtacatacccattttctatgcgtaaaacttgcacctaaaatttttaaactctcattcacattacaaaatcttatcaaatttgactttaatttggagggatgatttctgaaagagcaattttgtacaaattttggtcaatttctacattaagacccacatatgtctcttctcttatccattggtgtacccatacccattgggtaatacccacttaatttaggtatgagtaattgctagtgttatagataaggcatactcaatagtcttggtttaggctcgatggagcccaccatataccaagtcttatacaaaatcatgctttattacagaaggtatttcgaataaggaaggagaaacagagttttacttctccctaattctattttccatagttctatttgaagaaggggatattcgagggcataaatacaagatccctagaaggaaggagaacatgcaacacgtctagatagatctagacatgccaaaacaaaagacatgcccaatccggaaaaaaaaaacaagagggatataacgctacctccaaggctatctcactgaatttatattcaaagacgaagacaacattagccgtcgactatgattagatgaggatgagtaaaattagatatggatattggtttccaataccctccatgctcccattaaattaatttcagttatttgtgtccattatctattaaagaaactagtttactggtgaatcggctactgtatcacacatccttccgaccatgcatgtagcgatgtgatgtacgtaagccatcaattttcataagttttcctaattaacacgcaacaataaacaaggctgatcatgccggtcactgaatgaattatgattattagcactccactagctagctaattaacgagacctaattaacgtacgacgtacgtggatattaaggtagccaaacctggagaactatatagtacgtatatagtatatactactagctagcgcagcatacttcttcagatgttttgactgatcaaggaaaaagatcgacgtaggaccgactaattaatttgcatgtattaatttatactccctccccatcttagacaaaacatcatttttctcatataaaattatttttttgacgaagggaataaccacgtatatgcaaactatatatactgtgtggttactggccttatcgcggggtacggtaatagaaaaaccacggtaacctcctcaaattcaaataaatttaaaaataatttaaatttttgataaattttgcacagtttcgtacggtttttcacgggttaccgcgcggtaaccgtgcttaccgtcggggcgcggtaaccctggccccggcggtttggaaaaccctggatctgacacatgcaatcaatagatgcatatgactagctagcttgctgcggattcatcagttcttcatgcttaattacgtgtaagtgagatcatgcacacgtttggacgtgccgtacacgacctggtagtagcattggttgacctggagtgaacacgaacacaacgatatactatatatacatacatatcaacccatgcatatatgtggtatttttttttgtttgaacattcatatatgtggttagacgaccaaatattcgagtcatgctttgtatctaagctatatagatagaccaaatatactacggcgcatgtgttaagagagatcgagggtagtctttacgcatgtagtgtgaatgtgtgatccgtacgtggccgagcgcaacaaaagcacgtcaatgcggcgtgcttacagtttttctttttctattttctcttctttccttccaactgatggtagggaataaaaatgcagggatcctaattagggcacacgtaccagggagagaattaagttgcgcgcagttttcgactgcatggcgacaaactaaggttaaggttagggtttcgggctgggggaagggagggtggtgctgggaggaggaagtgtggggaggatttagagggatggcctaggaggaaacagaccaacagtgagtagcggacaaggccagaaggcaaggtggcgatggcactgctggaggcgccgggtttgcagtggacaatgggctggtgatggtagcagggataaagtgaggcgaaggggaaggggagggtgaggaggccggccgggcagggcggcacgttccgccctttcggtgccagcaaggctggggcggcggcacggtgggggtggcggtggagctaacctgttaccagaggaaggaatatggagctatcattgtcgccccttcgctcgcatcattgtcgctcaactgcaacccctcttctccgtcatagcaaatcactagagtgaggaggaagaagctcaccgtgaggctgtcgcccgctccgctcacgtgcgttgagtggagaggggaagtgaggggaggggagtgcatgagaggggggaaatggggtgagatagggggcgtgcactcatgcagagggagaggaagtgtgcacgacttcccctcctagctcacgtgcacttgataggaggccccttaaacgtgcttacaaattttccttttctttttctttttggtattgctctatggcatgtgatatttttttaatcaatagtaattcattaaccgaaaagtaatgcaaatttaggaacagttgtatatcggtattcagaaagacttttacatattcagaatagttgtataccggtataaccgaaagatttttgcaatgtcataaaactatttaaaattccattaattttgcaatggaactttgttaatattttttatctattgtatgagatatgcatattgtcatttttagttatctttattcttttccagaattttactagatcattgatatgttgatacaatcaatttgaagaattttatataattccgttaggaattttctcaaattattgatgttatgagctaaaatttgagaaaatatgattaagtttcctacatggtatttttctatattagttcctatatttgacaaaagtatgattaagtttcctacatttgactacttataatttcaaaaatttgagaaaatattatttctttgttcctatggtattgtcaaatttgagaaaatatggtattgtcaaattctaacatggtatttctttgttgctggtttcacttcctttaatattatttttctatattagttcctatatttgacaaaaatatgattaagtttcctacatttgactacttataatttcaaaaattttagatataataacgaacgttatcccatcatgctgatgaaatgattcataattctgtacctctatcctttgaattgtttccttcaacttaaactttattagcttatatgttgcctaattgtactttataagcaattaattatgccttattcaatgctcttgcatggtgtttaattgtacttttctgagcatcaaattcatttaaatttctcatttgtctacttataatttcaaaattttcaacaacgaacattatctgatgaaatgaaatgaaaatgctgatgttgatgaaatgatttataattatgtataaatcattttattagtcaaatgagaaattttacaattatgtataaaattgtccgtaactacattaaaacgtactgctaccatattctccccttctttttaatgtataacgtcgttaactttttatcaacatttgaccatttatcttatttattttttatgtagatataaaaatatttaattcatgtttaaagataaaaatatttgttttacataaaaatattgtttatgtataaatcaaggtcgccatgagccaagggaaaaagcttccgatgaattttccatggtgatttccactttccaccctgcattatattaggtactggcgtgtgtatattctaattctcccccgtgtgagcgtcgtcgtcgttcggttttgttttctaaagtcatttagcatttttttttttgaaaaatagatgcaatagcttttgggatgtctattacaattttgatagaaaaacaccactaaaaataatggatattcttgatgttggatcgctttattaagatatgtgcgtctggtttgaggttcatactccaccttatttcttcctttccagctcg

SEQ ID NO: 8745 - DNA, 58534 bp, Oryza sativa
  unsure (1)..(58534): unsure at all n locations
cctcaaaagtaatgcaaaaatcagaaatatttgtatatatgcattctttgaactatttcatttcacttcagccatgttctagtctttgaatagttcattcccacaaatgccctgtatattcaaaatttgttgtatatttaatgaacatctaaaattataactataactatggagacactgggaattataaaatctaatgtctaacgcgagcatcacaaatatttggatgggtattatactatccaatgcccaacgcgagcatcacacatattgggatgagtgggatccaaacatgtgcgatgctcgtgttggatattggaaaatataattaccggggtgcccacactaatatgaatggtttttagatactatttactaactagcatgcttattttttttattcgcattatcttatattaaaatcacagtgttttaattgtgcaattttatcacatatgcactgtaaattgttgaataatgatattatagttgtattatatccaaaaaaaaaaattatgtagtattacctgtatttatagttacaatttatgttgtctagtagacatgattaatcaaatgagttaatatgatcttgtaggagttgaaaaattgttccgttctattacccagttttatgagctaagcagaatgaaagtttgattgtgttctctttgcatctgcccttcccatgatgtagatttgatctcgcttcctagtagatccaccccatgctgtttacatacttgtcagctcaatttgagtgagnagatggagtacatgtcaaatccagaacccaaggatagagaaaaccttccttttgatttcattagaatgatgtgttcttccatatgtttttgttttcatcaacttagttaacttatatgttgcttaattggactttcctgatcaattcatctgacttcaatgctcttacctgttgcctaattggacatttcttagcatcaaatttatttgaatttctcgtctcattcttaacaatcatgccattcgttcaaataagtatgccaaccaattcagatctttttataagtttctcaactaatcagtatatatattttctcataatcatttatgattcataaactaaaagtaatgccaaatttagaaatagatgtatacgtatatcctttgaactatttcattccacttcaagacactctctattatttgaatagttcatttcctgtagttcccgtttattttcaaaaaaaaaattataggactaaccaacaaaaacttttcataatgaaaataattgaacaagcatcttaaattataactataacatgaatgatgttcagatgctagcatgcttctttttcatttacattgtctttatattaaaaatacaatgttttcattatgtaattttataacatatgtgatgcatattgtttctactgctattataaagagaaaattccttctatacccctaaaagtttagcaaatcccttctacgccctgagttttgtccactcccttgtatgcccctgaattttggttttgatccctttcatacccattccgttagttgaccgttagttgaatgtttaattcctatgaaaatgaccattttgcccttacacatgaaggaaatctgaaaattgtagactagctatattgttggaagtgtataattttgttatataagactattatattcatgattttattgtacaaggtattattcatttcaaagtttatttttacataatgacataaaaaactaatatttatttacttattaaaagagtatatgtagcattttttatggtacttagatcaacattttttttcctgtcctatatattaggaatgttttccaaaactatgcttatcatttaaagaaaattctatacatactttttaatatttattaaaatgtctatgtacaacaaacttacgaatgttataatcacacaacaaatttctatactttcaacaatatagtctacaaatttctacatattcctcatgtattgaagggcaaaactgacttttctatacctattaaacggtcaattgacggcaagggtatgaaagggatccaaatcaaaattcagaggtataaagggagtgaagagaattcaggggcatagaagggatcggctaaaatttcaggggtatggaaggaattttctctattataaaaggtattacaaatatagtaattgcaatgaaaaattttgaatcaggtaactgtggagcaaagtagtttacttgttagtttttaatgatgtgattttgtagaaaaaaatattgatgatatctttctgttgtcctaaaaattgtcagcataaatatttaaaaagaaaatatagtcaattacataaaatttgcatatgaatctggtttaagaagattgttgaagtttttgatatgttatatgaatagtacatgtttttcttttaacagaatgcaatttacttgaatcaatggtagctatgaataaaactggtttaggaggatcgtagacctatgaaaaacatgtttgtgtttggttggctggtatcaacaaccatgtacttcgatattaggagttcgaccttcctcccccatccctcaactagcgcatgggtatacaatttgtttcccttctcacatgaatcttggggcaatccaatattattatcacaaatctaaaagttttaactactaaaaaacgatttttttatacgagagcccctataggttgcgcgcggaccataacagatcgtgtctacaaaaatcgaaccccccatcttcgcatatggctccttaagaggcacgtgtgcaaaaatctattttcgccggtgggtcacttaaggagccacatgcaaaaataagtctattttctcatgtagtcctcttaagggaccatatgaaaaaaaaatagattttcacatgtggacctcttaaatggaccacatgaaaaaaatacctccatcttctccggatatattctctcctcctctttcttttttctctcatcactaaaaaaaacttttgcctcctctcctatcctctcctctcctctgctctctctccttttctcctctcgccccctaaccgagtggcgagcaggagcaacgcgtgcatgacgagggccggtggtgacggctggcggtggacccggcgatgccgcccttggcagtggctccggcaacgatgacggcggggtttttcgaattttttttcaccgaatttatttttgcatgcggttggtatagttgaccgtatcagaaatctcattttcgtgtgcggttgcgttggccgtatgggataatccgatttttgtggaccttttggtgtaagtgggctactcatctgtacgtaaaaatcactttagcctcgcggaaaaaactactttttagtagtgtttgaggagaaaaacactggtggaagttttttagcaattaaataaattaacagagtataacactatgaaagtactactatatccttaacactacgataagataatcgaccatatacacgtcctagaccaaattaatctctctcacaggcctactacgacagaccatatacacttaatccattataaaccacagttgacgattagtagcaagttaacagaggactaaacgctactacgactacgacgtatactactgccagtagtgtactagttagtacacccggtcactggtcatcagttggctggtcgatcgacctctcttccgggaggaaaatgtgccgcacattacgctctaatcaaccaccacggtcttactgactgattcatccatcagtcttctctttgaattttccacttacatctgatcttcgtctggacacagccagggttgactccatccgtcattgctccaacaaacttcatgtcactctacgagctagagctagctagctaccggtaatttcgttatatgtaaccgttggatagtactccctccgttcctaaatatttgacgccgttgatttttttaaacatatttaatcgttcgtcttattaaaaatttaagcaattattaattctttttctatcatttgattcattgttaaatatactactaccactcaagtttttgaataatattcacaaaagtttttgaataagacgaacggtcaaacatgtttaaaaaagtcaacggcgtgggaatgagggagtacaagtgtagtactactagtgttcacacatcatccaagcttactgctcctgcagagtcgtgggcagatctacagtgttagcttagatgcaagacaacgtcaataatttttaattgaatttatggttaaactgtttattcataatactacgatttatatatatactaattaacatactatgacactacactagtacgtatgttattatgatacaggaggaccaaattgtatcagcctctgtgttcttttttggagggtctgaacctgatatttttttcgagcgattcttctatctgttttgttttgtaaccagtgtcgcaatcaactctttaattaatcggtgccatgataatcatagttaacaattaataatatcaaagtccctacatattaaattctccaggacaaaggaaaaataagcacactgatgagctagccccagcgtctagattgtatagcaagatatctgccatttggtccttccctaccgatgcaaaagacgattaaattcagacatgacgtgttgccgacatctctcagcactagcaaagatcgtctgcatggcttttcaccacaaccaaaaacttccagataaaatggagatgaacacagcacaggtcacacacatgcatcacaatgcacgtttcatatggtaaatttgtgttcttcctcctaacacacacacacacacaaaggcttataatatgcagggatatattcagctaatccttttttgacttgttctttctttgttccctgatggaatgttcaccatttggcagggaatttcttgtgtttacatgggctttttcaccccctactaattagggctaagcttctgggtgccggtgccaccagtttctagtcatgttgttgtcagtattagtgtgattgtgacattgcttaacctgccttttaccatctgaatgtgatcaaagttaaagtactccacacatttagttggagcatctgcaactgagatcaaattaacgacagccgttgccttttttttttctctcactggaatatagtagtatatatagtggagatgataattaaccgtgcagcttatgttgatcgatcgatcgatcttgactgctgcatgctcgtagactttaatttgttgtgcagatggttcttcacgcgtgctacgtaaaaagcaaagctaacgaaagcaattcaattcaagcactgcatgtgtagtttgttcaacacttagcaaagcagctttaatatttcatgtgctttttgtgacagttttatctgagctttaacacttgcctttcgtatgcacaggagaaagtgagaaacagagtagcagtacgtagttttcaacgagagacaaaactgcttaacagtatctgcttgtttatactgatcaaagtctcaagctagcaaaaaaagattaaaactgtctccctggaagacattaatctttcagtataaacaaagcactgcagttttaatctttcagtataaaaagattaaaactgtctccatgggcctccagggagacattacgtgtgtcaggtacagaaagcgtatccagatctgaaaaaatgctggtccattttgatgtagttccatcatgatgatttatgtactggatctcaactgccatctgattattgatacattgatgaagagcgatgaagcccctgactttactgatacacagcttcctatcaccaaccgtaaaacatgtgatcgcattgtcattggagatcaaattaaagcgacacagatagtattaatattcagtattcccttcgattataattattcgacacaattaagtatttgtattaatatttaaaaagtttgtataaatatatgagaatatacatacttaaaacatctttaaattaaaataaaataagtcacaataaaatattttatattttttaataagacgaatggtacttaattagccgagcaattttaccgtccttgaggaggtaagtggtacctcgtagtacctccttaaggacaataaaattactctaattagaccgttgtaattcatggatacgttactagctagtataaaaagggctacaaattaaattggcttctgttcatcgtccacactggcacgtgcgtatgcttcgagtctatcagcatcgcgtgggatcgatccgcttacatcgtcgcactcgcacgcgcgcaaccgatcgatcgagaggcccccaaccccaagtcgcagccgttactggctactgcgctgccatgcccgtgtccaactgatctagtagctagtgcgtgtgctcgatcgatcactcgatcagtagcacaaattaaccagcaaaactatcggttacacattgacacttatagtgtacattatatctattcacctatatatctgcaattctaaattatctggctgtgtacataaaaagacgtgaatatgagggaaggacataatatcaaataattagaaagagtaaggcttcaaactcagatcgtctagcccaccaccttgtgaagctagccggaagaccccaggtcgtctggctgtgtacatggccagacattgaccgtgtacacgacccgatattttggaattatatatataggcgaatagatatactatacgtatctatgtgtacatgattttgtcgattagtttgatcataaatatttaaacgattgattttggcgatgaagtttaaccattcgtcttattaaaaaaactataaaatattttagtgtgatttattttatttttaaagatgttttaagtatgtatattcttgtatatttatactttttttaaataatacaaataatcaaacttaattgtgtcaaatatttataataggaaggaatacaaagtagtatttctacgtacggtaccgtttgggaatattggcaaacagtaaaattcccaacttcgtgtatataggataagctggctaattaggtccctttgaatcaaaggaattatgaatgaattttataggattgaaattctataggaaattttcctatgtagccctttgattcaaaggattgaagttttccaaatcctacaaaattcctatggaatggcttattgcatatagattttggagaaaacttagcaagaggtctaacctcttgggaaaaatcctttgagtctatctctctcatccgatttctgtgtttttcctgtggtccaatcaaacaatcattcatgtgttttgcaatcatctgttttacacttgcatttctgtcagaatcctatgttttttctattcctctgtttttccattcctacgattcaaaggggttaagcattttagtcgcataaaggtggataaaatgtcaacttaaatttggtcatttttgttcacttatataccaagatttgacatgcatcgtgtgtgcatgcacactatcaagtcaagacgttctggaatttgacctaatcagtcacaattgaaaccaaccgaagctacaactatggtacacgtatctgtctgaccggtgcgaaactttgcgcgtactgaactttcttctataagatttaagtgagttatgtagctttgacaaaatttgttcatcttttcaacccctaattaacatgcatgttttcatggttatttttttttcacataatgaaaaactaaaattatctagaaatgggggcaaacgtgttgcctggagttgaataatcttagcactttggccggtacagttggacttgaataaaattgtcttgccccaagtgaaatcagggagttgaccgatcgaatgatcgatgcaaatgcaaaaatgcttaaggaaaatacatctttgtagcacaggggattttgccatgcaaaatttgaatcttagatttttctttcatgcaaaagttttatgaataataatagaaagagctcctattttatgccattcaatgttatctttgactagcgaaagggcctgtaacctatagtggttacaagagtctcagtagcatctgaggtcctgagttcgactccccatgagagcgaattttccaggatttaacggcgttgtgctttcagtggtagacgacgtacccatcgacagcgatgcgcctgtggtgactttgtcaatctccaggattggggtaggatagcatcataggggtaggatttgcgtgtgtgcgttcatagaggtgagtgcacgtacgttgtaagtgtctgcgttttactgtgtaattaaaaaaaagttatctttgactagttggaacagaagtagatcgaagaaaacattactaggtttcaacaacaaaaaaaagaaaaaaaaatactaccaagaaatcagcatttcggcccatgcccgtagcctgatttgtccttgtttgatgggcctccattctggccagccacgtaatcaggccaagatattaacgtaccgcattaggcctagaatttggacggaataagttcatctgagttcccttaacttcaacatgggcctccattctggccagccacgtaatcaggccaagatattaacgtaccgcattaggcctagaatttggacggaataagttcatctgagttcccttaacttcaaccgaaaaaccagatacaacgggtccctcaactgaaaaaaccagtgtagatgaggcccctctgcggttttgacggcagttttggctgacgtggtgcctacgtggcaaatttgacttggtctttatctgatgtggcatcgacgtggtgctaacgtggcaattcgatccagaaaataataaactttgtgggacccacatgccagcctcacacataaattaatataaaaatggtggggcccacatgtcagctacaaataaaataaagatggcggggcccatgtgggccccacaagtccctcttggctctccatcatcctcgcggcggagcgacggtgaggaagaggagcgggcgccggcaacagcaagccgcgggcggaacggaggggcgggtggagcaacagcagatgcatcctggcagcagacgccaggcggaggtggtcagaggaggaggttgctaacagagcggtggcaagccgcggacgcgcggaggtgaccagaggaggaagaggcagaggaggagatcgccgatgagcgcagtagctccactccgtcggccgctatgcccgcgatgcccagcagaacaacgctgccccttcttgctcggccgcgccgcgccacctccttccttgcccggccaccgcacaccgcctccctcctcgtccggttgctatcgctgacgtccttgatggtcacatccgggtcggagccctccctcctcacctggtcgccgtgcgccgcctccctccttgcccagccgccgcgcgccgccttcctcctagcccagctgtcgcgcgccgcctccctcctcgcccggccgccgtgagctacccctcctcgcccgggcgccgcgtgccgcctcggggacaggagagggaagagaggaggaagaagaggggaagagagttgaagaaagcgagatgatgagaatgacatgtggggcccacgtgggccccacaattttttattaatttatgtgtgaaactgacatgtgggtcctacggagtttattgcttttccagatcaaattgccatgtaagcaccacgttaatgccacatcagataaagaccaagtcaaatttaccacatagacgccacgtcaggtaaaaccgtcgttaaaactgccgagggacctcatctacactggttttgacagttgagtgacccgttgtatctgttgaacgaagaaaatcggattcattgacaagttaagggacctcatatgaacttattccaatttggactaatattttggcccacacacacgaatgggccacgattcacgcccacataaatgaggcccatatataataatgggccggaatttggaaccatgcagacgagttcttacagggccaacgtctcatcaacgccaagaaaccaaatcatcattactctaattaacatactcctaattatctttctaatcaattaattaaacgcaaaatcagtagttttctaataattttattattaaaactgtacttttagaatatttcaccttataattcgatagttttacaataaatttactgttataaatatacatttaacagttgagtgataatttaaccaaataattaacatattatttttaaataataaaaataggttatatcttccgactttgtccatggtcacacaaccaacaaatttcacaagaatttaaaatggatgcgatgggtcaaaccctcaactctcaccaataaaatgataaagtgaaataacgttttcaaaatcagagagattctggcacgaaataattatctttctaatcaactattagttaattaattacggagtagtgataatccccggagctcatctccatctcctcttccgcttcctactcctactccgtcgcaatccgccgcctccaaaaagcatccacctgtacccacaaacggaagcaaagattccaactttcgatcgagagcctcgccgtcgattcccccacctcggctgagcccggattccgaggcagcccccccatggcgggagccgagcgaccctactacccgccgcggcccacggacggcggctccggccagcccgccggctgcgactcgccgatgaggtgggacgacgacgacgaagaccacggtggcggcggcggcgatggcatgaccgccgttgcggtgagcaatcccccctctctctctctctctctctctctctctctctctctctctctctctctctccccttacgcggtttcgtcactgtgaagattggttgcgtgtacgcttagttcgtttggttgagttcgttgtgattttaaagcttgtggtttgggcgattggttgggtgattagggcttgctgtgtgattgtgagaatcatggaggaatatggaaaatagaatgctttaatgggtgattgggttaagcgcttaagcgagaagcaagaaaaagaaggtttgggtttttaggattgtatggctgctgctgctcatcgccgtcgccgctttggctgctgggaattatggggcttttctacgattatttcttttaaacatgaacgaatttccatattggtttctgttgtaattttattttccaaatttagggattcaacctgttcgaggaagaatcagatgaccctcctgccaaaaatggcgtggtcgacgatcctgatactaccactacaagtgattgcaacactgatatgagtgaggatcttgtaaagagggaagaagggatgaacttccattgtgatcccccgcttcacgaacatactggcatctgggtgcctgtttctgtcccgccaatgaccaaacgcgatcacgaggagtggcataagggctttggtcataatggtgactactttccagaagacgaatttaactgggagatagatgaagagaacaaggagatgacgatgtgggatgtattttctgagatggttgttgcggcaaaggataaggtaatatcagttgcatcgtatgatcttgggagacgtggtatgtctatgttgtccaagtttttcttccaagaagcttggaaggatatggcccaaacacttgcagatgccaatgctggcattgcgaatgagctcctagagactgaacgaacaatatggttacctgacagcgctgccagcgcctgcatgctctgtaacgtgcgttttcatccgataatgtgctctcgacatcattgtcgtttctgtggtggtgtgttttgtggtggttgttcaaagggtagaagcttgatgccaccgaaatttaatacttcagaacctcaaagggtttgtgatgtttgcggggtacgtctagagagtattcaaccttacttgataaatcggatcagtcgtgcttcacaacctccaactcatgatgtcactgatctgagtacattgaggtcgtggctgaacttcccttacgcacacacaatggaatatgagatctacaaggctgcaaattctttgaatagttactgtaaggtatgcctttttaccctaaattgtttactgttgaatttgtttatcagtgctgttgtaatttttttagacattttcttttgttcttctcttttactgtttgagaaatcatgtgcttatgctttagtcatagcctatcaagacttgtcacctaattctaaggtgctttatcatgtcttaattctcaacagtttatatatgatttactatggacatcactcattaagtaattgatatgttcctttcttgctaatacaataataatatctataagacttgtaacagagtatggtcttccatatttcttgcaaagtaattttcagtttccttaagtatgagttgaatagatgaaaaacctaacccggtgattggataagaattgcatagatatttgctctcagcttttgcacaattacacctgtgtaatctatagtggcatcatatggttgtccacaacatttcagtacgtttatggtcttccctctgttgtataatttgttaatgatatctattattttttaaagacatacctgtgttacattcatccattccccaatctttattataataactctagaccattcaagttacagtaaatgctgccaactaattaaaatgatatctacattagttgttttagtgatatattcaaattagagaatcattttgtctgtcgaatgctggttcgaagtattatacaaactaaaattgggtttccacatcattctagcttctgaaagtgctgattgttcagttagttcagttgttaggagaccaaccagtagcagtgcaatcattttttttttcttccatgtgccattcaggtgggaagactgaaaccagaaaaggctatcccctatactatccttaaacaagcaaaaggccttgctataattactgtagcaaaagtcggtatgatggttgcatataaagttggtactgggctggttattgctcgaagagccgatggttcatggtcacccccttcagcaatcgccacttgtggtattggatatggagctcaggtgacatcttcttttctagtgtcctttatgtgcaaattcttttatcatcacactagcacatcataacaaaatcagataatttccgacttacccatcaggctggaggtgagctagctgatttcattattgtgctgaggaacacagaagctgttaaaactttcagtggaaaggcacatttgtcagtcggtgctggtgtaagtgcttctgttggccatgttggacgagtagctgaggctgattttcgtgccggtgatggtggttatgctgcatgttacacatacagttgtagcaaaggtttgtttcaaatttactccatggcatgcgtcactttggcgtcttctttcatatgttcattttcacctcgctcaacatggaacacatgctttattatatgatacgactgtatattcgtgaataacttcttttggtggtgatggtgatggttgggagaatatgtgtaacaggacagttcatggttacacaaagagtcaaataaacatgtaattctgtcttagaatctcttaaaacaaaacaacagaattggattggggtccttgacccatagtttctcaatatattaaggtaatttaaagggttttgtttgtatccattgcaagttgattatttctcttggatttcaaatggcagacgagtaattctacaaagtttgggaatgtcctcttaaacccaattttagttctgcatactttttataccaacacaccaggacctgttttaaaaggcccatagcttagtaatttgacccttctattattagctttatctttgaatgactaaaatatgtcctagtatatcttatcactggataagtgcacaaattctcggccttcattggcttacatcacgaacttattttgttactgatgagtaggcattatagtaagcttagccattcctactgttttttctcacaaagaaataatgtttaccttgttttttctcacaaggtaaacatttatacgttgaggcaccctgagaacacttgggactctagtctgaacaattaacttgttgacagtcttttaatgtaatattaatatatatatgcacttgtggaattcatattcataggagtgcaaaccatgtcatatgcatattaatttattttcgaggaattgctttttgaatttgaactttttgactaaaataataatgccaactgtgaaccactctagactgctggatgcagttatagtgacaaacctaagtagtattacagtgacactttagttcattcgtgcaatatctgatgtcgaatttttcaattaagtgtagcaggatagtaccatttttcaagaaataaatgttcattgctaactgttaagtacttgtggctagatctggtcattcagaccattcagggttgtcttatgtaacaactgagtctgtatatctgtcttatgttgcaggtgcttttgtgggctgtgctctcaatggtagcttagtatcaacccgagacacagaaaatgcccgattttatggtggtccaataaaggcacccgatatccttatgggatccatggctagaccacccgcagccgctgcgctctacaaggttctgtcagaattgtttgacaatcctgagaagcaatcgctttaggtctctagtatgcgttgcgtcttctggtaaatacattctggaactctctgtcaagtaattggattgcggttttgcgatcttttcacttattcgttggttgcagtttacgcaattgtacagtctgccattcattgacacgccaaaggtttcacatcatggttaccacaaaaccaaatgtaaatacatgtacattggatcccttcttgcttcatcaagatataaaagaaaaaaaatatatactattttccattccccttgatgatctgcatgcatgttcttcagctgcattgatcagcactcctgctgtgaatgacctaggactgtttttttttttttggttgcatgcaacttttttctcagtgtacatgtgaatgtcctcccatcttttctatgatctttgaatttgtgcacctcctccaggggaaaagaggagggtcccccaacctctcttcttgatagaattcacaggcagtatagtcatttttgatggtcctaaagaggacactgaaaaagctggttgtactggctctgtcatcctgttgtgatgttgtgtgttgttgcattccctgggtaattattttgtcctggcaatgcaatagcaaactaaaatgtactactacttcattacattgtttcagctagcctgtaattctgatgcaagaaattcatgcagaattgcactagacctgagaaacaatacttctctagcaaaagataaaacagaaaatgacttcatcaaggtagtggtggtattttttttttgttcatatgatgccattgcacttgacatgatgagttgtgagaaaatactccctccgtcccaatatattaaaacctaggataggatgggatattttctagtactacgaatctggacagaattttctagtactacgaatctggacagattttaatatattgggacggaggtctgtccagattcgtagtactagaaaatgtctcatcatgtcctaggttttaatatattgggacggagggagtgcatgacactgcagctaatgactatgattactgaagcgtgccgcatgttgagcttgtctggcatgcccagagcacacactgcagatgaatggaatctctgtccctgtcactgcaaaatgtatattcctggtcttaacaaacaccaatgtccatccagccctgaagatacagtaatgcggcagtgtccaatcggtgtctgactgaatgtgccgtcctcgatactagtgcccttgaatcattgagatgcataattcacttcagttccagttcagttctaccatgatggaattaagctgaatatacttactagagatgagatgagcaagagaatgatacagtatcctggaaagtgagtagcaatggataaatggataatcaatcagcaacacacagaatacagagcataaaccagcattgatcatgagcaggaagcaaaatgtataaaattattctctgaattctactcccaactgtctgacaacccattaaccatgaacatcctaattcccttcccttgccatgttttccttttcattgtcttctaacaaccgaaaattataggatataagaaagcaaaaaaaaaaatcaaaaagaagctaaacttaaacgacggcctgcatgaatttaaacccagttcagagactcctcataagatgaacttcttctgaacccctctctgatgatgatttctccaattcttgatttcttcgtcttcttcttcttcttgatgagatgaggaagtaagcttagcgatcgccgcgagtcatggagctcccgagggtgagctcgagatcgtcggagccgcactcctcatggatgcgctccccttcccacgccttcaccagcccggtcatcttgccgccctcgccgccgaacgcgaactcgcggcgcgccgcgtcggccatctggacgtcgccgccggcgaccggcgagcacgctccgctcatcaccctcgaggaggaccccgcggcggcggcggcggcgccgaacgggttgggaggaggagccacgaggctgtacgtcggggacgacggcccggcggaggatatctggaacccggcaagccacgccgccgcgtcgttgccgccgccggcggcggcggcggctgcggcgaccttgcggcgcgggctcggcggggtggagtttggcagggacgacgaggccgcgtaggcgtagctcgcgccgacggtggcccacggcggcagcacgctgccggcgtggtggtggtggtactcctcccaggcggccgtctgaggcgcggcgtgcgcggcggcgagcccgagggcggcgtcaccggcgcgctgatggagccgccgccgaagtaggagtagtgcgccgggaacttggacgacgagccgccgccgatgccgacgccggcggaggagagggtcttgagccacgggatgaggctgctgccctcgccgccgccgccgccgccgagcgtgatctgggaggaggagccggagctggggaaggaggacgtcccgcgcgggctcggctggtacgacgagcacgggctcgccgacggcgagcggccgagctgatcagcgagctctgacgccggcggcttgcatccctgaaacacacagacgaacggttcgacaaattaaaccaaattttttgaagcgaaaatttaaaccaaattggtgaatttgacaatagcaagttaatgacattttgcatagaagaataacaatcagaaaaatttatcatgtacagtttaacaagaattaaaaaaaaaattgtaacattttgcatagaagaataaaaaaaatcagaagatttgatcatgtacagtaaaatatgaatataaaatctgtgtcgttttttaagtaaaaaaaatgtgacattttgtatagaagaacaaaaatcagatgtacagaacaggaataagaaaatcacctcagaacacaatgtgaaaataaagttacaagaaacgtgaatgcaaattcttactgaaattcgctgcctcagaattaaaacttcacaaattatggccagaaatattaacattgctggcacaggagttttcatcaattcaaactataaccatgataataccaaatagtggcaatgcaaacttaactgaaaggtaattaaaatcctcagtgaaacgcacacaaaaaaaaaaacaactactgctctaaaaagccgattgcaataaaagaaagaagatacttgggtagaatttgtcattttgtaatgcaaagttgattttctgaaatcaaaggcttctgtgacagccttagctttctttgatgtaatattcggtcatgcccatatctatctgcctatgaccatgccactaacttttgtctccataattgcctctttcaccagtccttttttcacatgagcagcttcaattctgtccaggctccagtactacatatagatgcatccatagagataatgctaatcttaaaaagagaatttactcaaggtatctagaggcagagcttgcagccaacttagacttactttgacaaaacagggcagatggattctgtaaaggtactagctttgaccaaaaactaacaatctttgattcttgtattaatctacaccttaattcaaaagcgatttgtttggcagtctaaccatgcagttactaacgcgtgcaagccacatcctattttgcatttcttttcaattgaaaacaagtagcacttcagtttttttcggttttcacttgtcagccaacttgtcatccagaagacttcagaaaagaagagatgatctaatccttaatttttttttaaaagaagagcaggcatctaaaaagcaccatagataacaaaaagaaatgcttgaaaacagatagatttgatacattgtattctgcaaacaagatcctgatagcaatgttcagacttcagagctagtactacaaccaaaaagatgctagtactgctcttctgccaagacaaaaataaaataagaacaaaaaaaagaaagaaaacaaagtgatgagctttaagtacagcaccactactactacgacctcttttccctgcctaaaaagacactaaatcttgctaaaaagacccagcgccacagcatcatctctccaccccacagatgaagaagatgaaatcaacaacaatctaaaaccatttttgttcagataacggaagatctttttaataccaaaaacaacaaagaaacaaaaccaaaaaaaaaaaagagaaagaaaacgaacgctttttatccaggaaacggccacggaatgtcgcggcggcacgcgtaatcctgagctcctagtgcgtggcttgtcccacgcacgcaaagaaaagaggagatgagaggagagaatttcccccgccattatcggagtaaaaggaggaagacgaagcagaggagagaaaggagaggagaggagagagcacgcgcgccgcgttgcaggaacgaggaataaaaaaaaaaagccaaaaaggcaatcatggataacgagaaaaattcggtaccctcctctacagccgacgcaaattaagcaagaaatccattccatataagagcaaaagattaaatgaaattcgacgagaaatcgcttaattaatttgcaagaagaagaagaggaagaggaagagggaccttgcggtaggtggtgccgtcgggctcgacggtccagccggcctcgttgcagagcgccttgagcacctcgttgttgtcgcagtgcttcgggagcgtgtagtttccgtacgcccgcagccccgcgtagatcttcgccgcgatcgcccgccgccgccgctcccgccgccggttgttctcccgctccctccacgtcggcaccctccctccccctcctccgttcatcatccctctcacctcacctcaccgccgcgacctacgaggaagccaacggcggtgcgcgctcgccgtcgccgccgctgcaagctcgccgcgcgctctgcagtgtcagcctcgcaggcgcggcgtataaatacgccggagaagcagtaacggccggaggacgcgcaatgaccattctacccctgggtggtcttgcgcgggggagggtaaatgcggcatttcgcgcgggggtggccggtaatgattccgccgcagttaaggcgggggtggccgagaatggaatgcattcgcagtggcttaactagcctatcgccttagtgaacagtggccatttttagcagcagctagctaagctaagctaatccatgcaaaccaagcgtgagcggcgtgggtggtcaggtgacgcgtggtggggccagggtgtcagtgactgtggggggttggtgtgctactggaccagtggtggtcaaacgaccggccggcttgggttttggatatgttcttgggggtgcccttgatgacttgggttttggtatgatgtgtatgatttggtttgatgaggttgggggagaagatggatatagctagtgtggttgctgtcactgttcaatgtgtcaatgataactctacagtaatgattagttaaaagctagcacgagtctagttatggtttgtaacggttttggttttgtgtagcgcatggttatatagccgttaaattattataaatatgtgtatgtggaagtcaataacgagaattgttgtcattgattaactgcctatcgtagttactgtctgcacgattggatagtttaaacgtatctcgtgatatctcctttgacgatttacacgtgacattgattagacgaaggggacgatattaaatttgccacaataaccaccgtaacggttaatctggttgtgtaacggccatggaatgcaattttatcctcataatgactacatgtagtattggatagtttaaattaaacatgtgattccttctttgtcgatttacgcgtgacattgattagacaattagattatgttaatctttaccgtgacaacagtaatggtttgtctagtaacatagaacgtaaaattggacgtgctacgcattaatagagcattgttatctataataattgatctgcacagtcaaaacaaaagatttcaaacggttcaattgggtctagcacatggttacgtaaccatggaactacaactgtacatgcattcaaggtgtaaataaaacattaatatctctagtaatctatctacaacgtaacgcactagatagagctatggattgtaaagcgtccagttagttccatagcacgattgtataactctaggattaccatttacagtgcatataggagttgataaaaattgctataaaaataatcgttaatcaacataactgcagacacaattatatgtacaggtaacacatattatttgttactaattaatttatgtgtgatattgattagacaaacatggttgtgataagatgtaccgcattaatcaaatcggtttgactcggtcattaactatgaaagtgcaaccgtatgaaatcaatatggcactataaatctaataactaccatttcctgagaggaactactgctaggcttacctagcctaaaagggctaggtgcagtcagttattaggggctgtttggttttcagggacttattctaagtccctgtcacatcggatgtttggatattaatttagagtattaaacatacactaattacaaaacccattccataagcttggactaattcgcgagacgaatcttttgagtctaattacgccatgattttgacaatgtgatgctacagtaaacttttgataattatggattaattaggcttaaaaaatccgtctcgcggattagctctcatttatgaaattagtttttttattattccatatttaatactctaaattagcgtccaaacatccgatgtgacatgggctaaaaagttttagccccatctaaacacccccttagtctctctggccatgttaaatttgacagggaatacgtatactaattagagtttaatttattatttttattataacttgtagaaattaaatttgaaattgtattttttttcaatgatataggagtattatatattaatatatcttatcaatatttttgaattttattcataattatttagtaacttggatcatggaagttcaccagagaatacaatccatctctatgcaagcaaggtaccgtaccaacagttgctggcagctggcacgtacgtgaagtggactagagatcagcagcaggagataggccgtgccgtgcagtggctcatgactcatgagatcagcatcatgcatgagctagctagcacacggcgtgagcgcggttaaccgcggttggatgtgtgggtttcagttagtacgaacccgggataccggccaactcatgaaccgctgcttactttgtggagaatttttttttcttagtgaataatttgtgtttgtccactgagatgcatgtctcacacaatcttcctcttgatgcttaatttagatggttaataatatggggctcacacaaattaagcactttttaggttatccatcgataagatcgatgccattttgagtcaagatgataaaagcacagttaatagatacctgcataagtatataggtttatctcatggttaaaagtaaaagatttactactcaatagatctccaaatctcagtcgagtattatcatttatttatatacacagctatattaatagcttaaaaaaatactctcacatttaactacgtcatcaaattgggtcagccattagattgaaatgtctaatacacattgaacattagaccgatcaatgtttcttcctaaaagaattcttatacccacgtatcaacacacgaaatatcaactagttcagtggcggatgcaagatttctaagataaagatacaacatcacttaagcatagttaaatactccaaaaaaaataaaaaaagacttgctataagtgaaagtcaagtgataattttgatcccaatgcaaattaatagagaccaattatacaggaaaatttacaaaacaacgtaactaagctagaaaatacgtttaatacccttagaaagaatgattttgggattaagtgtgcttgttttgacacaagtaatggtatatagacatattatacctataaaatcacttattttttacaaaaatttgggatagaaatgtacccatgtcccatgtcccattgtaggtccgctcgtaactagttgttatgacgtggacaatcacgtgcttgtaatggcctgataattgtctttaactaagctccagctagcacccatcaaacagcgatggataagcgatgaggatggcacaacattaaagtaatccaggccatattcaaaagtaaatgaaatttaaataaaaaagcaagatgatcgataaataatactactacatttgttttttaatatatgacgccgttaactttttacatcatgtttaatcattcgtcttattcaaaaattaaataaatatattttgttttgatgtggcttgatttatcactaataaactttaagcactacttatatttttaagatttgcataaaatttttaataagacaaatggccaaatattataacaaaagccaacaacgtcatatatattgaaaaaaaaatgaatcaatcgatatctcaaatatatcaccccgtctaaacggatatcaactagccgataccttaaaaaagtatcatcctgtccaaaagtataccatgttgtagcattttccttattaatttatccatcaattggcgtgtgaaagaattaccgggggatattaattctttttccaaccaaaccaaattaaaccaaagttcatgaccgacagaacgaaaatgccagagcagcaaagcaagcatgcatgccgattaagcagtggcagattgcatatcgtggaagaagggccaagcatgcagcatgacacgtcgttttcttgcctcatccaacggcaacgtacaggccggctgctggtccatatgcgcctctccctcctctcttctgctcatgcatgcacgtacatgcatgcatatgctccatcatcgtttcatactatatccgtgttcaatgacgaaactgttgattttttttataatcaatctttaactattaattttatttgaaaattttatacaaatataaaagtatttatgtcatgcttgaaaaatatttaatgataaatcaaaacacaataaaataaataataattacatatttttttaataaaataaatgatcaaaaaccaacgacatctagtattaaaaataggaggatatatctcttcctgtcaagcagggcccacaggtcaggatagctagctagtcctgtcgatcgccacgtcgtcgtcaggcacgcatgctgccggcggccagaaacactgcatatcgatctgcaggagtagcactgcagggcagctagctattcccaccgcttctaaattgtaataacatattcgttttatattataaattatttatatttttctctaaataaaaatttaaaattttattaagtttatagaaaaatttagcaacatttacaacgctaaattaatggacctgttcgactggtattttttacagctacatggctgccagctgcacagcaacaagcagcacggctgcagccacacaacacaaattaccgctgcagcctgcagcagcagcagcgctgctgaacggcagccgaacaggcccaattttgttaaatgtaatattgaatatattttaatattatatttgtttcaggttgaaaatgttattatatttttttttataaatttgattaaacttataaattttaactaatagaaaaatcaaagcgattcattaatacgaaacggagggagtattattctaaatctattaggatatatccttcatccaatttcataaatagaaatcagatatcttatttagtttcgtaaccgaaaatacgcttatatttttgaaagtgaaccgatattcgaaacgatcaatacaaatacgaatatcgatgcctaggatgagaaagaattgagatggcaaaagatagcatcacgaggaggatgatgccaaatacgtaggaaggggtgaccgggtgacctgggggaaagagaccaaagagggagcaatggctaagccagctatatgtggcgcatgcaatgccatttttgtcactttgctccttggatcaggggaaaaagaaaccttcttgtgtcactctgtcagtgcttgcatgccaaattgactattgcattatacaaggatttttacatatgcatcccaggtcggtgagcgtgcatcttttatataatctaaaaagaaactctgtaaaatttacttatttatctctaatcaaatttcacacgattgactgattatttggaagattgttactcatgctctaccagaaccgtgcagcccagtctatccgacaggcaaacacactgactgttgagaatataggcatataatgatttaatatattccataaataaatcatgacattacatatgtatactagcattaacgcatcattaaatctacacatgtaaattaaacagtaaaacatgaacagatcaaatacgcgcaacatgtcgaacacgtaccgaggtagcggaaagaccggttgctcggcaggaactactcgcggttgcgagcgtcgacgaaggcgcgcagcacgcgagcggataggaaggcgagccgtcgcgaacgaacaggaagcagtcgcgcgaagcgcttcccaaaaaccttattgccgccttctcccggtgcaggacgtcgaaggcagaggttccggtgacctgctctcctgatcgccggtgcacactggcgagcgggatggagtagtctacgagcgacggcgcaacacagaggaggaggcaaaccctagattgatttcgcgtgtgttgcgtgaaggcggcgacacggtttatatagagataggtggcttgatcaggacgcccgcacgatctccactctgcgtaaccgagccggataagtcacgcgtaacttatccggactctacgccattttcacgcaccggatttttcggaatgtttccaacaacaaaacaaatccgaattttcctgcaacaaaacaaaactgcaaaaagaggctgcatctgcgcaatggtgaggagccaattttacggaccattcgatgcgtacgtcgtgcacgcgcgccgcctgcccaggcaaggcgaggcgagcgagcgcgcgcgtgttccccctcttctctccaccacacatgcttcaagtggctaggagggcatcctcccttttaaggaggtctccctcttctagaataagcaaggtggtactaaactccacatgcatgccatcccatgaggtgggcttttgtgatttcccaaagaattaatcttcgaatgggccttagcccatctattaattccaacaatcccccaccaaatctcaaaatcccactgagatttgccttttccaatgtactgtttatataccagcggttcgatggagaccgattaaggttgaacatccacctagaactccaagctacactaactcacaacttgaacaatggactacgccttgaattgcaagtcttgtgcaagcaagtttcactcagagtcttatctggtactagaccgtctgtagactacccctcgggtggagcgtataagtcatactctaggtttttagtaagcttcctagaagattcacccaaaatcttaatagactgcggccaacagtcaagcttacaaaggtgagttctttcaagaatgctctgcaggacaacatcttcgctaattaaagccaacagaactcattaaggcatagccaacctgccttgcagctcacgagagtacatgtatcttcacttagagagggtatagattggtactctcctctagtttactaatggtttgttcttcccaggttctaattcacgagatctccgatcacatagactggattaccaccatagtataactcacatgggtctcaaacccatctccttcgatgcattatctatcacatttcgtgatagtcccttcgtgaagggatctgccaggtttcaagctgtttggatgtaatccaacgttataactccggagtttctcaatttcctaacagacttcaatcgtcttttcacatgtctagacgatttcatattatccttagaactattcactttgacaattaccgtttgattgtcacagttcataaggatagccagcaccggtttttcaacaataggcagatccattaatagatcatgcagccattctgcctcaacagtagcagtatccagtgccgtcagttctgcttccatggttgacctcgtcaaaatagtctgtttgcaagacctccacgaaacagcaccaccacccaatgtgaagacatatccactagtggctttgatctcatccacatcagagatccacttagaatcactatatccctctagtaccgcaggatacccagaatagtgaagtcccaattccatagtacctttcagatagcgcattactcgctcaagcgcacgccagtgatcatctcccggattagaggtaaaccagctcaacttgctcacagcaaaggagatatcaggcctagttgcactagccaggtacatcggcgagccaatgatttgggagtattccagttgattcctagcaattctcttgttcttgcgaagcaacaagctaggattataaggtgttggagaaggcttactatcaatgtagccaaagcaattcaagatcttctccacataatgggactgcaaaagtgtaatctcattctcacctctaattagcttaatgtttaagataacatcaactactcccaaatccttcatatcagaatgatttaacctcatttatcacctcaaggtttgtcccaaatatcagtatgtcatcaacatacaagcacagaataactccctcacccccaccatggcgatagtacacacatttatctgcctcattgactgcaaagcctgcagatgtcaatgttttgtcaaatttctcatgtcattgcttaggagcttgtttcagaccatacaaagacttcaacaatttgcacactttgccttcttgaccttcaactacaaacccatcaggttgatccatatagatctcctcatctagctctccattaagaaaagctgtcttaacgtccatttgatgaacgagaagaccatatgaagctgctagggaaagtagcacacgaattgtggtcaatctagcaacaggtgagtaagtgtcaaagaaatcttcgccttcttttttagtatagcccttagcaacaagccgagccttgtacttttcaatagtaccatcaggcctgagcttcttcttgaacacccacttgcaccccacatgtttacacccataggccgctctgtcacctcccaagtcccgttagcgataatggaatccatttcactacggacaacctccttccagtagtctgcatcaggagatgcgtatgcttctgaaattgacttaggagtgtcatccacgaggtacacagtgaaatcgtcaccaaaagacttaaccgtcctttgtcttttgctccttcgaggagcttcactgtcatcctcctcagtgacatgttcatgtgtatgttcagtttgttctggtggtgtgattgaactgagaattatttcagagggttggctagaactactatgtgtatccttcattgggaaaaagctctcaaagaaggtagcatcacgagactccataattgtaccaacatgcatgtcaggtacctcagatttaactattaaaaatctataggcaatgctgtagtgagcatatcccagaaagacacagtccacagtcttaggtccaagtttgcgcttattcgttattgatacgttgactttcgccaagcacccccatgtgcgcaagtaagaaagtgatggttttctcccaatccatatctcatatggtgttttgtccttatttctgttaggaactctgtttaacacatgattcgaggtcaacaatgtctccccccaccatgccttaggtagtcctgcggtgtccaacatggcattcaccaagtcggtcagtgtgcggttcttcctttcagcaatcttattagactcaggagaatagggaggcgtcctctcatgtataatgccatgttcctcacagaataagtcaaactcgtttgagaaaaactctccaccacgatcagacctaagtctttttatctttctgtcaagttgattttcaacttttgccttataaattttaaaatagtctagagcctcgtctttcgttttcaacaagtacacatagcaaaatctagtagcatcatcaatcaacgtcatgaaatatcgttttccacccttcgtcaacaccccattcattttacagagatctgagtgtaagagttctagaggtgccaagtttctctctttagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgccatacattagcctcatcatccacactgccacaaatatggttcacagacttattgcagaaatcagaaaaggaaaagcagaacaggcctccgcactcataacctttaccaataaaatatctatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccctattaggacggtggaaccccatgcgacctgataagaagaaaacaatgagatgtcagcacaaacatgtacattggcccctgtatcaacccaccaattagtagactaattaactgaaaaaacagtaggtaaattaccatacccgcttccatctccagtgttgccaatggtcacattggcagacttagaggtctgccctgcaggtgccttcatccccttgcattgtggacacttcctggccagatggccaggttgaccacacacaaagcaagtcctcttatcctgattaggattgttgttgttgttcttcttcttgaagttggtggtctgctgagctttgtatttccccttgctcttgttctgggccttgtgcacaacattggcagtggactgcccaccatcgcccttagacgcgacatctttttcccgagctttctcctcaacatcaagagacgctatcaacccctcaacggagtattcctgtctcttgtgtttgagtgcagtaccgaaacctctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagcacgctaggaatgcatcccacaaagagagtagtggcctcatcgaattctttctgctgatcagcattaagaacgcccataggcttgccagtactcacctagaagcatttcatagctgtcaaccatagagtgaccctgatctgccatctcttaaagtgcacaccggtaaatttatccggcctcagtgcattggcaaaaccagccatagtaaactcacagtgcctatcataaggtttttggattgttgagaatataggcatataatgatttaatatattccataaataaatcatgacattacagatgtatactagcattaacgcatcattagatctacacatgtaaactaatcagtaaaacatgaacagatcaaatatgcgtaacatgtcgaacacgtaccgaggtggcggaaagaccggttgctcggcaggaattactcgcggttgcgagcatcaacgaaggcgcgcagcacgcgagcggagatgaaggcaagccgtcgcggacgaacaggaaggaagcagtcgtgcgaagcgcttcccaaaaaccttattgccgccttctcccgatgcaggacgtcgaaggcagaggttccgaagacctgctctcccaatcgccggtgcacgctggcgagtgggatggagtagtctacgagcgatggcgcaacacagaggaggaggcaaaccctagattgatttcgtgtgtgttgcgtgaaggtggcggcacagtttatatagagataggtcgcttgatcagggcgcccgcacgatctccactctgcataaccgagccggataagtcgcgcgtaacttatccggactccacgccgttttcacgcaccggatttttcggaatgtttccaacaataaaacaaatccgaattttcctgcagcaaaacaaaactgcaaaaaggaggctgcatctgcgcaagggtgaggagccaactttgcggaccattcgacgcgtacgtcgtgcgcgccgcctgccctgcccaggcgaggcgagcgagcgcgcgcgtgtgttccccctcttctctccaccacacatacttcaagtggctaggagggcatcctcccttttcaggaggcctccctcttctagaataagcaaggtggtactaaactccacatgcatgccatcccatgaggtgggcttttgtgatttcccaaagaattaatcttcgaatgggccttagcccatctattaattccaacactgacacatagcaccccctacacttttattctcacttcgagtaaaatgattaacttggaagtagtattgagcccatccaacaggtagacccacttatactttcattcgacagacatgttcacttacactttcatcatcatttcgtgtaaatggttaacccaaaagcgatatggttggatggacaacccatcctccagaaccgcaaaccaaccatccgtatagcacctcatttacactttcattctcgcttcgtataaaatggttaatccgaaaatggcatgatttccttaaaaaaaggaagtggtatggttggagggcttataagagattctactcttgctcatataaatcaagggcacacaacgctcatgggtaacataggccacatcctaattgaaccgagatatcactcatcacaaattaggctgtgtttggaaccctgggttcccaacccctcccaatcgtattccgcgcgcgtgcttttcaaactgctaaacggtactttttttgcaaaaaaaaatctataggaaagttgcttaaaaaatcaaattgcatgttgggaacaaattattccgaacacagccttaaaatagatcttatcatgaatttgtcatataatataagaaaatagggttaattacttctttcatataatcacatcttatttaattaattttcatccatccttatctccaaccaccttcactcgttacatattcctcatttaagtatttaacgagagatattatagtatattttttcttgtttacctaaacctctcaaaaatcctaggacattttatattttgtgatacttattaatttgataagttatgtcaaataaggagattctcactcgtgacgaaaaggaattggaaaattttgctagagggtcctgtgacttcgcgtttttagttgtagaacaccacacgaagtgatttttaggggaagacactttggaagcgtggaaattagctcatgggaaccgcaaccattagaatattaatttttgattgaataagagagaaatcatgtgaaaattatgaaattaccactgggcccacatgttaggtttgccatctctctatccctatctctctctcgcacatgaacccacatgctgcctgctgtggaaggagaggagctcttgcacgcctagttcattgcatcgccaagcacacaataacaagcctaccttcatcggcaactagttggaattggtgaaccattggatctgactatctgagtaggtgcagctccactttggtcccgttctgctcgtctaccaccacctgcgcctctggccggtcaccgccccaagctcctccttgcatggcgcctgtgggttgtggtaagagtcgtccttcgcacgcgatcttaggtctccaccacttgtggcgtccctgctttcaagacccattgtcgggagctggatcgtcaccctctgactatcttcatcacagtcgcacacccggggggaatggagcccatcctctccatgactctgcttactcccatgtcggtgcatggtttgggccccccctccctcgctgcttacatgctgcagcgtgaaccgtgtggatgcgccacacccataggagcgcgccgatgccgagtggactatgacagatgatgtcgagtaggagctcatctccttccacgatccaccattcccaaccagcatctagctcgcctcgccgtcgccggtcaccgagacactctctcacctttgcctcctgcgagagtgagaggaatagaggaagtagatggggaaaaagatagtagaggcttatatgcggattccatgtacgagagagagaaggatagagagatggcaagcctagcatgtgggcccatgggtaattcagaactttcacacggttttttctcctactcaaccaaaaattaatattctaatggtgtagtgtccacgagctaatttttatgtctatatggtgtcttccctcaaaattaactttgtctgatatcctacaggtaaaaccgtgaattcatgatgttgtctagcaaaatttgctaaatgaattactacctttttgctaaaccaatactactagaagataattcccctgtcaggataaccatcggtcatttatcatgtcattctaatcttgtggctattttgctattggttcctcgacatcggcagaaaattatctcacgttagtttaataattttgcttgcagaagatataactttttttgccccagtactatttttcggcttacggattatgaattatatcacaggcatattattttacttaaaaatcataggcatattttactttttaagctcctaaacaataatttctctaaaaaatttctccatcagccctccgaaagaacatttttatataaaattttcagctttccaatattttatttatttatttatttatttgcgcccttaaataattgttatagactagtttcatcccacacccatcgtgggtcgtgcatcaacactttaggatggcggagaatggaaggcatttgcagtggtcatcagctagtcaagatggtcatttaattcaaacaggtacatcaatgccataaaatttctttgttttggcatatctagaacacatggatttcacaaggcaaaattaaaaagattaagataaagggaatcttttgaattcaggcaaaacaagattgaaatatagttaatcttctcaactcaggccaaaaattctcaattcactggtttacctgctcatagcaatcgtggggaaagtaagaaggcattgagtatgtgagttctgatggatacccgtttgatgtgcttcaggattcgtgcagtcgtcacatgggagtgatgtatagaagctctgtttaacaccaaacttcatctgagaaaattattacttcctccttttcacaatgtaagtcattctagcattacccacattcatatagatgttaatgaatccaggcacacatatatatctagattcattaacatcaatatgaatatgaaaaatgctaaaatgacattgtgaaatggaggtagtacaaccaataagtgaaaatgttactttcaaaacaattattttagacaggagagactagccagacagaaatacagaacaatttgggtaataatcaatgagagaagcagcttattaaatggtttgcctggtgtggaaatagccaacaatagtcatcttacaacagacaccattatttatctatagacacatatggacatcagactagtgtaatactacaagaatttcatagaagactacatcaacatatgtacattttatagccgagaagtaatgtttacgcttcgcagcaaatttatctgcatacaacaacacggtagcagtttggagccttgggagttcattccacgtgtcattgtgagctcaatgaatcaataacattagtaagttgatacaagaagttgatagtgggaagggaactcagcttcccagtttgaaggcatccacaaaaaggcccagacatacgccggctttccagtagttcaccattgcaatcaatgactggaatcgtccaggaggtctactcatcggttttctgtacataagcatgccaattccctctatggcagccactacaacaccagccacaagaacatcccagtcaccagtctgccctaggattgttgccaatgcgttggcggtatagaagccaaacagcacaaggaatatcttcgtgggggagttgcttctggcagagttcagcttttcaagtagttccctcccagcagcttggatgagccttcccagccttgttctaccaagaaagccaccatcatcttcgaagtcttggctatcagcattagatggtccacctgtttccaaggcaaatactggcttccatctagaattttcatctggtaactatagagtgcagatatcaagtcaactaccaaatcttctgcatagtagagatctgaagaaattgattgcatcaatcttttatcttttctcaatctctacaaaccttcagtcatgaagctaactagtaaataattccacaaaggatggacacatcagcaattcatctactcccatccccaaaagaatataaaattggtaacctgactagtcaaatcttcctaagtttgaccgccactacatagaaaacctatttatatttatcatgtgaaaaaagtataactaaactggctcaagaaatattttggcaccgcaatacatttacagttattttgccaacacatatgacattactatacaaattgatggtccaatttatgcacttgataccatatcatgtccgaagtgtcgtatatttttttaacagatggattacttttattgtttctatttttttattgaaaatagtttatgcatataataggtagataccatataaattgaaaaatgggtactatcagtaacaagattgactgtccacaagttcttattatataatgattacctgccaaattcttgtattttgtatgccttgcggcataataacatttctgtttgaagatgctaaacgagatctaggtaggctacattttgcatccatgtcaccttggagagcacaacttgaacccatgcatttcctaacaacgtgcggtgaaacctaattacacttcattgtctattccattcttttgtttgggtgagcccttattgaattccttttaaacagtcaataatccaacctatgtcaactgaaatgtatttcttcaagtgtccagcttatatcaacaaatatatgattcttcaatataatctgactgatagtcagcaaagatgcattgtataaatgattgaactcatcataaacataaaaagatgtactgaaagctagatctacttatcaatggtgccaccgagtagaaatgtgtatgcaaattaattgtagtagggggaaatgctgttcatagatttaaaactttcgtaaaccagctcctccaaaattcctgttgacagaaaactgacccaaagttctggacgagtccaatggaacccaattcccaattgatttttgggatttttttttttacagaaatactaggtagagaaattcaatacgctggagaagagaagagaagacagcgagcagcggcgtcgggggctaacctgagcgccgctccgcccgtcgtcgccggccacgagaggctgcaggtccggcggaggagcgcgcggccgcagagaccgccgggtgccggccgaagaggggcgcggggagggagggctccgcgccgcagcggcatgaccggcgggcagcggcgccacggggcctctgtcagtctcaaggcggagctaccgcgacggcgacggcggcggcggcggcggcggggtgaggcgatgcgatgcgaagtagcctgtggttgacagtttcgatggtctagaatcgcgccttctgttccgtacgtggatagttgggccgagaacttgttgggctggagcccaactctccagttgcaaaacgtacctgtgggtcagtggcgagtggcttctctccgtcgctaccccggggacgtcgcggcggtcaagcgccgcgaggcgggcctcgcgggcggcgtcggaggcggtgaggatgcggctcgggtggggagcggcgggaccgccagcccggcggcgtccctcagcgcgacgcagtggtgcgccgagctgtgcgtgtacggacggccggatcggcgccgacgacgacggacgagcactcgccaccgccgccgctttcttcttcccgtcgccgccgccatcatcctcgtacgcgtcaagccgcaccggccaactccaaatcgacgctcaagctcaagctccgccggccagggcggagagggagagggccccgctggcggcgcgaccggcgggggaggaggaggaggaggggaggggaggcgcgcgggcgggtggcggcggctgaggaggaggcgccagctcggagcgggaggcggcggcggcggcggtggcttggagcgggaggcggcggcgttgtcgagaacgggagcgagagacgcgttcggtcgcgagcgagaccgcgtcaaagggcagagaagatgacgattttgagggagaataagttcaccggagattttttaaagtatcttaaccaaaaaaaccaaatatttactcctaaactctcacaaaccgttcactggaggtccctcggtactatttttgtccggtttttctgacgtggcattctagttagcaaaaaaataagaataaatatgtggggaccacatgtaagtgacataaaaatgttaggtcaacaatcctagtcagcactgatattctaaatcgcttttttctttggcgcacagggggagcaacagcgacacgcatccgaaggcaggcggagcagggacgcggcggttcggcgggcgaggtggcggttcgcgagtgcgactgtgatgagcacggcagcgaagcggcggtggagcggtggtagcgggcgagcagcggcttcgggctcgggaggaacaggcggaggggcggcagcggtggcgcggcagcagctggtgccggccggagagggcggagatgaggccggcgggagagggggtggagcgccgcatcggcggtggtggttgagaggacgggcgcctcctccaccgctgcctccctcgcgggaaccgtccagcgcttgccctcggcgcgccagagcacgtggattccacggcagcgggcgccgcggcagggatcgccaccgctatggcggcgcatgtggtgtgaacacccgtcgacgtcatcagccagagcctcatggtgcaggggaacccgtgcccggcctcccactaccgcggcggcctcgacgtcttccgcaagatcgtggccgccgacggcctgtaccgcggcttcggcatgtccatcctaacctacgccccctccaatgtcgtgtggtaggcgacatactcattgtcgtagaagacgatttggaggaggcgcctatcccctcagcccctcctcctccatcgctgctcccccctcttccgccggcgtgacacgtggagaggatgggagagggagaggtggtcgacgggagatgactagatgggggaggggaaaggtggccggctgctgccgtgctcgtcctccgccgctctgcccaccactcgtagaccgttgccgcgctcgctcgccgccagcctcccacattcacgctcgccatcgtcactccgccctccgccggagagaagagagtaaagagaagagaaggtgaagaaaagagaagaaaaaaagatgtgcagctgacatgtgggtcccacttttttaattttattttctaactaagatgccacgtcagcaaaatcggacaaaaatactgccgagggacctccggtgaatggttttgagagtttagggggtccatatttctggttttgtgattaagggacctcaaaaaatctcgttgttaagtggagggacctccggtgaacttattccattttgagggcatgcacgtaatttcacgttggctggagagctcggctccgtgggcttcggtgacgcccactgtgggctgtctgagtagccaaatgtgtaatctggtttgaggccacattggattgtgtagcttgtggcttttgaagttctttaatctatttggagtaaattgaacccacagtacaacaacttggtaggtggatgcgatatagaacaagaacttaagatttgaacgttcgagtacagtaacttgacaattgggtgcgatctagtatataagaacctgatagttcgatattttggtgcatcaacttggctaagcatatgctagatgagttgtttcacgatgtcaatatgctattagacagtaatcctacagatattaccttaaatattgaatttaatctttaagaattatattacatatatagtttacatccaattatctttaagatttttttttgttttcttcatcttctcaaatattaactgaaatataataatttttacatccagtttaattgactttcagttatgggttattaggataaaaatataaatatgcttatacaaatccatgctagtatattgtcaaaataattacttaaaaatgaatctatataaaaaatttctccaaataattaagttgtcgcataatttcttagtttactgtatcaaaatcgtacctatcttaaaagtttttacatttatataatcatttttaaggtcttatactaaattgcacctacctattaagttgttatactagaactctcatttctcaagtagttcttataccaaattacacccacctaccaagttgatgcaccgtggatgcaatttactcatctatttggcaccctagtctgaacagatatagtggcgcattggtgtggtaggtggagagtggtgtgtttctatttctttaatgcccttgcaaattccctaatggtcccaacaagtcaccgaaattcaacgcgcgcgaaatgccaaaaaatattggtgctctgtctcatttcttcgcacaccattacaattttattttacagaacctttcctatgaccccaaatttttacactaacgggtacgttcacgtcaggaaaactcatattactgacggtatctcatccacgtcaaggaaaattccaattgttccgacggttttaaaggatcgtcacacaaattattttttctctgacagggttttggactatttgccactctcccgaatggcgtgttctcaaatgccactctcccggatgacttcgctattttgccaccggagatagaagatttcttgcctgtgtgccatttttgagcctgcaaggcaccacgtcactcgatatgaggacaaaataattgtcttaccctttttcttcatttctcctcctgtcattgggctccggtgagctccccgcctcgcactcctccctccttcgctctgctccttaccttcccggcccctactccattccactgcggccaacaccggcccctgtcttttcttttgtggcctcatcggtgcctcaccccatcaccgtcgacttcgcattcctcctcacagctcttctacactctcccccgatgtcggcggctgcgccaggtccaccctcagggcttcccctaccttgtcattctccacccagcgccaggaggtcggttcggcggtggtggtggcggtgtcaccggctcacatacagggaggaaggttggagaagagagacccgagctagaggaagaagaagggcaagacagttattttgcctttggatcgggtgacgtggcgctttgtaggctcaaaaatggcacacgagcaagaaatcttctctctccgatggcaaaatagcgaggacatccgggagagtagcatttaagaacacgccatctgggagaatggcaaatagtctaaaaccccttctctgactggtggttgcatgcatgtcactgagtcagtaaaattagcgaccgtcaggggtattctaatttctgatagtgtaatagaattaaacattctgtgagtgtatgatttaaaaaataataatttaggagagaagagatgttaattaattgtcatgcatgtatttatgttttatattatgaaacacctttaaaaagcatgtgtcctatattttggaatggaggagtactactacatgcaagcgaagatcctacaattcaagcaaagcagtccactaaatcgccgctcgctgtaattgcgtaactaatgatgccgtcaaacaatacatgtacgcacttgattctacaagaactcagaagaaggctgcactacttgcagtttgcagccatctcccggctagagcgggcctggaagacgacggtgggctcgccgaggtcgtcgtcctgaagctccccatccacgtgtcatcgtcgtcgatcgtcgccgtctgtggcgtacgtcgagcaggttcaggggtttcctccgtggcggcgtcgatcaagtataacatgggacactttctcgtcagcccgagcttctgaatgggtcttggattattatttaaaaccaccatgtgtgacacctcatttgtgcttttttttaaaaaaaaaagaaaaaagaaaacagcatcgatgatataattaagtacagactttacaaataagtgcacaaataaagcgaaagggcatatagtatagtggttgcagttatctgagtagcaccccaacgttctaagttcaaatcattatatgagtgaattgtctcaatttaaaatgggaaaaagtacgaattaccccctgaactattgtggttgattgaattaccccctaaattcgaataccaaatatttctcaccctaaacttttaaaactggacgaattacctccctactccaaaccataacggttttggtcctacgtggcatccatgtggcgctaacgtggcaatctaattagaaaaaaattaaaaataacataggccccacatgtcatatggagtagtgcactagtgctaaattgctaatctctctctctctttcttccctctagggtcgcgggtgcgacgtgatggggcgaaaccagacgctgtggtggggacgacggggatggcaggagccgaggaggagctgtgctcgccggcggagaccaaggaggagctgcgtgccggcggatgcggatgaggaacaacgcgtgccggcggaatcgaggaggactcgtcgcggtagaccactcccacttcttccaatgccttcctcggcgccgctcgttgcccgccgcgcaatcctggtgatgccacagcccaccactatcctcgctgcctgtgatatcagagagatgagagagagagagagagatgttgtagccctccccgcgacgcaccacccgccgcctccagcgtcctcctcggcaccacccaccgcccaccgcctccactatcctcctcgacgcggcctaccggccactgctccttccccgttacgcgacaagcttcagcggcggcgtagtaggattttgcgcgaaggcggcaacgagcccgcctcggtctcgagctccctttgcgacagcgggacgtggagcgaggcggcggcggcggcgggatcctccttccctcggtcgcccgagcgacctccgcctccgccgctagcaactgcccccgccctcgcctgctgccattcttggtgtcgtcgtgtgctggtgagctggtgaggagaggagggagaagatagagtggggggaaagattgggatagagatagggtagagagacatagagaggagacgagaactgacaggtggggtccaccgattttttattaaacgaattgctgactggacttccacgtaggaccaaaaccatcgcagattgagctagggggttatttgtccagtttgcatagttgggggtgaaggatgtctgattttgcagttcggggagtaattcactcgaccgtgatagttcggggggtaattcgtactttttcctttaaaatggctgcatacattcagttacatgtgccggttttatttagcaagcacaaaatggatgacccgagtgcacggtgtaggggaaaacatcttctgagtgatcttaactaggggtgggcgttcggtctaaccaaaaatttcggtatcggtcttcggtttttcggtcatttcggtttttgaaaagtcaggaccgaatttcatccaaaaaaatcaggaccgataaatttggtctcggttttttcggtctcggtctcagtctgaccgaatttggaggagccgtgtaacatcctcaaattttaacctaaaatttgactgcatcatgctggcttttgattaaattagtgtgttttaaaaatctatttgattcttaattggttcaagtattacttctttagaaccctactaatttactctaattattccctttactccaaaccttagtgaatttgagcaaattctctcaaatttcaaactatagattattttcttagcttaccctaatattagtgaggatttgctacacttcaaaccctagtgaaaccctttcaaacttatagtttaaattcattctttcctagggaaatattcaaaaattcctaaatttcactgttcatcgcacacaaggtgctcgatgaaatgcccagcttagctagagcagcccaaccaccacccaatcttgtgcaaagtctagaattgatcctaggggaccacaccccactcaaaaaccgtggatttctttgcttcttcctccccttcacacgcgccgcgcgggcatccgacttagccgcgcgccgtgtcgccacgcgtcggcctcgggaccgcttgcgcgtgcccgaccgccttggcgcgccgtcgcccgtccgacgccctcagaccgccgccgccgcaccaatcttgacgacgacaaagccgggatgactaccgccgcaagaaatcgtcgctcgacgccgtgcgctccaatccaagccgctgtcgagtgcgatttcgcttctacccgggatgaatcgcgccaattctttccacacggttggattgaagatagacggtggtatcccctctcacaattcaaaccattcacccccgagtcggccgttttcaccctcgccgccaccgcgcgtcgtgcccggattggcgccaacacgtcgccagccgatttcacacgcggtcaagccaatccttcgctggtaagtattcaaacgtggcctcctgccactcaaagtgatcttggccgccctctcgcagcctctgctgccccagccatatccaatctttgagctcatccatggcgatgacggtgttcgagctcatccgctcctcctagccctataaataggaccccaatcccttccttgtccatcatcgatcatcaacaaccataaccccacaaccccgaagctctgcttcaccaatccatctcatcaaccaccatcgcccgtcggtcgaacaccttgtgcgcgatcgactccacacccctccatccatcctccgccctaaatacctcttagaacaccttatatcaactatgttctagtatattagaccctaaccgaagccctgcatcgagttttacctcgccgcaccaagccgagcaccgccgcccccgcgctgctctattcttcgccgccgagaagtttttccgaccgtaatccttcatctcggcatatctcggtgagttcttccgtttcaaccatctatgtactccctagattccattttagcaatccctttgcactaccatgccaccctctgggctgccgacgtgagcacggccaaggcctatggaggcgctcgtcggcaagtattctccgcgccttgccaaagattgacaagctatcagaatctatctaggtacctcgtagatgctctagaacccctcccctagccatgtctaactcatatcacctcgatcactattacggcctaactgtaccaccgccgccctagtcgctagcctatccatacatcaaattaacccctccgccgccgctcgccatcgccggagaaccccagctccctcccctccttggctgcaacccctttccccctccatcgccgccgtaatcgctaaccctagcgccgccggcccgatttggggaacggccggaggtagaagaagagaagagagagagactaacaggtgggacccgcacatagtaacatttcacttttagttgattttcaaactttagaagcccatatcttttaaaatatatatccaattccagtgaaacttggaccaatattcttctaaaatcattctctatcttttgagcccctttttgctatttttacattttattttattttctctatttttcttatttttggatttaatttgaatttcttttgaatttgaattttatatgtctaaccctaggtcttgaggattcttctgactcaatagataatatcaatcaatctcaggacaacgagcaagggaagttaccatataccttttgatcatttaagcctatattttacaaattatttatttatagccttatatccaatattctattttctatgcataaatcaatcatagaaacccagataatttagtattgcttactttgcttacaatctggttaaaataccttatacttagattgggagagtaagtaagatttggttgatttccgggtggctagtactgtctcgatcgatataagttttaccaggtacttatgtcgaacgaacgggtacgaccgcagtttctagaatagggacatacctagttattatgttaattagcaatatggcacctctgtatagtggttcttatttttaagtcctcacacaggaggcaactatagccgcgaagggcaactttaaccattaccatgtacaggtaaatggtttgtgatagtcgactataaactatatggtatatttctaaaccctgatcgagatgacgtggtgtcatatgatcagttccccttaaatacctcgggaatgccagaactcctcttgctgctgttaacaacacatttagagcatatgaggatatgagttcatggaacaggtgccacaattgttaatgacttaatattgggccatgactaaagccgatgattatcagcaagtcgtggactgcgggtaaagcgtacatctgctgcagtagaatatctttgaaactattcgaatagccgtactcatggagttgagtaccgggactcatatggtaccctggttagaaatctaaagtctatatgttttataaattctaactataactttcctagattgtttattactgctttttgcaaagaaccctactatatactaatgcataacatatttccatgataacttactgagtgttgcgaatactcatccttgctcttataacccctttttcagatctgggtcaagagaaggacccttatgactattactatgatgaccctgataacttagagaatccctaaaggtcatatctccctagtcagaatgtatagaaacttctgctgtgtattaattagttaggtgagtacctattattataaaacccttagtattgtaaaactttaacgtatgcaatgaagaaccagttatactgtatatatcaatatttactgatctagggattgatacattaattctagtcagatccaagtttttagtttcgggctccgacaagccaaggcagggccagctgtaggtggcacacgctgtcgacgccgatacggtggtggtcggtgggagtacggtcgtggtggaggcggaggatggatccggcggccggcgaggcagcgtggaggcggagggcggagacggcgccggcgatgtggaggcggaggtggcggcgcggcgcgatggatccggcagccgctggcccggtgcgaccggagaggcggcgcggaggcggagggtggagacggcaccggcgatgtggaggcggagggcggaggcggaggcggcggcggcggcgtgggatggatggggatgcggagggctgagggcggtggcagcggaagcgtggcgcgatggaggcggtggcggaggcggaggcggtgcggccgcgcgggatggaaacgagggcagcgcgatggggatgcggagccggagggtagcgcgatgggatggatggggatgcggcctgcgggtggcctctagggtttagtgatgtattgggcttattgggcctcctagacctattgggacacaattcggtttctcggttaattcggttaactgatcccaataaccgaattacccgaacaaatttcggtctttgacaggctgagaccgaattactaactgaatttctcggtctcggtcttattctgcccacccctaatcttaaccacctactctctccatccctaaatataagattttgattggatatgacatatcataatacaacgaatttggatatactccctccgtttcacaatgtaagtcattctagcatttcccatattcatattgatgttaatgaatttagacatatatatctatttagattggaaaatgctagaataacttaccttgtgaaacggagaaagtactaccgtccgtaaatataagggattttggttggatgtgacacattctagtacatgtgtcatatctaacatgtattaatctaacatgtattaaatctaaccaaaattctttatatttagggagagagagagtaatctttttatctctcaaacattctgtttgctctttccccagctctctcaaggcccagccggcggaaattcacgttgctcctggtgcattggacaactagttttagaactgtaccgcactaaaattttctccctcgaaaaaaaatatattcacgttgtttttctgtaccttctacacgactcacgaaacagatcggccggagaacaagccgatgcaagtaggggtgggcacaaaaataccgaaccgaaagaccgaactgaaaatatcgagaccaaaaccgaaaaaaccgataccgagaaattcggtcatcaattcggtcttaggtagtgaaagaccgaattttgttcggtcaattcggttagtctcctcgggtaaccgaatagaccgaattatcaaaaatgtctaaatgcaacctataatccagtatgtttaataggattaaactctaattttcacatccctacttcttcttggcatgcaacctaataggagtctttactcatgagtgcttacgaattttttttgtgatttttgtgttgaaaaattccattatttctttgcatatatgaaaacgttgttgaatttcggtcaggaccgagaccgagaccgaatttgttgatcctgacatttttcgctgaaattcggtcttcacttttcaaagaccgaaaagaccaaagaccgagatcgaaattttcgattggaccgaattcccacccctggatgcaacgaagcagtgctactcaaagtaaacagtccgatcgatcatcaatcatgccagaaatttaagaattcaacccagcgtttcaggccgaatataatccaaaattttcaaatcaaccatctactactccgtcataaaaaaatacaaactctagctacgaatctgaaaatacgtgtctaggttattaattaggattagactttttttttgagacggatagagtacatatgcaagcaaatactctctttgaccttaaatatttaacgccgttgatttttttaaatatgtttaaccgttcgtcttatttaaaaatttaagtaattattaattcttttcatatcatttaatgcattgttaaatatacttttatttatacatagagttttatatattttacaaaagtttttaataagacgaacggtcaaatctataactaatataaatattcggatttttccggtcgtcacctcatccatacggtgatttttcgtccctcccccccaaaaaaaaaaacctagccggaatttcatcatcacacaagtagaatcccacattgagcacaccttctctccaatctcaaatcatcacaatccaaatccaaatcaaaagctaaatcccagtccaaatataaatcgaaatcattagaaaacatcatattaacacgagatgactaggagagggaggggcgagccggaccggaggctgcagcgcgttgctgctcgccacctcgccgtcggccacggacccacccgccaacgccgccgacaccgccatcgccgccggatcaggggcaggagggaggcgaaaggggagaagggagccgccgccggccagcgaccgccaccacctccggatccaccggcggctaccacagccgctgccgccaccacctcgggatctgccgagagagtggtgcggcggccaccgctcaacgaggagagaaggagccggcggtggggagagggagcggcgccaccatcgccgcgccgccgcagccgtccgccgcgagggagtgtgccgccgctgccaccgctgctcgcaggagggcagggcgccgctgccgccgtcgtcgccgctgctcagtggggaaggccgccggcggtggggaggggggcaagaggcgtcgccggttggggaggagcgtagagaggtgcgccggtgggggtgtggtgcggccgccggcggggagagaggcggcctgcgtggaggggaggaagggaaagaatgaaattagggttaaggtttatttgggttaggggttttgatagatttggagtcgatctgagccgtccatcaaaacgaacggcttagatcgctcccgcgtcggaccggcctccatcatcgggctgcatcagtgatgggctgcacgcacttcatgggccgcacttaggtcggccgacccaacaaaaacttaaattagatttccaattaaataattgttaaataatgtttgtattattaaaattagcaattaagctctgaaaattccaataaaatttcaaagagcgaaactaatcatggagaatttaataaaattaaatttaaccatatcattttatttaattatatacatacctacttaaaaataccaaatattttagtgaatttatattttaattaattgcatattcttctgctgtacgcttcccgttgcaacgcacaggtgcttttgctaaaccaaacaacacttttggtcaatatacacactccgtaatcacccggtgcaacgcacgggcacttttgctagtatatttaaaaagattaacagtatcaactatttaggaacggagggagtatatattttacattcatcgagcaaagctactcgatcaatcagccattcagccatcgtgaggtcaatcgaataatcccattaaacaatctacatgcatgtatgtactcaagattcttcataaatttcagaaggtttcgtccgtgccgtcagtcatgtccacctgttcttgccgttgcagttgctcctcgtctacgtcgtcgccggcgagcacggcggcggcctcgtacgagtcctcctccggtggcacgtgctctcctccggagccctgcgccgccgcttcttgctcttcctggcgcgtgctgccgtctgcctcgccgaacaagcggtacaacacgcgctgatgctccggtgaaagctggttgccgtcgtggaagtccgctgccgccatgtcatcttgttggtgctcctcctcgtcgtatgcgccgccgtactcgccgtccatgtaatagtagctgtcgtagtacgtgtcatccgcagcaatctgctctccggagatctcttgcgccgccggcgtgtcgtcgtcgtgcgtgtagctctgatcatctgcatctgcctcgccggagaagtgccggggaaagagctccaacaaaaccggtcgtcctcgtccggcgccaccttcttccgccgccgcagagtccgcgtcgtccttgcctgcgtactcctcggtcgccatgagtatcgactctgcgtgctcctcccgtcctccgcgacatcgtcgtcgtagcatcgccccggcgcgccgcgagcgtcgccgacgtcgacgtcgtcctcttcggaagcacggaggcgcttccggcatcgcacctcgccggggtccaagaacatgaacaacgagtgatcttgctccagatcaccgtcgagttcgcggccgtcggcctcggggttcgatccagggaaggatgcctctgcatcgccatccagaccaccgtcgaggtcggcggcggcgttcggttctgggaagtagggtggctgaggcagaggctcgccgtggagatggacgatgtggtcgtcgtcttcggcggggggatcggcgttgaggtcgcgcaaggacggcggagctggatccagtggcgaagctagagagaaataagggggtgcactacatcatcacatataaatgacaatgtacagaattttcaagcaatattatactagttaatatatttttcaatagtctcattagcatagcataagtggcgatggtacaccgacaaaggaacactgacaaaaagaacgtaccataccgagatgaataaaaccactaatatttggaaatacaccacctgtcctcaatatcttgcaacaaaggataatataaacatattaagtttccattgtaaactatagaaaaaccatgtgaaaacaaacaaattaccttttcataaatcataaattatatttgggctctgtcatgttcataaaacgatgaaccacagcttcgttggtgactttcttcatttcttctttttctatatagcaaataaggctatgactcaagtagtcatcaccgatgcgattacgcaaagaacttttcacaatcttcatagctgaaaaacacctctcaaccgtcgcagtggcaacaggcaatactagaactagcttcaaaagtcaataaactaaaggatagcaaagatgtttccttgtctctaccaacttttgtgaaagctcaccaatagtttgtatgttggagaatctatcatcttctcgcacatcagcggtgtagagacaaagatgatgcctaagatctcttaattccccagaattaaaatcattaggataaagttttgctagtctcatcaagttctcaacattaaaatcatggaatgattctcttgggctaaaggcagctgagcaaagaagcaattcagatgatgtctcattgaaacgactatcaagctcttgaagtagccaatcaataacatcattaaaacaatccacttcataatggtgttggtttgtaattcctgtcttttgcctctgtttctttggattgacatatgcttctcccatctcaagcttgatgatatcatatttgtcacaaaaagcatacacatcaccaagtaaattttcccacccatctcttctcaaatcatccaaatggcacctagttgatttgacacacttaacagcattcacaatatcttgatctttcctttgcaacgctaatgacagggtgttagtgataattaatatagttgacataagatgcaaatagaagacaaactcaaaagattggaaatacactagaagaccatttgcttgatctctatttgttctatctttgtcatctttttccacaaattctagcactttgactattgttgggaacatgtcaagcaaacttttgagagttttgtagtgagaactccaacgagtatctcctggtctttgaaggcattgctcttgatttaacccagttccagtttgaagcatcccacaacctaatgccttgcatatttgttcataatttatttctctaatcatgtctcttctcttagatgatccacccaccacattcaacaaagtagatatcatagtaaagaaattactaatgcctttatgtttttctcacaatggctacaacaactaattgaagttggtgagcaaaacagtgaacataataagctgaactactttccctcatgatcaatgattttaatccattgaactcacctcgcatattgctagcaccgtcatatccttggcctctaacttgcttcaaactgagcttaaagcctgcaaatagagaatcaatcgcagccttgagataggaagaagttgtttccttcacatgaacaacctcaataaatctctctttcacaaatccacacttatcaacatatctcaacaccactgccatttgttccttgtaggacacatctctagactcatcaactagcaaacaaaacacatcatgcccaagttcttccatgatagaatgtaatatttccttcgcaaaacactcaacaatgtccttctgaatatcagaagatgtcataagactattccctgctccatatttacccactgccttccctaaagcatgatcatgctctaatagcatatcatgaaactccaagaagttccctttgttgtaggaatccttggactcatcatagcctcggaaaggtaatccttgcttcaataaccttctagcaacactaattgaaccatttaaacgagtaaaataagcctttttagcatcttcactttgaatctgaaaagcaacattaatatgttgagatgtttgtaacaaagcatcacaatttttcattgcttgattatgtaaactaccaactccaccgacatgctctttcagcctgctttttctatgccaaccattccaaccttctgtaacaaatgctttgtatccatcctccttcttattgcagtctctaaataagaaaaaaaagaacaatatgctttgtctttggcctcactatattcaagccagccaccaaactcatcaaaccattccgggataaagcttctatttctgtctgatatctttgtagttggaaaattgagtgtacgaggttggcaaggaccattctctaggtactttcttcttaccctatctctcaggttaggatgataagcatcaatcggtttcctcaatccaggatcatatttgatctcctctttccaattgagatcatttacttctggacaggaagtccttgcattgttgctgctatcaggcacttttcttttaaggtaattctccataataaagttcacctatcattcatagcactagaaattataatatataactttaattttactccaaatcaccaaatgaccaaaccctaaccatttaaccaatataatacgaagaatcgggcaatcagccaagtaatgaagtaacctgaacatatctttcaaatataaaagtttacttacagcaaatcaaattaatcttaaagaatttgagacttgagagcacagtggaggtagaggtcttaccttgcctattgttgcgttgccctattgtgagcaggggcttgattgcttgaattaatctccagatgtagtggcatgtggccggcgaggcggcggcggcggcgacgacgacggcaacggcaacggcctcgaccaccgtcgaggtcggcggcggcttcggttctgggaagtagggtggctgaggcagaggctcgccgtggagatggacgatgtggtcgtcgtcttcggcggggggatcggcgttgaggtcacgcaaggacggcggagctggatgcctggatccatggcgcggcgcgagttgttgatcgagcacctgcgcgcaggtggatgcaggggcgagaggttggaggaggtgggacgacagaaattcaaatatataggtgcgccatatgggcttcttcctcgtgtcggagtcggagtcggagtccgtattccatggggtcattgaactatttggcatttaactatttgccacccctatctcaatgacatgtgggtctacatgtatctatgacatgtgggtccaatggcaaatcgttaattaccacatctaaaagtgacaaatagttaaatatctcgtattaatatcatggcgagttgttgatcgattgagcatgagagggtgggtggggctaacgcgcgggtgatcgcatcgcatctccgtgtcccccgggccccggctatgtgggtagattgattttgaaaataaagttgggaatatatttttttaaaaaaaactacaaataagggaaaattaattctttctaaaaatatacattattcgtataaattttacccatataaaaaatatatatgcagaatcttctgatatagctccattctgaatatataacatttgaatccgaatcagaattcaaatttaaattgggcatataaatttttagagcataaacttttggtatataaatttaggagtactcttgacaggctataccgtcgagtatggggatagttggtggtaaggtatggacgagattgtggtaaaagagacgacggaagatcgtgatttttatacacgttcaagccctctaattacaggttttctgtctataaatgtcttaccaaatccatatttttggattatatttttctaaaactagaatgcccctttcatatttatgtgccaacttattgagaaacacagttctcatgtgaaaaattcattcataaaaaactaaatagaatcatttggaaaaaaataaaaactaaaattttaaaaaaatttcaaatcatttttttgaattcatacaacattttcaccaaaattcgagaacaggtaaaaataattttagttttaaaattctcagtgaaacttttgtatgaattttatcaatttttaaaatttgttaaaatatttttttcttttcaaatttgtggtcaaataatattttcctttgattttattataactaaaaatttcacattcagatatactccaccgtttcatattatataatgttttgacttttttatagcaaacttcattgagtttaaccatatttatagaaaacataataatatatataatatcaaattaatttttatacattgaatattatttctctaaaaataatgatatgttttttataagtttgaccaaaattaaagaagtttgacttataaaaagataaacatcttacattaatataaaacggatggggtgtattcttaagtaggtagcgcataagaaattcagaataggagaagaacaatatagttattttaaaattttgtagcagtcaacaactgatggaaagaaattcaaaggcatatagccaccggacaaaactttatttttaactaggaagatagcccgcgcattcgcgcgggcatgtgcattagtttgttccgaaaatagttctaaaaaataaaaaattaaagtaatgtattttctactgttaattgattatttattatatctctttttcgtgaagaaatctcgacaaactttcattggtttgaaatatatttttttaccattctgctagccctctctttaattgcttcatatacatgcaatttttatgcatgtgaatcaataaagatagaaaatttcttttaaaaaatatttattgtattttgaatttagtgattgagggattcttaattcgactttgtattcaaatcaaattactttattctaaattgtctttttagggattttaaattgcacttaatctcgtatcgtgggggcttttaactatttgccattcttacgagtggtgcttaacgatttgccattaggcccacatgtcatagacacatgagggcccacatgtcattgacagggtatggcaaatcgttaattgccatgtcacaagagtggcaaatagttaaatttccccgtatcgtgctgtatttgatctcttcttttaatacttattttattattccaaattttagatatttataacttatacttttatagtgactcttgatattttatattctacatggaatcttgttatatttttttatagttttagtgtttttttaatttttgtttgtgtattttaatcaaattgtttgttttatatttttgttctgaatttaattacaaactccttgtggtgatccgcctgtcaccatcagcctcgcggatcattgttgacctcctcatcagtgagcctctcttgatacattagacaggacgtggcggggctcggtggcaaagatgaagctattttctagtccttgtcgaagacatggaacgtctcctctgcccctcccccccccctcctcttagtccttgcccttcatctaatcatttagtgcgttattaggtccaggaacttgtagaagtcgatgatgccgctaccgtcagtatccacctcgctaataatgtcttgtagctccgcttcatcgggttcatgcccagagtttgcattctggttccaagcttcttggtggtgattgaacttggatttagacccacacatttgaattcattcatcattttcgaagtgctattttgctcaaatatttgtagtcagaatagcagcattatctaacttctatatagtaaatatgggcaatatggatcttgaatttaattataaataatacaaaaagtcaaataaactgtgaaaagtacatgtaacttgagagtcatgatcatttagctattattatttttctatatattatgtgttaggtagaaaataggataagttatattaaaaataggatatgagaattggatcctagagatgagtaggacggtggaggtacgtacgtacatgcatgctcacatacggtaggggtggaggtgggggtaccggatttatttttgtgagatgtagcagttataattattggatctacctatttaaaggaaaatcaatggtttgatttttttatcataatttctaggaacttttaatttatttgagcactatatggtgtcttatgagtggttttagaaaaccatgtgacagtttaagaggatctgtagggagtttaatgattttttagtatataatagatagttaatatagcattttttggttctttatgtactgaactgctcactagaaaatatggataagaaagtgagcaggagagataataggagatcatttacgatggcatgatatatgttactatttagttgcgataaaggggtttatgtcaaatgatatgtttcttatatatgtacataccaaaatatggtaaacatagttcaaattaaaatcgaatatattataagatattctaattatttagttgttgtgttttttatatataaaattttgctaccataaatggaatgaagaagagaggggcggggagacatacgtactttggatgtaggtacatgttaggagatgagggacctagggagaggtgtggacgtacgtgacatttgtttttttacatatatagatctaatggtgtgtaaagagaaaataaatggtacgatgttttctttttttttctggaatttcttagatttctctaatttatcagagcgtcacgtggcggctcagaagcgtttgtaggagccacatggtggcttaagagtgtttttaaaaagtttaatggacttactcgtacgatgtctatttgtagggatttttttcataaggatagaaaaagaagaaagaaacaaagataaaaaaaaaagaagggaagatagggagcgtacaatacgcatcctgcacggaggtagggacggcaggagtttttttttccgttaaagataatctaatgatccaaaataatgagcccatctatttaagtgaaaatcgatggtcagatttctctattttattagaatgccacgcggcgactcgggagtatttttaggatgccacgtggcggtttgagagtgtttgtaggaagtttaatggtcttttagtatataatagatagataccaacgagacaaaactcaaagatatgaataaaatagatagagtgaaactcatgaacatatgaccaatatatgacaaacattcctagtctcctagccaataacttgtcaacatcttttggtactg

SEQ ID NO: 8746 - DNA, 770 bp, Oryza sativa
aatctaaatgttaagttgctcaaaaagaagtaatcataattcatgattgacctggagttcatactaagggaacataatagtacatggcaaatttgtttgcctatcactgacctgctgaggcctcataatcttagtgtctggatcatcaagtgactctttccaatgtgctaaccaaccagccatgcgaggaattgcaaacagaacagggaagaactctgtagggaatcccattgccctgaatcaacacaatcacaattagctactcaatgacaaaaggagagaaaagagaaaaacagctttcccactgatgtacctatatattaagccagagtaaaaatccacatttggatacagcttcctcttgacaaaataatcatctgacaatgctgccttctccaacgcaacagcaacctgacatggcatcagaaaccatcacaaaggtgtattggatttatcaaagtgttattgcagttgcacacagataaccatgttgttcagaatcctacttcacgaacagaaaataattattgtagttttttgttccattaggaaaaggtttggaagataacacagggtagttaacaaaaatgtgacaccatcaatcctcgaagagtgctagttatagcctgcttgatatttttgccaaataactttccagattaatcaatcaaatttcaagtattgtggaaaggatagaatataatcctaatagttcttgggattcctctaatacgatggatcaaatgatcaaagccagcaaccaaaatatg

SEQ ID NO: 8747 - DNA, 13050 bp, Oryza sativa
ttatttatttatttttcatgcttataagtcaattagacatgttataaaaaacattatggtctaaatcatgtccactgttttgtttaaacaaggttaaaagtatatgttgtgtccatttcctcccatggacctatggtccccacatgtcagttggtaaggtggtgacagaaccaccaccatcgccgttataactatcaatttgctacatggtagaaaaaatagaaacaacaatgatttaagagtgcatataaacaagaaacattttaatttatgaaactcatattctaaaaaaaatgtgtttttaagaaaaaaaaatgaagcgtatattttaaaaaacatgtgttttaagaaaaatcgaagtgtatattttatcctgtttgatgaatgtaattacttttttcacacaagcgtatattatttcctatatttttatgagattttaagggaattgaatttattatttataaaatagttgttcgatttaaatgcactttatataatatgcacaggtacaaaataacgagcgcgtcaacagacgcgcttatattctagttacaggaaaaggattgaacagtaaaagactaataaatctgtttgcgtttattcaacattgatcagatcaagaaagaaactaatcagaagtattccatccatctcaatgtgttgtgcaaagtccatattcattcattgcaaataaaatgtagacctactgtttagaaatgaatgcttcatgttcccaagtacatgtcatttagcatcctatagtgcctgacaaaatctggttcttgggtggtgaatgcaatgtgaaacattaaccaaatatttcactaactgaatgaaggttacatacatacagtcatcataagctggacttcttgaataaagaaattcagcataactaacctcgataagaggatcccgtccgacaatagagaagacctcctctgctagctttcggatgactttagcacgggatcataattcttgtaaacacggtgcccaaaacctgacatctttctcttcctaaagaacaaaacagatctcataaaaacaagtccaaacatatagatttaaaaaggtaaaagcttaaacttcattaaactaaaaaagacctccatgattacatttcagatcagaaaatataaatcaggacaggagttatatattacctgtttttcactccctcgatgaaatctggaatattctccacacttccaatttcatttaacattttaagtaccgcctggcatgttagaaaatggcattagtgcttctgcatcataataattgagtaatgccttaattacttctaaaaataacagatgtagagtcaaggttaaagcgaaacaaaggttttagaactaaattttcaattatataaaaaaatccaagaaaataaaaacctctctatcaaggaggtgacttatttacattgttaacagaacaaatttatagagtacatagactgtatgtctttgttacttgtgagcttgatccttagattctgatgatgaatgtgtatataaactattagcagtccaatgcaagaaacaaaagtgacaactgctcattgctcagcattgtttacctcatttgcaccaccatgcagtggaccatatagagctccaacagcaccagaaagagcagtgaagacatcaacaccactgtaaacacaggataaataatcaggcaaggtcagactcccaattcttagaatgaatggcattatctaccttgaagcaaggtgcctagcagcagctgtagagcagttcatttcatgttcagcatggagaataaaaaggatatctagaaccctagcaagtctaggatttggcttgtattctttgtcacccctgcatcacagtcgaaaaggaaaatgaagtcaatcacaaaattgaattgcttattgatttctaacaaaagaaaaatgaaagagcacatgagagaacagaatacaaataattccaaagtgatgtgacttacaaagagtctagcatatacaagaagttctctgaataagagagactatttgtaggaaggataggaggtcttccagctaatctcaagtacgctgcagctgcaattgttggtgcctatacagaaaatcaagttaatattgcatcaattattagtaaaaccaaacatatataaagctaactgctgggctttgcccggcagtgcttgtttccggaaaaataacattatataaatctaaaagagaaacatcattgtgatatgcatcatgaccttccatagaatatctctggctattttatcacttcactaattcaagaaagagggtgtatcatttaactgggaaattatcctcgattaacttcactagtacaagaataatcggatttcttaagtcataccttcccaagtactcgcacaatctgcttatccctaacctgcttcgacttgtaaagatcttgaccctacacgagtacaatatatgtcattaacaacagcaaactattacacataacagatggtgcatacataattcagatattaaaaaatccaatttttggctgattctatcatgttaagtaaaatcatgtgaagaaacaactagctcaattagtgcatttagagagtgcttactctaagagcagggtttgcatccggatggaagacagaaagcgtgctcattgcactggcaagggcacccatgggatgagcgtcatgaggcattgcttgtatgatatcctgtcaacgttaaaagaacaccaagccattagttattagtacaaattaaacagaaaagctgtccatatatactgcaatgatacacaataagatggcaaaacataccaagagtccctggggaacagcagagtgctgagaaatcgcaaattcccatccagccaattggctctgggtaggcaaacttccgtacactgcaagagcaaacatgttttcaacaacaaaaactacatttgcattaaagaggaaataaaggtgcagaacacttactcaggaggtaggccacctcaacaaatgagctgctttcagccaactcttcaattgggtatcccctgtaacgaagaattccctcatccccatcaatgtagcagatggatgagcgaactggggctgtgttgagataaccaggatcatagatcttaagacccttgtcgtcctttccaagtggtaatctgcaacaattaacccaaaaaaaatcctaattaactttgggatgatctcatatagcaaaggcatcataatatgcacagagcttgagctgtccacacattctcttgaaattttagtcctaaaccaaaaggtagtgaagtaacatttgcatagttatctaataattcggtagttgcattctagtttgttcgcaagaagtacctgccaatcaagcagaacaatttactacaactacgaagtcacatgcaagcactagaagatttaggataacttcattgtgaacaaacgggtaagctgcgacctcatcgaagtcaaccaggataacaattagaaatcgccacacctacatccatacagacactataatgaggaactaaactcaataatcatgctagtttcgactttctgacatctccagggagaagatttgtccaaaggggggtggcgattgggcgaaatttacacatcggttttgtcacccaatcactagcagcagacgaaaattgagcacaaccaagatcgcaatcccctaatccaagccgattccacagaaatccagcttgatccaccaaccaaaacccgcatcccgaaatcccgcaacaccccccacataacccggcgcggatcacggcgcaggtcgcggcaacgaagaagccagcagtaagcgtagcgctcctaccttcttgaagtcggtggcgcgcacggtcccctcgtccgacaccttgacctcgtacctcttccccgtcctcccatccaccaccgccagcgcgccgcctcgcgcccccgcagacgccgccgacctctccagcggccccgccgcgtccgcctccccgcaggcggcggcgggggaggcgaggtgggcggagagcacggcgaggcgggcgcgatccatcggcgaggagagcagagcagagcagaggtgggcgcgggtggtggttgcttggacgactcgtctgcgttgggttgcaggttggggtttgtttgggtttggcttccgctttgcgggaattatcgagtcgtggatgctgctgctgttattattgtggggggagatggagaaggtgcaggaccactgggggcctcgtggggggatcagatgatgatgacgatggtgatgacgacgacgacgatgagatttgttttcggtgagtttgcacgtcttacggtttcattttcaacgcgggcttctatttgaactcttattaaaatacatcttccaattacttaaacttattatgaaggttattccaattctaaattgccacgattttcttgtgtcatatatcacgtgggtgctaattctttttctccttttatttttcttttttcaaaaccaccttgagtaataagaacggttttacaaaatttagagggttggatgtccggttttaaagtttaaggcgttaaacggacttctatttaaagtttagaggggtatttggaaattttccattctttttctccttttatttttcctttttctcccctttctcttcttccttcctcttcgtgtgtaagaaataaaaaaagaggggaaaaaaacaaaaacatagagaataataatgaaaaaaatgggataggaatgtgtgtatgacataccatgtcaatgttatgtaagatcgggtaatttgaaatcagaataatacactttaacaagtcatggatctaaaaatctctgctacttagaaaaccgatatttttggtggtgagtcctgaacaatcaaacagctaagttgtttcctaagatcctcccacaagatcaacactccaaaatgcccaatccttgtatcgcgctccaaccacccattcgtgcatccactctcttcgcgctccgtcgcacgcgcgccggctccccttttgccgcccaccttccaaccctgctcccttcgccgccaccaaagtcgtcgtcccattgctcatacgcctctacccatcgcaccgatccacactgccaccgatgacgatttcctccgctcatcccctaaccaccgccccatccctcccaagtcaaggtacacggatgttcgcgcaagggataatttcaggttgacgtggcatattcgccaaggtgtagtttgttagagttttgtgtcgaatatgtgtacgtagtcggttgcaatttaggacttggagttgtaataggtgtttggactagagtaagagtcagattttatcttggttgtaaccgcaagacgacaatagcataggtatggatacgactgaccgacggcctagccgatggagggtcgtgaatacccggatacactgtaatatgctggatcggggaagaccgctcgtaatcagtgctctggggatgtaggttttgactgaacctcgttaacaaatatcatgcctcagtgtcgccttcatgtttagatcttctatggcgtttcttccacgttcggttttcgaggtatatatcgggctggttttataacagtgtgcgcgtgcggctgcgagggagaagggagtggggaggcactcgaatgactgtgcattacataatataatttgatggacataaagaagattaattagatcaccatcctaaagatagagacaacactatccacaattagtgaaaatcctgcaagctacatgtagtcctagttcaaacctaaaaacagactccatgaaattagcgcctgatggttctaccaatgagaacttgcgcacattgcacatcaccgccggcaacattgaaccgaattagaaggtatcatcagagtgtaactgcattgcaaatcaaccactcgtccaagtgtggtcgcaaaatgcgaagaacaaccaatgactgcaatcaatcggccacgagccaatgtggggtcccacccacggcatcaactgcacgaagaaggttctctcaagcggctctcccatagaggatgcgatatgattcaccgctgccgctcatccgaaagtcggagagaggttttcacccatagatattgatgtggtggagaaggagaaaacccatcataacgatgtctataaggaggggagcggtgccacatataatcacaggacattatacatgcatgaatatatgaatatatgttgctgcattactctagctaccaagtcagctcaaagcataaatggattgaagcctcgctcattttggagataagaatttgagcggcagaatatcatgtcgagatgagtgggtgagatactttttttgacgttggtatctcatcattgaagtatataccctcatatgtcccttccttttcctttcgtgaggtatatgtcggatatgcacctttttatatatgtatcttttacagaattgatctatctactgcagaatcttatctattttagccttacatgcaacataaacttactcttctgagaaagtcgatttacaacacgtgcacttatcctttgtatatcatctaaatacaatccattctaaaatatatagctatcttatatatctagtcatagccataaatatatagctatgttttcggagccattgtttcacttattcgcgggataagcaaaacgacatatttgtaaaagaaaaataatttgtgaataaaatttttatatacatgttcctagtgatctaaaagcaaaagctgaaaaataaattttgatgaaaaaaaatctcaaaatcagctccaaatttaaagttgaaaattcaattttggctaataataagcataatcataagtgaaaaaatgaggcccaagagagggagggtgaagtagtcattaaaaattctagaacaaaaataataacatagtgattacaacgttataatgttatatgctaaactatgttttttatgttatatttatccatatataactcactctgtatgtaaaaaaaatagacatagtaataagagaaaataacccctattttctctgtcttaaaatgtaatagtagctatttctatctacagaacatgcacttatccatatccacatccagaaataactacatttcgaggctaagggagtataaaaaaccacttctcattaacatatttaactgggacagattgggagtaaaaagttaaattaaatgcgtcttagtctcttaataattgaatcagatatcttgaatcatatattcgatccttctaaattgtgctatatccatatcaaatagagaatatatctctactattataaaaattgaagatgtttttaccggtactttgatacgtcatacaatccgtgtatgagtcggttttcaaatttgttcatttttagaaataaaaatccatacatatttgagtcggattcttataattccgttcgcttttagaagtacaaaatgagtcgtataagaaatatctttaaaaaaactcgcatattaacttgacatgatattttagaaaaaaatatatatccaaatgaattctcacagtgaatttcacgttgaacaataaaatagccttcacccattgcaacgcacggatattttttctaatgactatataaagataaaaatgatgctccgttcatcccatttaagtgcggttgtagatttctgtgtctaacgtttcattgttcattttatttgaaattcttttatgattaatattttattattattagatgataaaacatgaatagtaatttatagacgcgacttaatttttttttcataaactttttaaataagatggacgatcaaatgttggacatataaacacacaatttcatttaaaatgagacggagggagtatatacgatgttccatgcatgtaccacgtggagcatcgcaccacacgcatgaatgatatatgttttaatttattattatacggacacacatcgatcttacataaaaatacctgtttgtatgtgtctatatatatatacatatatatatatatatatatatatatatatatatatatatatatatatatatatatatatatatatatgatccatttcgtttactacatcacataattaacctataagtgtatgtataacagtacatatatcgcacaccacatcctctcactatatataaactacaccaagcacaacagggataatattgcagctagctctagctacaaattaaacttaaagcatgcagcatatacatatagatatataagtacatatatatatcatcatatgctacgtttttattcgatcgttgaccacattgatctatataatatagatactgcatgcaaattataaatgcatgtaatatagctaattaagctatagagcttgattaattaggcttggcggcggcgggaggtgtaaggtccggtgaacctccggccgccggagccggcctggcgctggcagttgaagtagacggcggcgacgggcgcgccgaggttgtagcggcgggcgaaggcgcgggtggtgaagttgtggcgcaccgccggcgcgtacaccgtctccctccccagctgccggaacagcaccagcaccatcctgtggatccccgtcgtcgggttcgggctctcgtagcacaccacctccctccctgcatccgtatcgcaaagcaaccgcgcctctcagatcatatatatcgccaattcattaaatattttatatataacgttggtcagtctattttaacctgaccaacagagaaagtatatattatactattcgaatctcgatctcatgtctcatcgatctataaatctagtgttaagtagagattgcatattgtacgtaccatatgtagcatcggttgaagccgggatgtcagtcaccatcctgcaaatacacgcatggacatatatcgataagtagctagttagcacatagatccatatatagagttccatatatgtacatattgatcgatcccgatacatatgatctagctgtactgcatccgggatcgatcgatcgatcgatcgatttatgtatgtattgtgtggttcgagatgaactaacgcacacaccgatcgaccacgtggacacaacgcatgcgtgtacatccatgacatggcgcacatttgtacggtagctgatcgacgtacacgcgtgcagcatgcattgttacaagtgtatatttggtccctagctatctatactatacacaattacccacagttttttctgcatgcaagttgcaagctgcatttgcaccgtttgttgcgcacacaggggggctgtaagtgggtcagccgcgaacccacttataggttaaaataagtggcttattttagcctataagtgggtttagggggtgagccacttataccgcgcatgcgtatgcacgtgcgtgcaaaatgatcggtttaatttattttatggaatgtaaaaaaattgacactaattaaattgattgataattaactgagatcgatgtagctagctatagctactatatagtgctcaccagtggaggtattccctcagagttggattgctagggttaggtgcatcaggatcaaccatcacctacaacatagatgggtattcacacagttagcataaatccacgcatgaactgatgaacatatatattatatgcatatatatgatcaggtggtgccaattcggtaggtaacataattaattaacgcgcaaaagctttatacgccaatgtattaacactaaaattgtataaagatggcacgaaaatagtaccagagtatatgcgacgcgaagatcgtctcccccgacttcgaccaccggtttctccgcgaccgccggtgcgcgaagctccacgccgcttatgaccggcatgccatcatcaccatacatgacggtgagatcgacggtgctgatgaagggatccaggacatctccgatcacacgccctgtagccaatgaatcgttggccatttctgacgatttgcttaattggatcgaattgctagctagctatattgtgctggggattgagctagacagcagtgagaacaaatactgcgagctacaggagcttgcagctggtatatatgctgtatatgttttttgggtgtgtgttgtcgtcggcgatggctagctgtgtagatagaattggtttgtgttgtgttgggacaaaagctacaagggttgcgtgctatttatagggtacaaactgccgaccttgcacatcacacattcgcatgcatcgttctccggccggcgcttcggtgacaaattctcctagattttgacaggtctgacaaatttatttctagcgtgtctttaatttgatttcctaggacggcagatgtatgttcaactacatatttgatgtagagactcgattcaattgtgtttgtttttaagaaaacaaaatatgtatgtcaaaatatatctctactattataaaaattaaagatgtttttgccggtattttgatacgttattcatgtttgagccggtttttaagttcattcgcttttgaaattacatatttgtatttgggtaggtttttaaattcgtttgcttttgaaaatatagaaagagtcgtataagaattctctttaaagaactcgcatgctaacttgagacaatcggactcctaattattgtagctcatgatcttgtaaaaacaatattcaagtaaattcctatagtgaatttcagtttagctaaatcgtataacaataataagattaaggctgtgttcgctccaaccggttcctgacccaaacagtacgcacggaaacagaacggtccattagcacgtgattaattaagtattttcttttttttttcaaaaatggatcaatatgatttttaagcaacttccgtagagattttttttttcaaaaaacgcaccgtttagctatttgaaaagcgcgcggacggaaaacgagagcagggagttgtgaaccagctcttgcgaacagagcctaagccctaagatatatagccttcacccattgcaacgcacgtgtattttttttaagtatatcttcatatatagagactggattcatctcgattctatcattgaaaaagaattgaggcatgcgtacacaggtcgtaagcatttctcttttcctttttaacttgaaaggaatttctttttccttttctaacaattggaatgaaatatggataaagctacatacgcatctctagcgtgtgtgctgtgcgtgtgtctgttaatttgtatgtgacagcacatcctttttgccatgtgtgtgatttcaataggcttatggatcaacttttttttttcaaaaaaaaagaagggaaagcttagaatctttgagacttgagagcgccctggagatcactgctggtacgtattcttggcctttttcgggtcaaatattctctccttcactattggcttattggttttcaccttttttttttttagcttggcccggaatggataggccgacctacagatgtgcacccatttttattaaccaaggttgaagccatacaatattgctgttgagttcactgaatttttaggagtcacactatactaatatcaatatgatctacattttaatttgacaatgattttatttgggcgtccaacatgatccatgcgattggataccctgaagcaccactccactttgtgttctacccttatctgcacctcgttcttaggctgatccatacataccccttgcccttctcccccttcttccttcctctcttcccctgggtttggcaaacgtactctagctaagggcatgttctttttttattatcattgtcagattatcgcgttcatgcatgcttttcaagtttctaaacggtatgattaatgcaaaactttcttcattagtatgtcttattagtgaactcttttaaatcaacttatcatatttctaatatttaattcgttcgcttgtgtcctcgaataattatcataaatttagtttcatccattactatgatggcaatgacttagggaccgtttgaaagtgctaatgggccctaagtcatattgcttatcctacaagctataattattctgcaatttgcctcatgctggtccttgtcaacaatgcaaacccttctctctctctctctctctctctcacacacacacacacacacaccccgatcgaggtacatctcgttgggtgtccgcatttgagttattagctcgagaggacgaggagatcatctgcaagggaggagatgccaccattggagtggggatctagctagatggttaattggggactctgcttgatccatttggtgctaattagagcaaggctaatattatagcctattgccggctacacttcattctatagctaatgctgaagccaactactcatacaataggttgcttgttggctagctacatctcataaataaaataattaattataactagcacatgtcaatgtgtatgatcaagagtgaagtggatcattattgtagccaattttgttttgacattaacatttgtatgctacagaagtaatcacaaaacaccacatagttcacacacttttctaaggaccagtagagctcacgatggcctaaggagctagtgctacctccctcttcgtccggtgagacatggtgttggtggtggggaactatggttttaggcaggaatttctcacgggggcgggagagattattcaaggtggaagaggagcagggctgtggtcgaggtggccagcggaagaaggagatcggaagcggcgaaatattgcgatggggaattttggagcgactggattttttttgtcatatatataggtagtttcgcgagtgcgggagggagaggtggagaagcgcaggagctgcgtcagagagaggggaggagaagcacaggagccggagggggacattgcactgtcggaagagaaatcgtcacggtggtctcgcgcgttgagaatcaatggggcggaggcgatcgagaggaaggggatcgggaggggagggcgatgcagatggggagggcaatgtggaggggtagtatgatccactgtggttccacacgccc

SEQ ID NO: 8748 - DNA, 1200 bp, Oryza sativa
gagagatagactcaaagggaattttccaaaaggttagagctcttgctatatttcctccaaaatccacatacaatgtgccattccataggaatttcataggatttggaaaacttcctataggatttgaatcctatgaaattcctagataaatcttttgattcaaaggggcccgacacattatataaatggtagatgtatatgtttaaataatgtgaaaatgatatggagataatgatttgacattgcttgcatattgagttctaaaaatacaacaaaattgtaaatgatatgtcatgttagcatgatatttaaaatactctagataataattactagtgagtgatgatgtgacacacttgcatgttaagttttagtagttagtgggcatcaactttatagtaaaataggatttgaaataattaactatttgccactcttacgagtggttctagaggatttgccactagacccacatgtaatagatacacgagggcccacatgtcatagatacatgagggcctacatgtcatagatagcgaatggcaaatccttaattgacacatcttaaaagtggcaaataattaaatgtccctttatatacatataaccggatgattttgtgatcactattcgatggtacaacttaattaattaattattgtatagttgaaaattgaattgaaaatatttatttaataaattgatatacctctctagtttttacaaaaatcggacagtttagaggcttagaagcgtgttgcatgcattaatccattcttccattcattcgaaaaagaaaaggcatagattcttagcatgcagtacgtgtatcaattatatgtagaaacctcatgtaagaaaataatagccacaaaatttgtcaaacttgattctgtcttcactggatgattaactgaaattgacataacagaaacagattcaataaagtacagcaaacagaggcgtagaaaattctatcaaatatattggctggctagctctagctagctagctttgctctcttttcacaaatttcctcacgtgcagctagcccttcccagcttggaatactactggtcccttgcaaatctatccaagctagcgtttgtgatggctatggatgtcacgtcgatcgaccggaccgggtgcccatccgatcgatatcgataaagtccgaccgtccgatcgctttcgtacatt

SEQ ID NO: 8749 - DNA, 13405 bp, Oryza sativa
caatccggcccacgtggggttggccgaggcccaacaaattaaggttgtccgaaccccaacagttcttaggcccacccactcggggaaaggcccattctccctaaaagactagtccattaggggaatggtggctctcccttttaaggtggcttcctcctcccaagctaagcaaggtgggattattcaaaggctcacacggtcgccgcccgacttttgcgtcttttgccaacgggtaatagtggaggatgtcctcatcaggtttagttctttagcttccaagtcaaatagttagaaattattatcgtcaaatagactatttaatttatctcacattagtaaatgacttagtatttgcggatcgtggaacactaggcgacatagttgtggatctcctcctcaccatcgctagaggggagcgtcggattccggtagtcctcgagaaaggtgagtggtggtagggattgcggcgacaccctctagctagaagttcctaggacatggcgtggcaggaggctgtgacaggtggcactggcgaggcaggggggacagtggcatgcaggaaggcaaggcaagaggatggtggtagcctagtgtggagatgtcaagtgaacgggctgctcttggacccaccaatggatctagccatgccttgtgcggcgacaacaagaggatgacgtgcggtagtggtggacgtggtgacggtgggcttctctattagtgactaaggttccccggccagatttggtggcaatggtgggtgcgggtggctacaatgccatttctagtcgccactgtggaaaagccggttgtcgttagagtcatgacattggagatgccacctatctttccataggtgatgtcgtgatgcccctccctcatttgtaccttagggtaaactctctgaataaaatcattgttctagatattcagaatagtgatgacgatattctagatggcatgacctttttataaccggtgccattggaggttccttaatgacacgatgtccttgtggtggtgtacccgccagatcgggttcaataacaatgatggtgaaaaaaaatctagacaaataactgatttatatattatattatatataatgtacatatgtgacttgtaattaatatttatatatattatatatgctacatgagactctcctactttctttcatagtaaaagttactctcctgatgttataatttgctttggttaacatcagtcgccggtggtgatagtagcaacaaaataattaaatcgacaaagaattagctattgatttcgaagattttgagccattgtgacaaataattgttatacatatatactctggctaaccatacaagaaaatcgatctatgtatttaaggtggtatttttaattactccctccgtccaaaaaaaactaattctgggtttgaatctatgtgtggtttgaatctatgtgtctagattctctatgtccagattcaaacccagaattggtatgtccagattcaaactcaggattggatttttttttggacggaggaagtagttttctagtctttagttatttgtcatgtaacctccataataattggttagaatgaattaaattatttaaaaagatctcatattagtcaagaaagatatactccatccttcccataaaaaccaacctaatactgaatgtgatacatcttagtacaacgaatctaaatatacatctgtctagatttattgtcataaattcgtttttttttggatggagggagtacgcatgttgctcagatcgtacatggtaggtgtgatcatgtttgcagatttccagttcgatttctaccagccgcacgccaaaccttcgatccacgcatatgcacctagtaaaacctgaagatagatcgatgtgacttgcattgagaacgacatcgatgcacatatatatttccacatgcatgtcaccagagcaaaacgtgagaaattgccgaacgaacgaattgaaggcatgtgcttattaattgtttagcacgtacgacacatatacacgtacacgtgttcattgaagtcgtcgtagttgcacccccgccgttaagcaacaccgacgcgatcgagtcatatgtctcgaagaccaagaaaacggctgtgctactgtgctcccatgcaattgtacaccgtccagccaaaactgtggtgatcacgacagatcgagatggcctccgtccatataatcaatgatcaagatgcaattaattagctgcggggaagcatagatggtgtggtggtgtgtacgataaattgaacccatcaggatttacacataaatattgcgcagatgcatgcatgttttttatggaaaaatttagtaaaataaaaaagtgttgttggttttagtcccgattatctaaccgagactacgaattcgaaacaagatcgatctctagtcgaactaaagagagaataacagcagttcggatggtcccctttctttttttttattttctcccgaatcaagtggcatgcatatccctaaatctcaaatcaaagtaacatcccaaatccacatcacaaatcttaaagttacttatacacataaatcaaatacatcgcaaatcctaaaaaaattacacacaaatcaaattacatcacaagttctacaaaattcatcgcaaatacatcacaagttcacattgcacacaaatcaaatacatcacaggatcatgcaataaatcacaaattcaaaaaaaaaaccatagaggcgccgcccggccagccgctgccgcctcctctctgcaccggccggccaccgccgcgccgccgcccaccgccaccgcgcaagccgccgccgagccggccgccgcctggccggcccgctctcgcgctcgatctcgctcaatcaaaaaaagaggaaggaagaaagagataaggcaggagttagagaggaagaaagaaagaaagagatagagtttgctgtgtggacgagagaagaggataagtaatagggattttatagtacgtgttgatttttattcccggttagtaacaccaaccgagattaaacttagatctttagtcccgatttataagatcctaggcgcctgacacggaaccaatcgggactaaaaatcatctttagtcttggttggtgtaaagatcatttttagtcccagttggtaacaccaaccaggaataaagatcatctagtcctgttgttcttataaaccgggactaaaaatcgtttctagtcccggtttttaatggaaccgggactattgtggatttgggtcaaccgaccaaagattatttctccaccagtgttattatacgtgtattaggaaatacatattcatagatgtgtgagtgtgtttttgcatgtgtgcacttttaccgtgtactactttgctcatcggattatgagtgtgtacaatttgtgagtgtgtgagtgtggagtaataaaaaaagacatatagttaggtattgttagttactttctctctctttttctttctttctctttctctttctgttttttaaattaaagttaagataagaagattacgtgaaaaattaaataaaagatgattatcatcatttgagatgagagtgaaaaattaataaacaagatttaaattttagaagtaaccacaatacgaggacggagatggtaaaacgtaacgggaaaggtgaaaaaaaaattggcattcacctttgaatatatattcgatctggtgtaatgttgactgaagtgaaattgaacccttactttgcctaccgctttcaataatcctgtaggctttgtgtcgtactactcatcggtccattcgttttgctcatcggattattcaaaaaatgagagagggagcgttgccatcaataactaaaaaaaatctacatcatcatcgcgagtagcagtctgccaggtaatttagcacctgcggaaacatgaccaatagaagaacgcaggttgacttcaaacattctcctgttctccatttcggctctggacggtggcttttttcttgatacttagaaaaccactgctaggtgaaatatatgctagtacacgaaatatagtgactaagaacatttccaacagagtggtcatcccactctccaagttaaaatttgatagctatggactaaaaacgagcttcaatagtattgctaaacggatggccaagccatctggctggccaaactggctctctcagtagccaaacttggccagtccaaattagcttaccaatcgtgggtcccacgtgagatgctctctccctcctctttctcccccccccactctcttccggtggccgatcgaggtcaccgtcgccagcttcccttgcccgtcgtcacctccagcctcgcacacgcggggagccgtcgcctcccgcctcacgcgcgtgtgtactcgaggatggatcgatgggccgatgcgggagaagagaaagaggaggaggaagaaggcaatggaggctgacatgtgggtcctttatcattttggagatgtaaatatagagactgttgaagtgaacacctagtttaactatccaaaccagttaaagagttggctatatcagtatttggagagtctaatttggagatgttgttggagatgctctaatcttcttgggctgtaccgcaggttatttgcctattaatatatatactccatagtactgatcatttataatatttaataacgaaatttggttgtaacctacctatttttttcatattctcaccagctgacttcttaccagctgtttctcaaaattttaaacttatctaaataaggtctatatacccaattataatcgtaaatctgcataaaagataatatgttaccgacaacatgtcatgcatcaatttttcccacctacctattctacccatctccaccttctatccatctctaattctactctagacccattgaataggtaagtattgagctcatgagtagtcaatgctatggctatggatatggcgtagctagccgtctactgctggcctgcggctagtagttggctattagcttaccttccgatttttgctgctgcagctagctagtgcagccgagtaagctcagtagtaactataacctagtcaatacaccatgtttgttatagaattgtttgatttttcaattacctgaaaatacccacaaatttcaatcacctttagatggtatagattatgctacaactcgtatgctacagaaaccttgtcctaatctcttctcccctctcaccttgtccttaagaaataccttttcatagacgacttccctatagaattataggcgaggccttcaggaggaccacctatgataaggccatttcgaggtaacgctagatcgaacgctcgcctccccaatgagcgccactacctcctcgaccactaatgcgtcgccttttataattgttcgcgccaacgagactgctctaactggcttcctcctcctccccttccccaccttcccaagccgggcagcagtgaggacccctgccatcttccttgtctctagcggctcgcgtcattgaagacacccctaacacccccccgcctcttaaccacccaaacttccacgctcctgccgacctctccacccattgcccttcaattctacaactatgaaggaaccactcccgcctcgccacccacctatgtttgccgcccaccgccattttcgtcgccctcggctatccctctaaatccgtgaaagctctccgtccttcctctccccaccctttctcacatcgactcccaccctggaacctaaactctaagttctctgcaagagtttcgatgctttgagcaccgtcgaggagtcacatcctctttcaccgttagttggtgagttaattaccccctactcccttcatccgtccccactcatggaattcagtgttgtattaaagggagttcagtgttaggttaaaggtgattgaagttcatagcatcctcttttttttttagtttgaactatggatcacatgacgtatttaacttgtgacatgtgcgcaacgactttgctaaacatctctgatatttgatgttttcctgggcgtaggatcgtgtgtcaagattagtgcaggaaattacagttctatataactaaaattacattcgtaaattcagttgatatgacatgtaaatgtattgtaattggtaaaaatgttgtgcaagtaaatatgtatttgttattttctttaaaatataaaattacagtgctatataactaaaattacatttgcaaattcagttgatatgaaatgtaagtgcgttgtaattttgataaaaatattgtgtaagtaaatatgtattgttgtgttcttttttagttatttggatgtaaatctaagggtagaaaaaacctgggtgatttttttttttagaaatcacccgacaaatggatagacagttccgtgtcgtaaacgcctttgacccaaacagaaaagtgtagtaaacataacgaggcatccccccacgattcatgattttttttatttttacatttttattaaaatatttacaaaaacatttttttcaaaatttacaattctagtcgcctctcgccctctggaagggcattttttaaaaatcgtccttccagagggctttaggggacctaaatacaaattttttatttgtgttcaaactctttccaccggttttaattgcttaaaaactaataattcttattcgacgctccaaatgattttaaatggaaaagtgataagctacaaagttgtagatatcatccagatctacaacttttatataaagtttatctccatccaatgtcgtttgaaatgtagatatgagattttttaaaaaataggttttgcattttgtaacgaatatttggatatctaaaagatcttaaatgaaaaagttgttaactacaaacttgtatatctcctcgagctctaaaatttttatataaagttttatttcatttgactttatataatataattttaaattgtaaaatcatagagttgacaagttatactggaaaatttacatttaggtcccttaataccctctgtgagggtgatttttcccagcgggcgagaggcatttgtaaattttcgaaacaaaagattattttttaaaatattttaataaaaaaatatataaataaaaaaaattccacgattcatctcattagcccactaagcaaactagtgggcccaatagcccaattccgtggccccagaaccagcgcctccgagcccagtgggcccatcttgtcagtgactgacaccaaggacaccgcgacgcggccccctccgcctcgcaaagcaattttgccattctcccgtttcaaacccgcgctctctctctctctctctctctctccccctccctgccgctgctgccgccaccgccgcggcggcgccccgattcggtgatcccccgctcgcccatctccgccgtgacgtatcggcgacgcggagggagccccccaccccccacctccggatctagggtttcgaggcccaggtggcgttgcgctgcgcccccgctcctccgcctctcctccgccgccgagggttcgcgtgaggtaaccgacgcgcccccgtttggtaatcgcaccggcagatatcgtgggggttcgtttctccgtggcgtgttttggtgatggatccgatctaggtttgttttaggggctattttgacccaaatttcaggtgttttgcggagattgtagtgtttctacctagaaatactgcgattattggtgcgtttggagatgccactggctgtgaaatttcctgtgggaactcgtttccagttcgctggggatttatggaatggttacggttttgcaatattacgggttttgcgaactaaggcttcggtttggtcgctcatgggagcaatatttagtacgattgtcatcgccatttctgcaattccaccagcgattggttgctctgttcgtactcccaatagaaagcttgctccgctgctgatatttaaagtgcttcgttggtggatttcaactgcagatgttgggctctgaaggaaatggtgcaatttcttcgtgcatgatgctcgtatattgtgtctattatgtagtcctgcctgcttcggtggttctagatgctacagctttatctgccattctatttatgctgcattctatgttcagggcatgcgcaaaatattattgaaatgatcatttacttgaagataattggatttatttcattaattgctccgtaagccttgattcataggtagtattatgctttttttactactaagtctgtagaatcccatctctcctgcaatagctcataagaaagtgacatgttgtgcgatgcagaactggttctgaatgcatagtccttagtgcattttgagctaccctttgtcaggactgtagtctctgtaaatagtgggagaattcattggctaaaaagatgacaaaagctagctgcttatcagtattaagtgtcgcaccatttcttttatcatgcgagtagtgcaagtgcctgaagggttatcccatttagctattccaaatggcacatacgaaatatgattatttgttcatttgatccgtgatacttaggtagctatgatctgtctctgctcggtttgtttttctgttcagacatgcagaatacaactgctgtctgtattcagtttatatcttgcaactcataattctatgtttctacctgcaggtttctgcgtattaccagctctgtacttaatttactagtgagaagcaaaatgaagtgcaatgcttgctggcgggagttggaagggcaagctgtatcaacaacctgcggtcatcttttatgtatgcctgcaatcttccttactagttttgcttaaccagtttctcattgtaaactaacattgtctgctgctattgcagtatacataactgatccttgctgatgattatccgttgagcaggtacagaggatgctaagaaaatactgagcaatgatgctgcatgcccgatttgtgatcaagtgctttcaaaaaggtctgttgtttactcttgaagttgtattcattatctcatactacattttctcttctttcctgtaagctatttttgaatgtacatcatgatttgacaattagggatgccaaaagtacctcaaacgcatacatatttatcatctcgatggttattgccatgtcatttcatccgaatgggtgcttaacacatggagtttactttctagcatgctttgaagcttttatacttctttgatgtgttcgagtgaaaatggactccagtggtttactattttgagacagtctaaacattataattttttttctcagccatatgagacctgttgatacaaatccaaatgatgattggacaaatgtaagttcgcttacgattcattgtagataaaagcaatccttctttttctaacagccagtctgctcattggtacagatgtcaatggctggagtttctccacagatacgtatccttattattttctcattgtccgtaagattcttgtgctacttttgttgaaaatcatcactaactgctatatggaatctatggcgtagctagcctcttgtcctgttttattgtcatagtaatgcaaaaatctgaaagatcaaaattgtttatatgattattgtctaaggcttggtgactattcagattttccctaactatgatgctaatcagttatgaagagtgcatacagaagtgtcatgttttacattgggcaaaaggaactggagatgcagtacaagatgaacagaattgttggtcagtgtaggcaaaagtgtgaacttatgcaggcaaagttcactgagaagctggaagaagttcatactgcataccagaaaatggccaaaaaatgccagttgatggaacaagaggttgaaaacttgtcgagggataagcaagagctacaagaaaaatttgctgagaaatccaggtcagtatgtacagtacatttctagtttaattctcatatgaataaacctctgcttcatccaacttatatggagaattgactgctgtcatttccaggcagaaaaggaagcttgatgagatgtatgatcagctgagaagcgagtatgagtcggcaaagcgttcagcaattcaacctgcgaacaactacttcccaagagcccagccagacctgttctcaggcgtgcccaacataatggatagcagcgaccctctgagacaaggtaatttaacatgttatcattcagcttattagttctctcataccatataactcatcctttcctctgtgcacacccttttgttatgcttccaaccagaaaaactgttaactgtaatgcttggattgctagtagccactattaaatatataaaagttaaaatgcttttagccctccacaaaaacagcttattcactggctgcaggattggctggtcttcctgaaactccagggcggagagatgagggatgggctccaccaccaaggcaacgtcggtccacctctggaccatttgagctgtctgcgggatctcctgctcacaatgcggcgcctccggttgatattaggcccagacagccagcacggcccgtattcggcactgccatgaataatacttctgcagctctgcgaaatatgataatctcgcctgtgaaacgtcctcagctttcccgaaaccgtccacatatgttcacgtaatgtcctccttattgctcatgcatgtatttcacatctaaatgaagcagtttgggaatgaaaattgatgtccaacttgctcaaaagaattatttcaacagtaacatgacatttctacccttgccctttcctatactaattcatggaaatgtgaaatgccagggtgtagaattggaagagctgatgtggcatcctgctttggaatctgtcacggtcttgtcatggacttgctaactgtaaatgcagtaagatcaatctgtctctttccctcacttcaatttctgccccatcatcttggtgtatagaaactgttacagaagtcccttgggagaagattgttagggaggttctgatatatacttggggcgcaaagtcactccttcctgattgcaataacacgtagtgtatctgcagctaaattcttggactttgtgactgtcatcacactaaccatctactattagtagtaataatttactactgctcggggtggactaacccctgaatgatggggacggtttttctaggattatgttctagggaccagtactgacttgtcggatgcgggttctatagctggaaactacaaagggatctgttgtaatcgtgccttctgttgtttattatatttgtagttacctaaaatgcacttaaccagttcttcattgagctattacagcacatcgtggtcctgaattgtagaagtggtacgtggcatgctatttgtatgcaccctagcaaactcatcagctcgagactagcgcctttcggcctacctggacgaatttttatacctttctgtcaacaacccaagggatatgtcacgccatcgcccatcgatgatcagctgacggccaccgatcgtgaaggcgagaggtacaggataaatactatccgtgatggctgcgtctgcattttttttttgtttagcattgttcgggtgactatttatggcagcgggccagctgctccaccgagctgaagcctcgtcaccgcccacgtacggtgcggcgattggctgggcttgcgctcgccggagacgctcctgatttaaattaatcgaatgatgaggagattttgttccagctaatccctcttgaggttgacagcgaaagcggagaaaacgaaacctgccgctccaatccggagggtgacgctgggccggctgagcacgtcagcactcgccattgaaaaggattacggggtgtttgatttgatgcttcttgtcgcaacgtgatagtactttaatttgaggaatgtgttgggttaattgtactaacaatcatggttaatcgtactactctgttaaaaaaccaatcctagtttatatgaactaaaaaatcaattctaattatgaacctaaatataatcctagttatgaactaaaaatcaatcctacataactaaaaatcaattctaattatgaacctaaatataccctaggtttgtagttaggattgaatttttaatgggggtggaggggtatttcacttatttgcccacctggtaaagattattttacggccaacgcaaataagtgaagtacgatttgaattaggagagtattattgttcagttcggttagtgactagctttagcaaaccacacttaaacttcctattatgtcttaacaagaatgtgtggcttacgttggaaagaacggctagcagaacggtagccataagtaaattgatgtacgtcatatatgggaccatatagctaaaatgagctacaatgcgtggtgaatctcatctaaaaaaaatgcgtggtgaatcataatgatggcaataaaatcaaacaactgctatgctaagatggtctaaagataaagtgagctaagatgccttgtgatagtctaaagtgaaagatacaaagatagctatcgcgggaaaattcctgtgtattctctccgtttaccgttaactttttaaacattcctatcatttcatttattattaaatatacttttatttattattaaatatagtttacatgcttcacaaaatattttaaatgacgaacggttaaacgtgttctaaaaatgaatggtaccaaacatttaaaaaatatttttcctttcataaccatccaaacaaggcacactcaacattcgattccaacattcgattcctaatactgtgcttttcctgtttctgtagtttttgaaatcttttgttcaaacggagcaaattttgttgaacttagatactaccagtactattatttttttttgcttgcgcatatacacccggctggcccacaagtcaggcacacaccgagaccaaaaacccccaacaagggggaaaaaacccaacatggctactaggagagctacctagcttccttccttcgccgttcacagccacttcgtccaaacactttggggagggcaaactgaaacggaaaatactactgcgtacacaaatcgttggatcggcaacaagagcacgaatctcaaagcggttacagctttagtagccgctgtccaccaccgggaacgcgtacgccggcgggtagtcgacgccggcgtcgacgacggcgttgccgaacccgtcgccgccggtgtagaggccggtgaagtcgaccgcgtcgtccggcacgaacgcggcggcagctgcggcctccgggccgcagccgccggcgtagaacccgtctgcggcggcggtgacaaggtggcggtcgccgtgggtggtggtggtggaggatgaatccaagaggaggcgcggcctcttgacctgatgatgcac

SEQ ID NO: 8750 - DNA, 3696 bp, Oryza sativa
cctccgccgccgcaaccgccggcctcctccttcctcttcgctccccctccgccgctgctccgtcgcacgatccggcgcagcaggtgcgtctggccgcgcaggaacgacacgtgcgcgaactcccacctgtccggatcaaccttgcgaaacccctgcacaatccattgatgacagaattttgaatataatcgagcgagcaggaagcagggaatgggatggaaggaaagcgagagcgtacgtaggtgttgagctggcggacgaagctggagaagttggagtgcttgaagtgggcggggaggagggtctgggagaaggcgaaggggtcggcgacgacgaagctgttgctgtccctgccccaggcgatgacgccgtcggtggccgggtcgtccaccatccggtacgtcttcgccacgaacggcgccaccccgccaccgccctccgccgtcgtcgtcgtcatcacccttcttgctatactagtagtgctagtacagtggttggtgttggtatgcagtggaggaaatgcgggatgcaggggatggtggagtgacgcaaattttatacggggatagcgtagcgagaggtggcaaaggtgatcggcagggggaggacgcgtgtgcgcgccctggaccctcccagccacaagttctcgcgacctttttcattccttggccgcggtcgctttggggtattttttttttggctcgcggcgcgcgtgcgtggacttgagggagggggtggggtgatcgcatgtcatggtcgtggacgaatcgcgttggttgggatgtggagtgacctggcggtgtgggccaatggggcttcgacgtgtccgaactcgagtagctggggggccaattaacccaacgcaaccatcacgctacggaaagggcaagtactagggtaccgagtaactacggctactcctcgacggtccaatgcgagaagggcatagtaaggccgtggggcgtcgcgccgctggctggggtgtccgtacagtcggcaaccacacgcggcagcgagaggatatagatcacagtacacaggtcaccccgcggcagcgcgagcctacctgggcgcgccacgccttgcatgcaggtacgcgtctcacgggaattcgcgcgctggctccgcttgccccgtcgctcctccgtactccgctactgtctccccaaatgggccatgccagcccgtctccaactctccgtgcatgtatgcctgccaatacttcggtttggataattttagtctctctcacatcagacgttgagatattaattagaagtattaaacataaactaatgataaaacctattccaaaactctggactaatttacgagacgaatctatgactagactatgtgacgctacagtaaacatgtgctatggattaattaggcttaaaaaatttatctcgtgaattagctctcatttatataattagttttataattagtctataattaatacttcaaattagcgtccaaacatttaatgtgataggaactaaagtttagttcttggatccaaacaccagcttaccatgcccaaataggtcagtgttgtggataacggttggtacggccgtatattcgggcattaatacgttggcgccgacccctccgtcacgaatgagcaaaacgctaaacattaatcgttttaggatgtataatcaccgtcattagtgattaatcggccgtttccgactattcggccgaataaacggccaaatcatgtgacaaggccggaaggccctgcccagccagcccacgatactggcccattagttgtgtaacctagcaatatatagctacagtacgtcgtttgtaatcaaaaaccctcgcaactcattcctgaagctacaacctgcaagtctagggttagttcttttcatctaatcctctttcaaatccaatctccatattttgttgttgtcattttaatcttctgtttgaatctcgaacaggtgagcatgcttgaagtttttcttctatcaaaaataataagctattatgagttatgtacatatatttgtacaaaacattaaatttccgtcaaataccaattattcgcccgtactccgattaatcgtttagcggaaccctctccgtccgacatccgtgttccgtcatccacaacactgaaataggttatttgagaatagctatatatatatatatttatcgataaatcttttttctaaaagtttttaacaaatataagtatagtatatttattgtatattgcatgtacctataatacaattgatatgtaacttttaaaaatctcatggtaacatgttatttttgtgaaccgaagattatgataccgaatctcctcactacgatgccactgctgacctccctctacacaccgccgcccccggtgccgcgcgccgcagccaccaccgccccccgaagccactccgccgtgtgacgccgcctccgaagtcccacgcagcagccgccaccactccgccatgttatggcgtcgccgcagccactggcgtgcggtgttccgccgccgccgccgacctctccctctgtgcgccgctcgcaagagattagagagagataggattggcctggatagggttgaagtgtgtcgagggtattttggtcaatttaaatagtaaatattttttttttctaattgaaatcctaacggtgtaatgaaaagagggttaaacggggtgttcgattttgaaaaacgtggtcaaataagcaaacgcgtcgatcggttccatggatcggtggctgggtgggcatccctgcatccaactatgaactaccagtgccgatcaggttgggagttttggatttgtcctcccccacgtctcggaaattaacgatttcacgaaaagaaaatttttgggtgtcacatctgatgtttgaccggatatcggaaggggttttcggatataaatgaaaaaaactaatttcataactcgcatgaaaacagcgagacaaatttattaagcataattaatctatcattagtacatataggttactgtagcacttatggctaatcataaactaattaggtttgaaagattcatctcgcgattacatgcaaactatgtaattaatttttttatctatatttattgcttgatgcatgtgtcaaatattcgatgtgacgtttttagaaaaaaaaaattagaactaaacaaggccatatataacgggcggcaaagtgatcgatcgaggtgattatttttccttatcttttttcaaagagataaagatgatcttaacagagagagagagagagagagtagcggtacgtaacctggggcgagtgtaacgccttagattcggagatgggttttttccacatggcgcccacctcgtttaattttcacttgtgtagagttttttttttatttttttttatttttttatggagggagtactgtcatctcgtcaaacaaaacggtaggcaggcgggtttgaccgacggcgccctttctaattccgtggagtcccagtcacgtcacggcatgcgcatgcctaatctgtacaccgagccttaggtggtgtttgggtccacggacttactttagtctctatatttagataataatttagagtattaaatataaactacttacaaaactaattatataaacgaaagctaactcaccagacaaattttttaagcctaattaattcataattagagaatgtttactgtaa

SEQ ID NO: 8751 - DNA, 2660 bp, Oryza sativa
tagtagtattgtaaaaaatagctaggtggcctgtgtaattgcgctaccccatacgtttatcatatcttctttatttgcttgcttgatttactactatttctattcattcttcttgaaacctttaaaagttagatcttgtagtttttagagtttattgtctcgttatgtttcatttttataatttctagaagtcccgtcaaacgctgccattatacttctctacggctcgtccactgtcttttatctttattgtcattaggattttaaaaatcgaacataattatcgtttggttttatttttttcctttctagaagtcctgccaaaccgtcaacggctttggcattgtacttctgttaacgaccaaatttggtaatatcagcatcagaaaggaagattagatcgaagcggaatcaaagataaggattatcgcggaaacagagtaagaatcggctggaatccggatcggctacgactgggatcggctgagtccgagttagactgggttaagtgatatagccgattccgacaatacgacttggtggacgacatcgggtctagttgatatgcttcaagataattgccatgcatggatagagtccagggaaggcaattgtatctattaatttagatattttatgtaatttccttagagatatgtttgggtaaaaatctgccgcaaaggcttatggtatcttaaagtttgttagagataagagtcgtgtccgatatggacatagtttgtaattctcgggtataaatagatcccgaaccccatgtaattaattaacacacacgttcaatacaatctcggcgcatcaccacccttttttgctttcgttttatttcgacgagttcttgctttcgggttgagctgcatcggtttcgattttcaacaataggtaaaacttgttatggcagcttgcattctcaagattagtacttccatctttacgatactctaattttgtttatgtaattcgtcgagttatcatatatgttgtataatctgtggcaatatcatcacaggggcgaagctatagccatctatcggggtccactgaccccgacgatttcttgtgtacgtttcttactccacttaattttaccgtgtatgaccccggtcgataaaaacactagaccctggtaaccatgatttgttatagcctgattaattagcaacttgaaacgacacgtttgagattagcaagcaacaaataggaattagctagcgctaatgattatacgtcagcccaaaggcccaatatacattttggtaatcttagcagtgagtatttgtgcatttaatgtctactttgtttacatattaattatgtccggtttttaatacttcctccgtttcaggttataagactttctagaattgaccacattcatatagatataaatgaatttatatataatatgtagattcattaatatctatatgaatatgggcaatgctagaaagtcttataccctgaaacggaggtagtataatttatagacatgtccgtgcgttgcgacaatctcatatgggccaatggttgctcgtagcattatttaggatatggattttcatccctcgaggggatatcccctcattgtttgcatgtcatctaaatagttataaaaaaattgacaacataggttgataagaaatatatcactctacaaacatgcaaaatcaaatttgacttctacaagttacaacaaaaaaaataaactgaaaatagttatcgtacattcgcatttatatttgttatttttgtttcaatttgtagaagttaaattttaacttgcatatttgtggagtgatatatttcgtattaatctagctatttagatgagatgaacgaaacgagggatatcccctcgagggatgaaattactttccccgttatttagttttctgttgggtctggtttttcccccttttttttttctttcagggtggatgataaattctgtttttatgtagtagagataaataggcaagcaaagtattatggagcgattcttgaaaccccccccattattttagaagatctaacaatgtatcatacactaaattagtattgaccccgtcgaccatttatcctggcttcgcccctgtatcgtcatctaacctacaattggctaacatctgctaatagagggcagccgattaggttaggatatcgatgttggtttagattatatatgatatctaccactctatgaaactccaatggcttgattgtctagatattgctcttcttttcatacttatagctgtatcagttgtttgatcttatgagtcatgattaaaatctcaatatctagcctgcttcttggttgccgattagggtagtatcggggtttcagccgatcttacctgatttaactatatttgctttatatgctttaccgacatgttaaatctgccctttatgtcaagatcttattgcatttaagtatattaggcttttgtttggtatattttgcttggtttaatattttaatatagagttgtatcggagtattagccgatacgtgctagatctatttgatcggctatgctatgaacatatatagtcttgttgttagtatatattttaatctaagtgatttatactgtctcggtatggcgaccgatctatcccaatcacttgatttaagt

SEQ ID NO: 8752 - DNA, 10268 bp, Oryza sativa
ccttctcaagaatggtaaaattatccattaaagaatatatgcatgcaatgtaggcacaaatctattgtcgtgggtgtacatgtgtattttttgaaaagaaaataatttactctctctgttccaaaaatataaagatttataagttgtttagccaatattaaggttagctcgagagattccattttagtcacttcagatattaatcataaattttatattgttcatatttcctttccaagcatcattgaaaataatgggaaccatggaaatcattacaataatcctcttaaactatggtataaaatttggatcagaaaaaaccttatacttggatgggggagtaatagttttctttatatttttatagaaaaaaagttatatatagtttgggaatttactcaactattcagtactatggggatgtttagatccatgatggcatgatgtgtgtaaagttttagcgtgttacgtcagatatacggacacatatttaaagtattaaacgtagactaagggggtgtttggatccagggacttaactttagtctctgtatttagacactaatttagagtattaaatatagactacttacaaaactaattacataaatgaaagctaatttgtgagacaatttttttaagcctaattaatccataattagagaatgtttactgtagcatcacataggctaatcatggattaattagtctcaatagattcgtctcgcgaattagtccaagattatggatgggttttattaatagtctacgtttaatatttataattagtgtccaaacatccgatgtgatagggacttaaaagttttagccccatctaaacagggtctaataataaaacaaattacagattccgactgtaaactgtgagacaaatttattaagcctaattaatctgtcattagcaaatgtttactgtagcaccacattgtcaaattaatcatggagcaattgggcttaaaaggttcgtctcacaatttacacgtaatttatgtaattagttattttttcgtttatatttaatactctataaatatgtcaaacattcaatatgacatgatgaaaattttgccaggggattcccgggcttgtcgattagccatactttctgacggtcttccatcaactgtgcctccagtaaaacatttgtgaagagtttcacttgattgtcgactctgccactggtgggtaggtgggctttgaatcccaatttgttactcccttcggcctctcattggaccaacagataatcctcttttttgacacgccaaacaaaccaaacagatactaatcaattaatccctgatcacgattaaattaaatggataatcaccagcagttaacggagcacaccaacaaccaggagattaaagtgggctcggtcaatccaaacggcttggaaagtgattactatccgcagtagcagcatcagctgctgccatggaaggagagagaaagagagagagatcttagcttgcttggcgccaataaataggagcccgggtcatcggcgaatccattgccattgcagttgtatccttcttcttcttcttctttctctactcacctgcatctgtagagagagagagagagagagagagagagagagagagatggcaggaggtgacaacaactcccagaccaccaatggcggctcaggtcacgagcagagagccatggaggaaggcaggaagcaggaggagttcgccgccgacggccagggctgcggcctcgccttctccgtccctttcatccagaaggtgatcatcatttcatgtcttcttcttcctcctgatcttgagagttcttgatcttgacaatggcgggcgcgcgcattgatcgatcatggtgtagatcatcgcggagatctttgggacatacttcttgatcttcgcggggtgcggggcggtgacgatcaaccagagcaagaacgggcagatcacgttcccgggggtggcgatcgtgtgggggctggcggtgatggtgatggtgtacgccgtggggcacatctccggcgcgcacttcaaccccgcggtgacgctggcgttcgcgacgtgccggaggttccctgcggcaggtgccggcgtacgcggcggcgcagatgctgggcgccaccctcgccgccggcacgctccggctcatgttcggcggccgccacgagcacttccccggcacgctccccgccggctccgacgtgcagtcgctcgtcctcgagttcatcatcaccttctacctcatgttcgtcatctccggcgtcgccaccgacaaccgagccgtaagctacctagcacgattttaattcatttaatttaattgctccctccgctaattaattatctagtttaattagtttctatatatctgtaatttgattgctccactaattaggatcgatttgatcctgattaatctgaaagttttgaagtgataattctgttgaccatatgcatggatgcagatcggggagctggcagggctggccgttggtgcaaccatcctgcttaacgtgctgattgctgggtacgttttaatttttctttctttcacgcatcatctctctcatgatgataattaattaattactcttcacaatggaaagtatttcaaagaggatctagagggctgaaaatgtgttggtatcgatccacttcttttcatgcccatgaaacatatagggtgtgtttagttcatatcaaaattagaagtttagttgaaattggaacgatgtgacggaaaagttggaagtttgtgtgagtagaaaagttttaatgtgatggaaaagttgaaagtttgtagaaaaagttagaaactaaaccaaaccaggccatagtagtagtagtagtatataatttccagtcaaaattaagaaaacaatgggtcagattcagagttcagactagatcagatgtatgcgtccttttcggtagggagagtgcgttttgaaggagccaaagccaaccaataaattcggtcatgtggagcgcagggctttgagtgtgctgcggttggtgcagtgaagatcggccatgcactgcactgcaaccaagcattaatgtcaacttaattactcctcctacctccggccgcctagcttgtaaattcacactctccactccacttcactcctcacccatggtgcctgcctctcaataactcaccgtttgatacaggccctatttagattctaccttttctcttcaaacttttaactttttcgtcgcatcgttctaattttttcaaaccttcaattttaacgtgtaactaaacacaaccatagttgtgacatgatactatggaccccgtttgatacagctcgtactcgcgaaattaatccagggttatggaataggttttgttattagtctacgtttaatacttctaattagtgtccaaacatgtgatgtgaaaggaactaaaaaattttagtcccatccaaacagcccgtaagatttttatcccgtgaagttggaattgtaccgaacactcgggtctacgacttaaaccttatgaatttgtagatttttgttacacggttctcaaactacaatttcttcttttcacaatttcactaaggcttagataacttgttcttatctattttttttcaattaatgtataaataatgtttagtcaattcttataaacaaatgtccataattgagattaattagagtccgtaaaaaaagctgaaacagagtttttgtgttttgttgaagaaaattcatttgtacccttttacctacctttaaccagcatcattttatattggacaataatgatcaacaagccctaataaagatttgggatgagagattcagagattcagataattctttttcaaaaaaaaaaatcagagattgatgacatgtgcattttctgttcaggccgatctcgggagcatcgatgaacccggctcggagcctggggccggcgatgatcggcggcgagtacaggtcgatctgggtgtacatcgtcgggccggtcgccggcgcggtggccggagcttgggcctacaacatcatccgcttcaccaacaagcccctccgggagatcaccaagagcggctccttcctcaagagcatgaaccggatgaactcctccacctaacctctatctagctaaccaccaagaaccctaattaattactactgccagtactactactgctactttctgttcgagatcgatatcgagatgcttgatcgatgcaccgcatcgcatttaaaagggaagagatggatgaactactatttgtgacgtacacatatatagtagtaatttaattagcgttagttcgttgtcgtctcggctacgtgccacaaggcctcctttgtaacgcaggaattttataggaattctgtgatgtgtgtttttagatgtggggattcctataaaattcgtgtggaacttctctgcctcctatatatgtagaacttaaaaaatctatgtatatgtgtgtgtggaatagtatgttttggaccacgtgataaaattgcagagtgtttccttgcagattatggttttcttttaaataggtgagtatgataagttcccccctctatccatgcttatgaagttcagtatttcgacatctaaattatcaagaaaaaaaaggacatgtttgaaataagaagggaacttaattttgtttgaaatagggaatgagcttaatttggccatgtacatagcaagtgacaaaagacatgtgtcttccatgtaatcgaggagaaaaaatagtaccaatgaaatggaaccatggtcaaccggtgtgcttggaaaaaaagcgtaccggaattacttataaaatgagccttttgctagcatttctgcatttggctttgatgtggtgtcttttcttggactaggagcagtagcatttcgaagaaatctatgatatgtggtagcaatagttgaaagatgttaaaattgattagatcttgcatggtctttgacagtatatattctcacggattcatggtgcttaaatagaaacccgtgtagaaaggtagaaaatcaagcagtgctgctgaatgtttcacatctccgattttggtttcataagatcaatttcaggttcagtgagtttggatgggctttaatttgtgttaggctcttgtttggatgggcgtggatggaccaaggctaagacccatccagtgatccagagagactttagggagcccaaatccaggcccaatccccaccaaaatgaacttccaatgaacaaaacatgacttctttttggaaaaagtacacccaaggtccctcaacttgtcatcgagttacaatatcggtcctcgaaccacaaaaccggatataacgcatccctcaacttacaaaaccagtgtaaactaggtcccaagacggttttgagtccggttttatcccatgtggcagctgactcagcgtggaacccacgtgggccccatgcgtcagcctcttcttccctcccctctccacctctcttcctctctcctctcttttccaatctccacgggcggcgcgcggggagtagctgcacgggcggcggccggcgggcgcaggcggcgtggggaggagccgcgcgcgggcggcaggcggcaggcggcgggcggcggtgcacgagctcctcgccggacgaacgctagaccggctccgccacgtcggccgcgaggaggtggcgcgcctcgtcggctcgctcagtcggagtgccgccaacggcgagcacgtcgacgccgacgccgcgctgatgggcctcaccagcgacatcgtctctcgcatggtgaattggtgatgggccggccgccggcgacgacaatgacacggaggagatgtggagcgtggtcgccgagacggcggagctcaccagcacgttaaacctgcagtgcgaggtcatcataatacttgttgtagccgttgagcagccgggcgaggtcgtcgtagtggtaggcgccgccctggtcaatgaagaagtcaatgccgtccaccgccgcgtcgtcgccgaaggggcggtgcacgccggcgcggtggccgcctaggtaggcgttccagatcaggttgtcggcgacgtcggcggcggaggcgttggtggggagggagtagccgccgccctggccgccgatggagaggagcacggtgatgcccctggactggcagtgcttgatcaatgtcggcaccgacggcggcaagcgggtggccggatatgtcgagcgagtagcggccgtagccgaagacgttgtagaaggtgatgatgacggtggtgtagtggccggtgtcgcaggcctttctcagggagccttcctccttgtggcggccccagtagacgacgaggcccgggtcgtcggccgtcgctggcggcggcgtagcgaggagcagctcctgctaaggggaggagtgcatgcacgaggcccatgtgtaagttgctgtatgctagctaggttgatggttttgccatgtatttatagagagatttgcaggtgaagcttcatgtcctcttgtggtgttcgtgcgtgatgtgcatgcgtacaagtttaatggattgattcgtccacgtggattgaagcttttgagatgtgagcatttgactctatgatcggcggctagttcgtcggtgctgctcgatcgatcatatctcgatccagtgcttaatcgtgtcaatcttgttgatagggcttgaaggagaacagcaagatggcaatgatctcaaattctcaggtcatttgcgttaacgtcggcggcggcactccggctgagcgagccgacgaggcgcgccacctcctcgcggccgacatggcggagccggtctagcgttcgtccggcgaggagctcgtgcaccgccgcctagctcctcccccgccggccgccgcccgcccgcccagcctccgccgctcgccgcccgcacgcagctcctccccacgccgcctgcgcccgccggccgccgcccgtgcagtttggaaaagataggagagagagaaagagaggtggagaggggagggaagaagtggctgatgcgtggggcccacatgggtcccatgctgagtcagctcctacataggacaaaaccggagtgaaaaccgtccagagacctagtttgcactggttttttaagttggaggatacatcatatccggttttgcggttcgaggacggtattgtaactcgatgacaagttgagggaccttgagtgtactttttccttcttttttaagttaacaagggcagaaactagtttgcactgaactgttattatgttacatgtcttctctacttgcccaccaaacaataaccttcctagctagaaaagaaaagaaaaaaaaaacttactagatatccacatttgcacagattagttgtacattgcatttactagatacatgatgaccaaggctaacaaacaagaaactcaagtggtgcccctgagaagttgctcaattcatatgtaccatcacatcagcagcatcagattccaatatctgcttccagtccccttgtgaagaatatatcatcatggcaatgcatcattgatatcaattgtcatatgccatggatgagaaggctgaggacaactgacagaatgccaaactacaggggattacagacagagcaaatgcatatgcatatgtacagttgctgcattgggctcaaaacaattgccaacatttcatcctagctaatcctggtgctgcagctcacagctttgaagaaggggagcttgaagatgggaggtaaccactctccatactgttctgcagcaagatcgaaggatcgctcgatggcgcgtaggaccactccgttaggctgttgttcatggattgattggattgggagtaactgggcctgatgtatccactcaaatcttcatcaggtacaacctctagaggggcttggccacagagcatgctcaccaccgaagacattcttggcctctgaacaggtgatgtgtttgtgcatagaagagctacattgagcatcctaagtgcttcttcttgagagtagtgagaaccaagacgctggtcaacgatttccagtagtctcccttcctgcttcaatctttcagcctgtgggcagaaaataaatccagttagtagattcgtgtttaaaatgtgtagcaggactatcagcagtttacttggtgatattaacatgcaatgcaaggctaaatttcttgggtaattcgcctttcagatgtgaaacactttcagttagcactaggcaattctttcttctggcatgaagaatattggtttgtttgtgggctaatcctgatcaagagaaaattgtttatgggcacacctagttcattgttagcctttgtttgacagaatctcagtagctactagacagactgattatccattgttatccgttgggtgagtaccaagaaacttggtcttatttcattggctatagcagaatagctgccattcaaatgatcgatttttggaacaatgttgttggtttatgttacaattgacctttattcctatcataacataattttgaacagccaatccaaatcatcaattactcagcatattatcagcctaaaatgtgacagagctctccaaagttaagcaaactgactttataaaagataacatatctatgacagaaattcgtcccataagatcatacccaattctatggggctggacggctggttatgaattcgagtcctaaaagacaaaagcagtaacagaaaaaaagaagctaaaatagcatacccagtcaagaagatggagatattcgtcatctgacatgctacttgtattgctcattccactaacaatctctaatgtcaccactccaaaactgtatacatctgctttacatgtcaagcaacctctcgtggcatactcaggtgccatgtatccactggttcaaataaagaacggtatcagatgttggataataaagatttttacaatatacaataatagaaaatgaaaggtgaagtagccaataaaaatatagaatgacagcttacactgttccagctatccgagtgctcatacgcccacggtcatcattcagtttagccaaaccaaaatcagatattttcggttgcagtctttcatcaagaagaatatttgatggtttaatatctctatggatgattttcaatgttgattcttcatggagatagcacaagccttttgctgttccaaggcagatattatatcgttttggccagtctagtttcaattgatgatctccacgtcctaaaaattggtacactattagaatagaatgctcttaccaactacgatgagcgttgaactagataattgtagggaaattcattttggggcaggaaaaccagtttggaaatatcatctgaatttatgtagtcttaccaaaaagtgcacgaccaagactattgttttccaataactcgtatatcagcagtagctgttctccatcaatacaacaaccaaagagccttacaaggttaggatgccttagggcagatattattcctatttcatttaaaaactcacgattcccttggctcgactgggaagagagtttcttaacagcaactgtagtaccattggctagtgtaccctgaagatagaagattggttaacagtgtgttacaactcagaaaggaatgaaagaggtactgaattaaaatgcctactgttagtttattacatctgagtgctggtcgattcacctttattattatttatatgtttcttagttattatgttcgatcatctgagtatgttgcagtggcagtgaattacttatcccaaaggcagtgtttggctaatgggataggggaaatgatttcccacccaccaaaagacatctttaaatcctaaccattcatttctccttttccatttaatcttaacccttcattcatttcccattcccaataccaccccccatttcccattatccaaacacacccaaaatgtgtataccatatgcagtgatgtcatgaatacaaagtaaattttctgtattctaacaccttaagggagaaaaccttaagttcacagtttttaccttgtaaacaggtccaaagccaccctcaccaattttatttgcaggatcaaaatttttcgttgcagattcaatttcttttaagctaaagaagtactgtgtccgtgtctgaagatctgaagtatcggtcttccttccatggtaaaagaattgtaaacctgtgatgcacagtaaaatattaaaactagaaggtagaaacactagtgtattttggatgtctgtcgtcaatattagctgacgagcatatcaatttt

SEQ ID NO: 8753 - DNA, 758 bp, Oryza sativa
atgctaattattccccatgattattcagcgttcgcgaaaaattccccacgattaattcccacgttttttaaagccaatgatcgcctcttttttaattccgtcctatgccctgttccttggtgttaattgcatgacgtcactcaatcatctccccaagttagtttatctatcctgcctccaactgccatgaaattgcattgcatgcatgctctcatcaatcctgtcctgacctggagtatttatctctaagccaatcattttagttaactgcaactcgcacaaagaatactgctatatcacacagaaacaatatccatatctctctctcttttttttttaccatcgcccatgtatttgcttgtgcctacctacctgtagtcctgcatcgatcaaatctatcgccgaccatcgtctactttaattcccaacatatatacttttgcataggctcatactcatactcaagtatatagtaattaattaaacatacatgccgcttttattaattattcttgctgtgtatagcctagatcgagatggatattttttctgcacaaggtacttagctatatagagattattaatgagaagagtagattattaattgatgatcaggggagggatgtaataacttaattaatttttggataattaagccgcaacaaccatatgcatgtacgacgcagctagcatatggtacatgtacttttgatatatactgatcacgaatacccgtactgtactttttttcatctcaa

SEQ ID NO: 8754 - DNA, 452 bp, Oryza sativa
agaggacccattacctgttctgtaccgactagccccacaggttaggtaactgttcaagtctacatattccttgtagtacaatacacaatgatttacacatgtatgtatcttttggacatatgagtttcttcgcttgatacgtgttagatggcaattagttaggtttaggaagcaaaacacttaagagacccaacaaaccattgaagctactatcggatcatttgtgtctggtcttcaatctgagaagttcaagcatcgaaggcaatatcgtaaaatctttctcacatcccttggattcgtcgtaaagaagatccttcgctgactaaactaacgtctcctaattatctaatcctctcgctgaacccattagcacctttggtttagcgtgacgtggcatatcccccagaccagaaagagctttaaaatcatcaatacgagtagaactgttctcg

SEQ ID NO: 8755 - DNA, 721 bp, Oryza sativa
tttggttctgcgtcttccacccatgattaatttgatcgatggcgacgctctgaaaatgacattaatatacaatcgatcagttccttaccgtaatatgctacatgctcgcttttttacttcaaaaggtgaatcatgtgtgtgcaccaggacttataggtcaaaagtagatccaacaaacaaacagttcaccaatagtattacgctccacattcatagaaactagcgatctgtattttatggatctgaggaagagaagagaaaaaaggcgaacttcgttggagggggagtatcgaaaatccgatggtccttgagggaggcagcaacatgagattgtgatatgttggcggcggcgtaccgcaagctatggcatagtaggaggcgacgaaatagaagcgggaggtatagtgaggcataaggcagagggaagtgtcggatttcggcattccttgaggtggtagcgatggggatcacggtagtagcacatcgtcccgaaatctcatagggcctgggaggtggcgtgcggcagtgacggacgtggtagtggtgggacgaacgttgtgctgtccgccagccgcactttgctaccggtcgccgctcgacactggccaccaagtcttccactcactttttggtagtagcggtgggtgtaggtggttgttaccgttgcagttgtgttgtctttcaagtactaatatcggtgacgcctatgggagtcacacct

SEQ ID NO: 8756 - DNA, 8576 bp, Oryza sativa
  unsure (1)..(8576): unsure at all n locations
agtcaacggtgtcaaacattttgaaacggagggagtgctattgtactagcgatgatcacattagccaggttgctttatttggctgtgtcagtaataaagacaggagatataaaccgtttttatcaattattaagaggtgtttcatcagtcctaaaatgtaagaacctaacactggatgagatatttcctacccattcaaattcactgtactagaaaatgttccatccagtcctaggtttttatattttaggatggagagagtagtttgtttttttttctttttcttcttctttttctttcttcacgaggaggaggagatcgatcattagattcgatggatatatcgtagctaatgcgggtatggattattaaggatatttaaccgttacaaattcgtcctgcagctatatgccgtacgtgtgtcttggtcggccgtgtgtaaatctcacggaaaaggacgttgtcagggttgttcaacaaagctttaaagtgatgcaacgacaatgggcatagtgtcatccattgatgacattaatcttacacaagtggggtgttatgtcatggctcatggggaccttattcaagtttaaagagggaatagcaattaatggataagtgacattaatttagacaagtgaccagcattctttccctctttttagttatagccccccaatacaaaaatgcgtcccacatgtacacaatatcacagcactagctacactaactcataagttcaagtttctgattttcttttggtgccaggcaacgtgtgatatagtgacttcgttaatttcaagtctattagtctcaatcgttcgaagttgcttataagagcgcatatgcatacaattgataagggtgacgagcatatactggctccatcgtaaaatatagctatcagatgcgacatatcatgtattagttagataattcctccgttttagaatatagcaaattagaactagattaaacaccatataacacaatgtatctatgtgatgtccaatctagtttctggttactatattcctgagacggaggaagtatatttaagaaggatatagcaattgtttgcgtttgtattgcgtttagcgtagctcaactggttaggtttattgtggtggaactaacccacatgggcttaagtcataaacttgatacggatggtcgtattttactgttaattatttatttagtggtaggcgacgtaccccttgacagcgagacacccgtggtgtttcatacaagctttgaaattttggaattggttttgttgccggtggggaccggaattttagaaatttgtttgccgaaattatttgaaaatttgattgattttgaattaatttgaataaaacctgatcaaattaaaaaaaaattacaaaaaactgaaaatttcgggccaagatgtgagcttgccggggggggggggggggaggggtggnncncaanttaccaaaatttcataaatttccaaccgaaatttcaaaccctggtttcatcaattttaagatataccggcccagcctcgtggatatactcatagagacagggtatgcgtatgcgtatgcgtgtgttataagcaccaacgattgtactgtgtttctcaaaagaaaatcacacccttacttacctaaccatttaaccaatgatgtttgcaccaagagaaaacatcatcaaccgcaacttacttagctcacaaaacaaactgtcctggcgaccatcaaatgatcacccgagcccatgacaccaccaaaccaaaccaaacccccccaagatcacccacacaaacacacagtggagggagggaaggaggcgccaatctagagcacacgcaggcaaagtctcgatacagcaggagggcgagacgcagacacagagagaggagaaaaaagaaaaatacagcgagacatcgcgcgaacaggaggaccacttcccccctccctcctctccagtctccctccgccgcgccgcgattcccctccctccctttcccccccgcgccgtcgtcaccgccgccgcgggagagggggcggatcccgaggccgacctcggcgagccagatctgggccacatgccgcccagctcggcctagatccgccctgacctagcgccgagcgacggggtgggggcatggaggacgcgtccaagtacgcgcacagcccggcccacctcgccgtggtgcggcgggaccacgcctcgctccgccgcctggtcgcggggctcccgcgcctcccgcgcgccggggaggtggccaccgaggaggagtccatcgccggcgaggccgtggccgacgcggtctccgccgccatcgaccgccgcgacgtgccgcggagggagaccccgctccacctcgccgtgcggctccgcgaccccgtcgccgccgacatcctcatgtccgccggcgccgactggtcgctccagaacgccgacgggtggtccgcgctccaggaggccgtctgcacgcgggaggacgccatcgccaccatcatcgcgcgccactaccagcccctcgcctgggccaagtggtgccgccgcctcccgcgcgtcctcgcctccatcaaccgcatccgagacttctacatggagatctccttccacttcgagtcctccgtcatacccttcatcggccgcatcgccccctccgacacttaccgcatttggaagcgtggagctgcgctgcgtgccgacatgacgcttgccggcttcgacggcttccgcatccagcgttcggaccagaccttcttgtttctcggggatggtgctcgtcctgaggatgctgggggcaaagagttgcacccaggttctctcatagtgctggctcataaggacaaggagatcacagatgcattggagggagcaggggtgcaaccaacggaggccgaggtcgcacatgaggtggcgttgatgtcaaagacgaacatgtatcgtcccgggatcgacgtgacgcaggcagagcttgtgcctcatttgaattggcgccggcaggagaggacggaagccgttggacattggaaagctaaggtttatgatatgttaaacgttctggtgactgtgaagtcaaggcgtgtgccgggggcgatgacagatgaggagctgtttgcgatggagggggaggagaagaatgggaggggcactgaacttgacgcggagctggatgaagtgttgacagccgaagagaggaaacagcttgattctgcgttgagaatggggaaccaggaagaagaatttgaggagaggtgcgaggaaggtgatggcggggctgatcatttggatgcaaatggcgtggcaaaagataagaagggatggtttggttggggtggcaagaaaggcaccaagaatgacgagaaaccatccaaggcgaatcaagggagtaaggatgaatcaggtgacctaggaaagggaaaggagaagaacagcagcaagaagaagaagggtgcatcatcaggggattctactaaacatgaaagtgaatacaagaaggggttaagaccagtgttgtggctgacaccagatttccctttgaagacggatgaactgatccctctgcttgatgtcttagcaaacaaagtgaaagctgtcagaaggcttagggaactcttgactactaaactgcctccaggcacatttccggtgaaggtaaccacctgccaacttgactatataatgtccacctatttcagcaattaactgaatttttgatatgccattcattttagtcaaaatttgcacgcttattcatttgcaacataaatggtgatatgattctatgtaactcaatcaacgactgtttgctgattgtatgagcaattattttgcactggtttctttgactgccagtgtttgttgtttgatccacctgctgtgtcatgcgtcgtaattcactccctagctgggacttgtgctgtctgccttgctgcttgtgcatagtactgtttgaacctggttatgacatgtgcttgaatatgaaattatgaatatgtgtttctttattgttggcgctgatgcgcggcttatggctatgcatgtggtttttttccctttagaccggacatattaatacaagatagttctgttcaagttctagaactagcacatcttatgtgtgtcctcccgggtaatcaatccctcgcactaacaaggcattatcataagatgtggtgcccgccatgtgcacaattcatatgattgatggatgttcgaataaccaaaccttttctattagttaccactactattggccacccatatggaataattagattccaataatagatattatatttgggtgtaaatgataaatgtgcagtgtacttgcaaaatatcattgactatttctaaggatttgatgcatgatggttgatgacattttttttccttgttgtattaaactttatatggacatggaacactatcgagttattgaatctagtacaaatatattgtatatttctatttgtctgtttgccatttcttttatgtggtgttaattaactttaaaagtagccagtgggtttctgctcccaccatcaatttaataatctcacagatttaagaaatgccaaaaaaatatatccattgaagctttcaaaactttcatatgtttatttcctattcatccactctatctcttcctctgtttgagtcttgattagctgggtcctactccaaaccaccataaaactgatgcccccctgtaccctactgaccttgtatccctaaatgcagttgatgatccatcgacatcttgtgaccactcttcctgtcaaatgttatttcatgtgtcatcttttctttggtgaatgctgcagtaatttttccattgcattattagactatttttaccgctttccatgttttgttgccatgctttattgtttctaaattggtacagatgtcttgtctcaatgtgcatagcaatctgaatcgtttcattttgttgtaacttttttggaatctcatcatttgttttgaatcttagttcttgttggataaggcattgtggtgccagtacaagacgtttgcactgcatcataattattatttcacatagtctcaaatttgaaatcagatctcttcttttaccaaaattaacatcactacagttacttcgaaaatgagattcacatgaattaatctatattttggaaaagatgatatctaactctctgtaacattgattttcagattgcgatacctattgttccaacaatacgagtcatcgtgacattcacaaagtttgaggaattacaacctttggatgagtttgctaccccaccctcaagcccaacgcaattccaggatgccaagggcaaagaatcagaaggatcaggctcatggtattcgtgggttagaggggggcgtggtgcacagtccagtgatagtggtgatagccgtaactggaaagatgaggttgatccattccaaataccttctgactacacctgggttgatgccaacgagaagaaacggaggatgaaggcaaagaaagccaagaacaggcggggctcaactcggaaacaatcatcgaaaagcacctcgtcggaaggaggtcacccgatgatggatggctttgaggagtaaaaaagtttcgccacatagcaggtcacctttcattcagagatgttagatgttgatgtcagctgtgctgcgcacctgacagcatagattgataatgtgctctggagaacgcgtagttgattggatctcctcgaggaagtacaggatggctatataccccgctaatctgtaattcaattctattttttgcccccttattttcttcttccagctggatgtatgtttgatgatcatgatgatacggccctgttgttgttaaagatgtgttttgtggggggctttttagctgtagcacttcccctcctgttgtacgaaaaccctcgaatctggcagtgattttctcgcaaagaggaagctcaatgcacatgcttgcttatgactgctgctgtccctcttctcttcgctttgtttccaaggaaactggacatcttatgcttgccagagacgttatcttgctttctgttggtacttaattagtacagctgctataacttgctgtagcttattgtgtttcaaagcagagtaattgtggtgctctcattgaggctaagcagatcatttacagtctgctgttgagagcgaaaccctgcgatgcagaaatgtacaaaactcatagttgatggattgaaaggatgttatatgattgtgaaagatcatgcagcttactgtcgatcagatgtcatcatttggtagcagtctctctcttcaaatgaggttattatggccacacacagtttgggattttgccggttggtaagctacgctatcagcttgagggcttgtttagagcgaatagttaaggggaaaacaaggttgaatgccagaattagaggtccaaccagctggattacgctgaaagagacgctacaatccttaccattagaccctgttttttttttcaacttcaaacttcctcattttctattagcatgtttttcaatatgttaaaatatacattcttaaacaattcctatatataaaagttattttaaaaactgaaaataactctattattcaagtttataataatctgtattaggtgcacttatattagtatattctactaggatatcctgtattatgtgcacttatattgggacgaagagaatattaataattaattaattatatgcttatgagatttactgttttgcgtgtgcttaaaattctccttcaatgggaggcaaacgaacgggcccttagaagctcatcacttgggccgagtcacgggccttagcccaacaagagaacagaactggtcggtcactgacaaagcggccccacctaatgcggccccagcgcttttcggtgtacccatgccgcctgggcccacagccacagggcctcgcgctcgaaacatttcgaaatttgaaacgcttctcccggtcgtaaaattcccaaatcaaaccattccttccccaaaatctcgcaaaccatctccctctccctctcgtcttcccccagatccccccaaaccctaaccctaccatcgccatggcctcccgcatcaaggaccgcggcaaggccgcacccgccgccgcgggatcccgcccgctcacccccaaggccttctccgcctcgtcgtccgctcgccgcacccccgccgccgccgctgccgggaaggagaactcggcgtccaagccctccaagcccaccgccgcggtgcggtggtccacgtcgtcgatcccgagggccagcaggatcccgagctccgtggagtcctccaagctcgtctccaccctcagggcgtcctcggtgatgccggggagggcatctgtcgggaaggaaatggaggcggaggcgggcttgcggcggagcgtgagcggcgggatcagggccgctgccccggagagagcgaggaggtcggtgggtggcgttgggggtagggtcccggatgcgaggagagcaagcagcgtgcctcgtgctgatgagattggtaggaggagggatgggtttgatgctagggcgaaggcgagtgatgtgaccagtgggagaagagaaggctttgatggtaaggctaagcaaatgaatgcggttgataggaaaagagagagcttcgatgtaaaggcgaagcagatcagtgggaaaagagggagcttcgatgttaatgtgaccaagcaatgtgatgagatcaaaggggaaagagagggctttggcaccaacgcaaagaagcaatgcgatgggattgatggcgacaatgagggctttgatgtgaaggccaggctaggtgacgaaatcaataagaagaaagatggatttgatacgaaattggtgaaagagattcatcccaagaaagttatctctagtgtcactggttcggcagaagcttcttccaaacctgcaccttttcctgctactgagaaggatggtgacggaggcaacaatgctgtcatccctgtattcactgtccatgtggtggacgtggacgatgttccttgcagagccagggaagagcagaagaatactgatgagcctaagaagcaggaggaaaagagcaagctggcagacaagattagagtttttgagaaagcgtctgcaagtgggggatcagtgaaatctgtttctagtttgaacaagtacccaagcaagctgcatgagaaactagctgcattggaagggagagtccaaaagatagcgacagatatcaagaagaccaaagagatgctggatgagaataacccggatgagcctaagcagatattatctaatatccagaaggagattactgcaattgagaaggcaatttcccatgtcaaggatgataataagattcagctcggcactgcagataatagtgagtgtgagatctcttatgctaaaaaggctgcagagtgtgctgttacaaagccaagtgacccgaagcatgctgcaaaaggtatgaatactgatgaattagaggcgaggttctttccacatcataaattgttgagagactgcaaatcgtctagcgctactcaacaggaatcgtccatggctgtcaaaaagggctgcag

SEQ ID NO: 8757 - DNA, 10849 bp, Oryza sativa
  unsure (1)..(10849): unsure at all n locations
tcgtccatggctgtcaaaaaggattgtaacacagatatggaactttcttcccttgagcctcaagaagatgagaatagtatagccatggagtttctggcttccttagatggtgaagaaagcggcttcttcaagaaccgcagagcgaagaacttggaaaaaaccatcatctgtgaagcagcagatgttagcagcaagacatcgggccaaggttcctcaaataatccggtaggcccaaaccatgacaaagaaattgaattgcttgctacagagaagctagaagagtttgatgaacaggagaacaagtcctttttgattttacaggaggaaacagaggaattctctagtgatcagttattagggatagggaacaaatcctcaactggtggatggtttgtttcagagggggaagctgttcttcttgctcatggagatggtacctgttcttactatgatattgcaaaccgcgaggtacttgattcattactatgttttctttttgttcttttcataatttatgttaatacaacattttgaagttctgattgcattaaactgaaaatgacagttcaagtctgaatacaagcctccgagtgtgatctcaaataatatgtggggtgattgctggttgatccgtgccccgggtgttgacggatgctcaggaagatatgtagttgcggcatcagctggcaatgcactggaccctgggttttgcagctgggattactatagcagagaagcaaaagcatttcacattgaggagatatctcatgcttcttcagtaccatcgtccagaactgttcttgggcctcttcctaatgtaggttcatcaagatctagctctgcaatttctactgtagaaagacagcaatggtggtatagaccctgtggctctcctgctttctgctgctagtaagcaaaagatggtcacagcttatgacatccgagatggtgatgtagtgatgaaatgggaagtgagcaatcctgtacagggaatggaatattccagcccactacaatggcgtagcaggggcaaggttgtaattgctggtactgagtcgattgggttgtgggatgttaattcgcttaacccacaacccctgttatctgttgcttctgctggcaaaaagctttactgccttcatgtgaacaacactgatgcagagctgggcggaggagttcgtcaaaggtacgcctggaattattagcttgaatgccctttgtgtaccattggtaacactatactagatcctgtctggttgaacttggcttatgcttgcaaatgcaggattttttagttcatttaccaatagctgatttttttttgtcttgatcattgatgattctgaaacttggaaatgtaactaatctaaaggagatgtaagttctgttttgtgtgagctgacatgttttcaaagttaacttgtttatcgttctgttttgcagagttagttcctgtgaggtggagggaaatgatggtgtttttagcacacaagaaagtgttaatgtatttgactttcgtgtacctgctggcatcggtcttaaaatggcaagacatggtggtacagcaagttcaatcttctcacgtggtgactcggtattcattgggagcacagaaggtaggctgcaaataaaagggggtctgaaatcacgagttcagcaatattcactgagaaagggaaagcttgttgcaacctatgagctacctgatttcaatgcccacttccatcactcttcaataacccaagtatggggcaactccaaccttgtcttggctgcatgtggtatgggactatttgcatttgacgcctttaaggaggacggtcaacaaacttacagctttgaccgtggagccactcttggagtaagagaggctattggctttgatgatttgtactgccctacattcgattactcgtcatcaagggttcttcttgtctcaagagaccgtccagcacaatggaggtatctgtcatagctatctatttatcgtgtgcatcatgtgatcgacatgtaatatatttgtactatgtttatgctttagcttatttagtcatctgtagtgccaagcatcttgctttcactgtattagcagaaatgattgggtttcttccccttcagttaattaatatctattgcatgtttattttaccccattgtgttcttatttccttctctaacattgacatcttacttattttgtttatcggcaaattatttgaattcagtttgatgcaatggtgcatatgaattcatggaatattttttttggagggtgggcatccatctccagatacatacataacacaaccataaacaaaattaagatcttgttagcgaaatgacgcccaacaatcttcatcggaccaagaagggattattccttcttttttgacgaactgcctcgattagctgctctgatttaagcttattccatcctaatcagcaacatcatggtcttgtgcaccaatggtctctgcaaactttattaccacttatgtaccaaatctagcggcaagcagcatctccattcctggaactctgatccttactggccttgatgttggcagcatgccggcatgtcctactgcttaatcaatcagtttcaagttcacggaatggtaatgggacagtcttcactgctctgaacttgccaacgttgttcaaatgttcattctccaatctgcaatcccataaaccatttcaccatgttacaccataacattaaattaaaattgatgttccttgtaaaagtacttccaattacctatagaagttccaatggcctcgtctgattatctctagtgaagcgagcgagaaatccagtaagcgggactcaaccttaccaatatggatcttcattacactctcagtccatgctaggcgaagtgcaagattgagcatctgtaattatttgaaggcatgtagtgtcctaggatctgggaattttctaggcgctagtcagagaatgaaggtatattaagcataggtaccatgggatacggtagtagattggatttattttcttcaaggatgaggctcggttacggagcgcaacggnntctttattttgggtttaagaagccccagtccttgacaaagtcccagtagagctggtaaattgtggcacctgaggatgaaatgatgaccatccacacccagaatggtgttggtgttgcagcatatttgaacctaacagcagctgctaccattgctgatcatattttccagcattagcaagttggttgatatcatgtccttcctccaagtaccttcttaaacacttcaaaacatgacacagctattagtttgaaactgatccaaacaaagttgttaatcgttagtatttcccatctaaagattcatacctgcaaggctctccagaagtatgggagaaaggagatcacataggccagatgcttatattgttggccactagtacaggtctcatatgggtgagttctaaagcttccagccatgaagtagcacgctgtaaattccatgtgccgtaatagtggaatctgcagatagtagcaccagttcactcataagatgctgagctccaactctcaaaagctctagtgtaaagttcagtttcttcagtattacctggctagttagttggtcagccatgaagaaatcagccatcagaacctgcatgtcaaagcagcctgcttatcagatagatgctttcaacaatttgtgataagaaaactcatgaggtctttagtctttaccttatagaatggtgaaaatatgatattgcgcatgacacgcatgaagcagtatcgcgtcgagcggtagaatatgtcaaatggacagaatagtacacctgttgacagctgaaacaacagaatccgagttgagaactgaaaatcagtacatgaaacagagctgaattaccaaattttcccaaagtttatgtttcttactagtaggagtgctccaggcaaagcattggcataggctacaccggcgttcttgaggaaaagattgatgaccagtgcagcgacaacagtgcacattatcgatgcagacatgaggaaggcgtcccggtgcgtcaaggcggtgtttgaggagaaatcgaatatgaagttgtgattgatccttgtgttcttccacatgaagaggttgcacccatacaggaagatgtggaggctgatgagagcaaacatgctgcagaagcaaggtcacatctatacattactttgaggtaaaattgcatcttttattatcatgaggtcctaagtctgaaatttgaaaaatttgcaaacattgagcccacatgctaaatctaatcaattgaactcttgtcaagaacagagcatatatagcctgaacagaagtaccaagtacaaacgcagtaataaaaaatctatttctaaatagtgctttacccctagaactgaaccgtaattctcaagaatttacctgaaaacatggtacacaatttccatgtaggctgagttcccagtggaagtaaaaataccactaacatgggctaaaatcgcgtatatgatgaacagtgaaacaaaagtgcccgtgaacaaacctgcaaattagaacatgaaaaaaaagaagaagtgaagttagatttgtgtgccaaatgcagatgacagatctgatattctgatcttgaagttgctcagctacatgcctacgaggaaggtgatcatgtgagtgtttctgggctgctgtggcttaaggtatttcatcgccaccttcctgtcattgcctgtgaaatgcttcatgaagatgcactcgacctcatctgctagctgaagtacctgttcagaatttcgcatgcttcagttcatattcgtcagagagacatgtttccatcccccaaaaaactgattgaagtgaatttgtatgtttgtgcagctttgcagtaggattgtggagcaccagatgataccttgtcggagctgctaaatggcgacctcttcaccttctctgaaaacaggtctgtagctcgctgttgctcggacacctgaaatgcaaagcagttcgtaccagtcactgtcagctcggagtagcatttttttaaaaaaatatattaaaaaattaaattattccttgcaagaaaatgtttatgctgtctcatgttattaggctgactagtgactaggattacactgtcgagaatgagatctagtacctctgctttgagggtactaaactactaatagtacacttagaactttattctcctagaagccttatatatgtagaccggttttctttaatctttatcatctattatttagactcttcattcttccatccatccatttcaaaagggcacagatgtggctaattagtatattaccttgacaaatttcttcaatattttggtgaaagcctttacattgagagagctgctcccatccatccatgcatgcaaccaaaaaagcatccaaatccgtcagaaccacaagaacaccataattgacaagtaaaagaaatataaagacagccacctaaaataaccggtgaattaatctaccttttcaaaaaccacaaaagaattagtaatttgaaaggagaaacagtcgctttcaggtgacacaggatggtgtatggatggctacgtgatttacacggatgcttccatgcaaaacggggttgaaatttgactaaactactactgtactgcatgcttgggtgcagtgcaggtgtagttgtgtgctgctcacacagtgctccatgactcatgctgcaactaatattcatagtagtaatttgttagatatacatctatgaagaaacaacttaatttttttttcctagttggtcagttaaccaaactatctatatcatttgtgtgcatgcaattagtgtgatcgatcagttgcatgctattagtgtgaggtttggccatcagaattctaaatagcttacaaatgcgtatatatatgcatcatgcatggcatagaagacaatatacatagacacaaaaggcaagtcttgttctaaaataccgtgacttcgtggttttagcttgtcagatatggcaaaaaggaaagatgaagagggaagatgtgcctgaatttcttgagcagctcgaggccgcggtagagcgccatgaaggcgtcgcggatgttcttctcggcgtgctggatcttcttccggtggacgaacgccgcggcggggtcggcgccgtccttgcggagcacgttcacgagctcctcccacaccttgagcgccgcccgcccggggctcgtcgccgggatgtcgatcctcaccgtcgctggcagctgcagcacgcctccgcctccgccgccgccgccgccccgccctttgccgctgccgtccttggtcttgccgtccttcttcccggcgagccccacgaagctgacgccgttccgctccagcgccgccatcacctcgtccgccaccgccgcgccctccgacacctgcgcctgctgcaactccaggctcccatctgcaaaacacgccatcgacgacgacgacggcgacatcgacatgacatgacattgcatgcataaagagatgtgcagctagcccaggattcatgtgtgtgggtggttggtgtcacctacctgacatggactgcggcgaggagaggccggagaggaggtagcggccgctggagccgtgcaccgacgacggcggcgaggaggacggcggcggcggcggcatagagcggcttcgggcgaggccgcgggcgcggcgggcggcggcgtggtcggcgaggatgcgcttgacgtcggcgaggatccggagctgctccagcagcgcgtcgccgcgcgccagcagctccgcctcctgccccgtgtagaacgcgttcaccttctccagctcctcgtccgccctctccatgaactccctctcctacaccatccatccatgcatctccatttttacaatcaatttaattacttagttttatttacaatcaaattaactaattaattttatacatgcttgtccgtggatcgcacgagctcccctctgtccgggcactcctcatcctcctgcgaaatgcacatacgtattaacatcagaaatgtgtattaattaattaatacacgtttattagttagtatttgattcgagacacaacgacgacgtactgaggcagaaggctgttgtccagcggagaagcgggcggcgatggcgcgaacggggtcaagaatggagaacccatagccaccggcttccttctctgcgggcggcggcgggagaaggtggtcggctgcggctgcggcgttggcggcggcgaaggagtcgtcgcggcgggtgaccttgatcctcttgatgagcttcttgagccgcttgtagtcgacgaacgcagccttccactccggtatgatgctcgcctcgtactccctcgagaacttcaccatcttcttcttcttcttcttcctcgttgcagcagcagcagcagcagctgatcgatcgatcgatcgaacaattaactgaaacgtacgtacgttcacatgtgtggaatcgagctaggagaagatcaagatggatggatggatgcaggaaagggacaggcaggcagggatgatctcgcaagcaacaaccgtcctgccttgttagcttatatagatagacagttagagagagagagagagatcaggctactagcttggtgctcttctccttcttcttcaatcctctctctctgctcacctcgagtgctcctgctatataagcttagcttagctaagcatgcagcgaaatttggcactgctggtgcacatacagggacagatagtggccttgtatgttacaatattaggtagagctagctagcttagctaaattaaagtagaaaggtgtatctgaattcagagatatatatatacacttacatagtggggatcgaccatgccattcgtagaactgtttgtgtcctgttcattcagttagtggcttagttagttgcttaattcgatcagtgggatcatatatagttatattattatatactagttatgtacacgtaattaagcctcgtcgcatgatctggttggatgctaattctgtattaagggagaaattgattaagtaattacttctaattagagtaaggcagtgtatacatatttgtagcgcagagaattaaagaggagaaggaaagaaattaaagaaagaaaggaaagaaagccggttgctttaggccgggttgttaatttgagcggcccatcttttgggcgaaaaggcaggggcaatggagtgagggaaacatgagcagctgcaggaatcaagcagagacagacccttgcttaacctactcggccactcacactcaggtgaccatgcatgcagctgctaattagctagttgcctcctctaaaaaaagacaataactaatcaagtaattggctagttgacatgcactataattttcttattagtatcactaatcagctcatgtgttaattaattatttagttaattaaagaagagggcagtgtccaggggagtaggactaattaaggtcgtaaacttttaagtatgtatgtggatttctatgtctaaagtttgatcgttcgttttgttttaaactttttgattagtatttttgttgctattagatgataaaacatgaataatattttatgcgcgacttttttttattttttttataaattcgttaaataagatgtgcggtcaaacgacaaacacggaaacccgctaatgtatttaaaataggatggatgattatataattaattaattaattaattctgattagagtgttttgtgcggtgcagcatggagtgactgtagatatgctatagctttacacatatcgtggttcgattggatcgcggaaattaatggatggatggatggatcgatcgcaagttggagacaatggagctaagcttagctagggttctgctagtacagggaccagatcagccggatgctctccatgtatgcgcaatggaggccacgccaccgccgctgctgcagcgacgccggcctgacgtggccatgacgccgactcctactcctttttcttttctttctttttagtgtttttctttttttttaaaaaaaaggtatatttctctaggcgcagtgacgaaaactgggtagggcagttagggctgttgccctaagcttaaatatctattaaaagttacatttaaaaacttcaaaacacgaaaaataaaggtaaattatgtaaattatactagttgtgctttaggcgtgagaaaattctaactacaccactgctctaaggtatctatctacaattgtagtggagtacatggtatttgtgtgtgtgtgtgtgtttttaaaaaaaaagataaatatgaactgatcggttacacagtaagcatgcatgcacatgagctgagttggtcggatagtggcgcagccgtgcaacggaaaagtgtagctaaggtcgacagtactaacaagtcgcatacctcatcctaaaagaaaaaagaaaaaatatgttcactgtatacggttggctctggtatgatcgatcgacggcgtcgacgcgaccatcattaaatgaactagccgcccaacatcgatcgcttaatgaaactgaatcgaatttgccgtgcacactttttttttcctgagcttctagataacgtgatttttataagaactttctatatttgaatttaattttttaattgctgtttcaaatatattctttaactagaaaaaatgcccatgcgattgcaatgggtgaatgatattttaatcttattattgttatatgtttagctaggatgaaattcactgtgtgcaattaggagtccgactttcatttcaagttggcatgcgagtttttttaagaaatttcttatacaactccttttgtatttccaaaagcaaataaacttaaaaaccgactcaaatacggatgacgtaccaaaataccggcaaaaatattttcaatttttataatagtagggactagttaatatttactcactccttttctgattataagtcgttttgattttttttctagtgtaaatttataggaaaaaaattagcaatatctaaaataccaaattagtttcattaaatctagcgatgaatatattttgataatatgcttattttacgttgaaaatgctataactttttttataaacttgatcaaacataaataaatttgattaggaaaaaaattaaaatgacttctaatatataaaattaaagagagaaagtaatttatttgcttctacccttaaataactatcacaaatcactagctattcagtccttcaacacaaaacaacatgtcataaatggaagaaaatattaggtcagccagtttatttctcgtattataagtgcgcgcatacgtacgtattacctggcattaattaactagttcgcttacgtacgtacataacatatctacgcgtgtgtgtacatacacatccatctcccctgcgcggatgcgggggcgcgaaaaattttgtctccacgacgtgtatttcgcgccttttttccgcaacggaaaaaaaaattgaaacggtgaggcgttattttgcctccatgtccgttacgcactgcagtgtaagtggtcgcagctgccgttgcgtcgcacgtcatggggtccaagcagaagtgcagaacagaagaaagagatcgaagaaaaaatgggtaagtacacccgcgttgcgtacacgtccatgacacctcggatatggtgcttgctgcctccctcgccacaaacaataggaaacccggccgacctcgtttggtataggtccagctaaattttgttatattcatactctaaactagctgaagtcttatatttttgaaaaaaaaatatagtagtcatagtcttgtcaaacaccatagagcttatgatgttagg

SEQ ID NO: 8758 - DNA, 2040 bp, Oryza sativa
cacccgatcagcttaccttgccctcttctcgggcaggatctcgtttcagcacctaccaatctggcgctcttttgccccacctcagtgtcacgtcgctacttcctgtggctggtcgctcactgcgctactggacgactgaccgattggagaagcgtggcctgccgcacccaacctattgtgtcttttgtgaccaactggaagaaacagttgatcacattctgattgggtgccttgagtccctatagctgtggtggactgtcctttcaagccccggcctccctcagtgctttccctctgacgctgattccttctttgagtggcactgctcctgtcggctcaaagttccgagggagcatcgtcgtgggttcaacacgattgtgactcttggcggttggtctatttggaatgaaaagggacaaccatgtgttcgacaaccattcccggccctagcctgaggttgtcgcagccatggcgtaagaggccatcctttggcgtcttgcccatcccccgttgccagcgcttcctagttagcatgtttggtcgtttggtcgttcggtcgtcacaatgtaatcgcgagaataggcttaagtccttgttttccttttcttcctcccttccccccctcctctcctctcctctctctctctctctctctctctcttctttgtttgccatttgtgtaaattttattcctcttaatacaaaagtgcgtaatccttttgcgtattcccgaaaaaaatctagaaagttcatcttttcaaatccaatttctggtagtagatctcataaatcaatggttgaggtcatttctatgatgataatgctagtagtaaaacactactagtacagaccaccgtaaaggtacttttaaaaaaaatagagagaaaggctagtgattagtgaatatgtgtattcatcaaagttcactggattttttgggtcatgtcttcaacaaatcaaatggttgacaaagaggagaatgccctggttgttctacaggaaactttttttttttgaaaccgatgttctacaggaaacttgtgtgtcaatttcttttacatggcatagctgttactgtcatactactataaaattctgcaattggatctctcgtgtaccacttatcagcattatgagtaccactgaaaatttggtaagtgcatcctcttttttcttgggtacactggacctcaggataatatatatctaggattaagtggataccagatcaaaatatatggacctgatttgatataacgatactgttttcctattagctcagaagtttcacacgctaaagttatctgctaggatggtgcatatatacatgccctattgccgtacagaagcaaacttaggccaaacatatctattcagaggagctaaatacaatgaacaaggtttagcagcttctgaattgcttaccagaaccggtccttgttcaccgacagatagccagacatcacctttcctgcggtgttccgcatgccgtcgatgaggtagcaccaggttgatcccagggctccaatgaagaaatctgcttcagtggccatgatgaaattgacaaggggatagtttgtgctggtctcacggcccaggctggcctcatacattgccatgctcacattgacatcttggcgcgtcacatttgtgaaatagaaattccatttgggatataattttgtttcgtcgataacttcctacatttcagcattagcagagttaaattacagaccaatgaaatgaagaaattaatttacaccatacgagggatgagaattgaggagttaaattgcctgcatttcagtagaaagccagatgttcttgagacttggaaaacgttttcgaagacgaccagccaactccatgtatttctcaaagccaactacttccatttcacaagctttatctcccatccttacatgcatactgataaaaggcccgggtatatatggtttatgctccgaccacacaagtcgctcaatgtcagattctgttctgctaatgctaggctgcaattgtgaaatctttcagttactt

SEQ ID NO: 8759 - DNA, 2985 bp, Oryza sativa
  unsure (1)..(2985): unsure at all n locations
tcctgcagcccttgaggtagcactacacatatcatattatcaattcataatctacaaggtaagctggattgttcctacctttacaaccattgtgatcagcacggttgtagtatcctgcaactagaatccttctctcttttatagcaatagcaagaagtcccgacattccagcgagttgcgcacctatacaaatcccggtagcctctccagtctgcatagagaaacctcaagcttggatcactgcagtttggaggatgttgatgaatccatacatctctctgcacttgtctggtcagtggatagttttcttcatctgatcctgcaatctttaaagttttgttgtaactcaaaagttagaatactgcattcatagtagtactgacaagacaattacgagttcaggcaagtttacacacccaaggtggatatggcgccctgtcagatttagcatttgacctgaaaaacatttgcctccactcttctgaatctgaatagttctggttgaataactcaagaccaagtgaccctttccataatgtccaaggaggaaatacgccgttgtcgctataactgtcaaatttcttatttctttcccatttaagcctgcaattctccagatgaggcggccgcggcacgtctgaacttttcataacttcatcactggtcgtatccagtaaagtgctccaagcattatacaaatgcattttatcagcttcattgatgtccttgctattggtggctatttctatcttttcttgtaaaacagataagtcatctgtttctgtagctccacctgcatggaagaagctggttacacagacattgtcacagctaaaaggaaaagaaaaaatacattcagcctagatgaacatatagtactacactactactgaattttttatgcgaaatggtgttcgcaaaataccaggttcagttgatgttgaattcaacaagattgctcgccgaaccggtggatgtaccgatcggatcatcaggatttggataggtgggagagcaacaccaaacaggtacacaatgcagacaccacagaagaagcccagtgcccatgtcttgcagggagcagagctccccatctgcagagccctccgagatataaacctttcaaggcttttgctgctgttgctgtggccattactcatcatcctcaattcctgaattcctcagatacctaccagcgcaacctgacccttgcattcaaacactgcctccaatcaagaaacaccaaatgcatcatggaatggaattcatgcaagaaaagctataaagacaaaaaaattcttcccaaagagtaagacaaatcaaatcacagatgagctaattgcttggaagacaacatggatttgatccacagatggcttctaagcacaggaatatacagtctacatgaaagatcatcggcatgcatgcacattaaacagattaccatgcgctaaaccccatcactaatcaggaaggaccaaggtagtcgcacaacacagccacatgcagaagtcactgacaaaccagtacagaaattgaaagatggttagctgaaaaacagccgctaacaaatcgcggggcttatcactcgtttactcccctcttactcggagtctttcaagtttcaggtacaagaacaggtcaaataaacagaccgaaattcaaaacaaaccaagttctctcgagtgtcaaacaactcaccgaatcttctgcaatcagcctaatcctgcaacttatgcatgcagagtgaaattcaaagctggaagtgttcttgtttttctcatctcctcctccgtcctacgccctgaaacaggaaaaaagagttgacgaccagaggagcaaagatcaacatgggtcagagaaaaaatcgttcaaaaaaaaaaagcaaaaaaaaaaattggccaacaaccatgttatttggttattctcttgtacttatcaaacttctcggtgagtcaataaattggccggcggcaaggaaaggatgcagagaagacaagttcagaaaagaacatttttccttgatcggtcgagattttgtgttcattgctcagatgaggctgaggcattcacctatttctaaagagaggccgtttttagcttcttctggtaggattggcgagaccgatcgaagtaaacgagcaaagtgaagtaaacaccattctcagggaaaaaaataaaaataaaatggaagtaaactcatcagatgatgttttggcgtgcttatgatggatgcattttactgctgttcatttccctaattaggtcaaacaattatctcatatgccttctctgtgtaactcgattttttgcacacagagagagagagatggtttcatcaagagagcatagaaaggaaggtgacgtgtcccagcgatgagttggtctctgtctactctgctctgtgctagacagctagagtagctgaaaaagcagaggaggtcacggtacaaacgaacaagacctgccacgtgtgggcccgacgccgaacacatgacaagtggcacgcgcgtggcagcaactcgctccacgtgtgcacgcagcgcaagagtagcagttggggtccacatgtcattgtcatcctcgggttgcgtggaaattggaacgtctcccgcaccgaacgcgcgctaatccgaggcgtccgtttgaaatccaacgactcaaaaccaatttggttgggaaagctctttttggctgtatttttttttctaagaaaagaacggttttgctattggataattctgctagtatatagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 8760 - DNA, 4305 bp, Oryza sativa
ttttagtatctatttgcgtcattatgctctacataaaatatgtgacaatacaagatccatattgatatatattcaaatattttattaatttaaaagcaatgtatttaaattgcagaagtgatttagttatacaatagaagtaacttagctatacaatagaagtaacttagctatgcaatagaaataagtttctgtagtagaagtaattatatgcaacagaataatttagttatgtaatagaagtacttctaactctctctatagtagaaataataatttacataaatcataaaagtaacttagataaaatgcaagtaaattgttataacattagaagtaaattcgttgtaggaaagaaaatatggtctatcgaaaaattaaatttaaagtccacaaattacagaatttactaaaaacaataatacaaataatcaatttagagcattatgaatgtataagaagtaacttagtcaaatctaaaagtaatttatatatatgataaaagtaacttacatatataataaaagtaatttacaaacataaatatttttttcgtcgcaatataatcatgtaagatcttgttgtaaagatttaattgtaatgaatacaatggtgtaatcggattgtatatcggataagtaattttagagaaaattttataagaagggtaaaaagaaattttatatagatgtgtaggcatttgtctgttgtctcccgtacagatgtgtaggctttctctgctatgtacgtagactttctataccgtctcctattaagactaaacagagactaaacagagaggcctctctgtttagattttaccttattttttatagttccatacctcattggatgcttcccaacttcgactagtgttcggggctcaagacctaagcgaatatccccgaaaaaaaaaaggaaatacgaatatgtccgtattgggccagcccataagtacggatgttacatttccccgtctcatgggccacttcggggcccacatcgtaccaggtgaaatgaagataatggaacacaaaatactgtatatactttttaacaaattgatccttttcaaaaacttatttcgaaactagtccctgcaaaaaacttcaatcaaaaataggccgcggactcagcgccatggacattggcgctaagctataacgtatcagcgccaacatcgttggcgctaaactctaatccgaggtgacatgaattcgctgagtcatcagatcttagcgccaaggtatttggcgctcaggtttagacgatttaaatagatgcggaggcatttatagtaacaccccattgatagcataatggtagtagagttctactctatccttgaagagcagggtttgactcccatctctctttttttttctttccttttagtttccctttttcttctctccctcactcattattaatatttttttcttttttatctcgttttctttttcttttttttccttttagttttccctttttcttctctccctcactcttccttatagtttccctttttcttctctccctcactcattattaatatttttttctttttttatctcgttttctttttcttttttttccttttagttttccctttttcttctctccctcactctttattaatatattttttctttttttatctcgttttctttttctatgtttatttatttattttcttttttttcttgtaatactatcttcaaaatatatgtttaatatgcaactttttttgaatttgaaaaaaaatattaaagtgctatattatatggaaaatgagaacttaaactgaaatttcaaatcaaattcaaaataaaacaaatttacaaacggaacagtcattttgtaaagaataagagtgagtattaatatgttttttcttttttttatctcgttttctttttctatctttatttatttattttcttttttttgtcttgtaatactatcttcaaaatatatgtttaatatgaaactttttttaatttaaaaaaatattaaagtgctatattatatggcaaatgagaacttaaactgaaatttcaaatcaaattcaaaataaaacaaatttacaaacggaacagtcattttgtaaagagagtgagtagtgaagagaacaaaacttattaaagagagtgagtagtgaagagaacaaaacttattttgtaaaatacatgagggaaaccaggattcgatcctagtaccctatggatgacagcccaagcatccaaccaccacgctatcacggtcttggttctatatgttgcttgcgcgattatttaaaccgtctggacctcagtgccaaataccttggcgctaagatctgatgactcagcgaattcatatcaccacggattatagtttagcgccaatgtccatggcgctgagtccatggcctatttttgattaaagttttttgcagagactagtttcaaaataagtttttaaaaatgaccaatttataaaaaaatcggctaaattactgtagtactacttgggtgacgctcgatcccaatacgagtatttataagatgattttaaagctactccacaagtagataggagtaataaataaaaaaacactttgattaacatcactatatgatttatttttcacagtttcggaagacaaattaattatctttgcacagtttcgctgcaccaccacccgattctatgttcagacaaaggatatcaccaaataaaaaaactaaacccataaatgcatagtagaatccaaacaatactatatattcgcatcagaccgacatagtacgttggacaaaaaaaaaagagtaaaatctatacgatgttatcccgtttgaacgaaatgataccttaaaaatatcgtatgatatctggtaagtatcatcttatctgaacaggtatcaactgatacctatcaaaaatcaagtgcctaggtgatatcttagaggtatcattcaatccgaacgagatatcgttctacattacttccaccgtttcaggttataagacgttttaagtatgatcaaagtcaaatcatttcaactttgactaagtttatagacaaatataataatgttgataatactaaataagtttcatcaaatcaataattaaatatagtattttcataataaatttgttactatttttttctacaaagttgatcaaactattttaattttgaccaaagttaaaacatcttaatctgaaatggagggagcatttttcttaagaaggaaacaaagaaaagttaccatataaaattgtttcagaattcaattttgatgcatggtttcccccattttgcatcgaccgaaaatctcgtgatttcgcggcgggcggtacacggcgcggtgcggtctccctctcgtccagcttcaaaacaaacacacttaccgttacgactccaacggctacttccctttcaaatccttccccttcccaagtcccagccctctcctctcctctctctcttcacccgcaactcgatctccaattctctctctctttctctcgcatcgaatccgagttcacatctccaaaccctagcgagctctctctctcgcagatggcgccgccgacgccctctccccggccggggccgccgccgacgccgcaggcggccatgacgaccccgctcaagacgcccgcatccaagcaccgcctccacttcccggccatgacgcccaggaacggcggcggcgggggcgccgcggcgggcggcacggagcacccggtggaggtgatcggccgcatccggaacctcgccgcgggggcgggcggcgcgtcggcgctggagatcgcgggcgggggcacggccgtgcgcgtccgcggcgacgccggcgggtgccgcgacttcaccctcgacggggtctcggtctccgaggaggaggatctggaggggttctaccgccgcttcgtgcggtcgcggatcgagggggtgcgggtgggcgccaagtgcaccgtcatggtgtacggccccacgggctccgggaagagccacaccatgttcggctgcgccaagcagcccgggatcgtgtaccgcgctctccgggatatactggaaggaggaggaggaggagggggaggtgtctctggtggtgggggtgaaggcgatggccgtggcgaggatgacgccgggttcgggatggggctgttcgtgcaggttgccgtgctcgagatctacaacgaggagatctacgatttgctcgtggggagcggagcgaatgctaaaggaaacgcccccaaggtgatacaccgaaactaattttccacatgccattattaactgttagtaatgca

SEQ ID NO: 8761 - DNA, 7773 bp, Oryza sativa
atacttatcataggttttaacatgattttcgggaacatatgatggacagaagattttaatagttttaactgcgtaactttggaaattttctatggtgttgaagtttctcagtccttactccttactttatgtgcaggcgaggctagaagtaatggggaagaaagccaagaatgcaacctacatatctggaaatgaagccgggaagatatcaagagaagttgcaaaagtggaaaagaggcgtattgtcaagagcacgctttgtaatgagaggagttcccggagccactgcatggttagttgcacacttgcgttctcgtattgagctgttagctcctggaatcttcatttcaaaaatgaactcgctattgataagcttcgctttacttctctagataattttggatgttccatcggtggggggaaggctcatgcttgtggatatggctggttctgagaacatagaagcagcaggccaaactggatttgaagccaaaatgcaggtctgtgatgtcactaatgcctgtataattttgtactttcagcaggacgtttttaaagttaccccttcaacaatgaatacctaatacagaagaataattaacactgttgtgtaatgaaaaatctaaacataacagttaacggtctgcaaagcagtgaccacattgtaggttttttttctccctttttttgaatgataaagtgatattatcacagtcacgctgtttttaagtactttaggtactactattatattgtttttctgcaacttattgtatgtgtttgataattaagttcatagtttgtttacatgatcattactgttgaacagactgcaaagattagctactagtactttttttcctgcaaattatgttatgtgttcgataacagaagttcatattttgtttacattattattactgttgaacagactgcaaagattaaccaagggaacacggctttgaaacgagtggttgagtccattgctaatggtgactcccatgttccatttcgagacagcaagctcacaatgctcttgcaggtacaagattctaaaatttcacattcctcgatacaaatttatactgtaaaattaaagctgctaacgtaatgcctacgatcttccatgaattttcaggattcatttgaggatgacaaatcaaaaatcttgatgattctctgtgcaagtcctgacccaaaggaattgcacaagacagtttctacattggagtatggtgctaaagcgaagtgcattatccgtgctgcccacgctgcaaccccaagggacaaaatgagctctgaagagtcatctacaatgctcaattcaagaattgtcgcgatgaatcagttcatctacaatctccagaaagagaacaagctaagggagaaagagcgcaatgaggcccagagtgtgctaaggaaaaaggaagaggagcttgcacagctcagggcgaagctcaagctgattgaaggtcagggagcagctgcaaaggaggaagagattaactcaaaggtcatggagaagacccagagtttgaggactgagctcatgaagatggaagagaaaatgcttaggcagcagcaagaactccttgctttgcaacagcggctgaaggaggttgagcgtgaaaagcctgtgcagcaggatatcatcggaggtagattgctggcacgtctgtcagagatgtccgctagggcggatcagtccatgtcaatggatatgtccattgattttgatatgggagatcagccagctgcgcaagacgtgaaggtgatcaaggaggatactcgcaagcagggccagatatggagccaagcaaatactgcaggctcttgcaccagcgctgtggagcaagaagatgatgttgtgaggctgtctgggtacccagaaaaggtggtcctgagcactgtctttgaggagggagatgaagaagaagataaagacagtggcgttgaagaggaagtgtgcaaggaagttgtcgaagagagctatgtaatgcaacagccccttgcagagcctgaagaccctgccacaaggaataaccggattcagaacattttcaggctttgtgggaatcaccgagaattagccaagaaggtccagtcaccagcaaagaaggcgttcggagatgagaacaatgagcctgcgaagcaaacattcggagatgagaacaagcagcagcctgcgaagcgagtgtttggagatgagaacaaggacccttcagcatggggagcgatagaacctccaatgtgcgacgtcagagtgaccgacagtccagtatcctcgcagctttcacctatcgtctgccaagttgtggacgatgccaagttgcccgtgtcggagcagctgaaatcatgcaatgctttggaggcagctgatgagaacaaggagaacaatgcttctggacaagacggcctgcttgaagtctacatcaaatgggagtccggccatctgataaaaggtctgaaattgctgagcaactcgtgtctttctgacctgagaaagctcttggaggatcacttcgaagaagcagggagcaagcagcagcagcagttcaccttcctccttctcggggtacgtcatctagctcctctactactacctatgccatgctttcatccaagtgttctctgctacctcttcctccttgcaatgtcattcatccactatcacatcttgcattggaggatcgaatcttgtcagtgaaaacaaataaggagaaatatgtggggatctctgatttggtgcaggatccttctggcgcaccggtgtccagagagaaggaagcaggggtgccgataagcaagctgccaagctgcaacaaccagccgaacagctacctagcctgcttgcgcgctgtcaagaagcagccggcgacggagcagatgccgttcagcccactggagagcaagctcaattcggcactgaacgacgtgcacctcgccgccctctcgccgaaggtcaacccaatgagccctaactacatccgtgagctcagagcttgagctcttccaacctgaagaagatcggttagatctttcgtaggtttgtcgccggtggcatttcaacggtggcaacgatgtatcatcatttatctatagtctggctctgttctgtctgtaaatttgctagctataggctggttctgcaaacctaaactctgaagtgtaaccatgttacacgagtggctgtggctagacactgcgggtcatgcgtctgtggccaacaaggtgaatatgaatatgattcgattcgtttacttctgctgtgctgctgttctgtctattgcttggtcactagtacatttctatattactccctccgtacttaaaaaaaaactccagattcatagtcctacccctcctagattcataatcgtgctacgacgtgatacatcatagtacaatgaatctggacataatctattaacagtattcgattcattgtattaggatgtgagtatgtctgtattaccattttagacctgtttgaatctcagcttgatttagcttttcaatgacatataaaacaagaaaaaccattagttcattaataattgagtattagttattacaaactttaaaaatatgtttatttgatttttcgaataaactttgataaaaaaaactttttataaaaaacatcatcatttaacacagtggcggatacagcactaaaatttagctatggcggatcatcacacaaggacgaagtgcgtggtattttaaaaatgatgtaacattttattatacacaaactataatatgttcgtacttattagaatatatgccattaacgatgattataatcctaaatttgtcatgaagtttttacaactgaagccttaaatttgttgtgtaacttttatgactaaaccacatttctacgagtgttaaatttgttgtgtaacttttatgactaaaccacatttctacgagtgttttcctgttttttaggtgtgtttatttataagtagacattcacttaagttacatatctattttttagcattcgatttttaccgattaacattttgtggttagctagactattcattcatttgtgcagacacaaggcagtccccctataggtctttaccaccagttaactaaacgaataagcttgtaccaaatgaaatacagccaactaatcatataattagcatctgaaatcaaggctgagatggtcatatgcttgaataccctacctactttgtaggtatggccggcgccatcccttgccacaagagaaggtccgccactgatttaacagtttaaaaaacgtgctaacgaaaaatgagaaatttggagtttacactaaaaaaaactacactgtgcatagtttgtgtaaattcaaaactgaaaatttaggtggagctgttcgttgttactcccaggcccataagtgagaaatgggccagggcccagggatggagtcggcccaaggcccagtagtcgtgtttggtgggcagtcgcgtgagaaaatgagaagatacaagtgcacggaggctctgacgcggcggagacacagccaagggaaaagagttcccacttcccccaccaaactccgctcggatcacccaccggcggcgaggctgcggagatggccggcggcgaggacgaagggtggaggaggagcggcatcgaggtgagcgcactgcagttcgactacgacgggcagccgccgctcttcgcgcggttcaatctccgcatcgcccccggctcacgatgcctcctcatcggcgcgaacggatcaggttaggttttgtttgcctaaccctaacccctcccatcagccgtggttcctacgtagttcgtcgatttccactattcgatgctccgggcgagctcttctgatggattcgcgtggattggtggctttagctataatatataggctatcttcactccgcgtgtcgtttggattagaattagatatagattgatctatggttcctctattcgtattttgaagcaattcgcgtgtattactgtatttgtttgctagttgcaatacgggtttctagtgtgccctttcgaatttgaatgaccatgaatttgtgtatggtgtcacccttgatgttttggagttccgcattctgacgtttcagccttcttcaaggcaaggttgttctgcactagtgcttgagcaaagttggagctaaagcacaatctcaatggaatgcttgtagatactaaggtgaataggtgatagggggaaaaatggagttcaaacgagttatactttttattatatactcaagttgtcattgatagttgtgaggcacctatacattgctcttgcaaatgcgaataagggtgctctttatcaaaaagaaattctctcctttttaaatcaatcactgcacaatcatgtacagggcctgtaattgaggcatgttatgttcttatcttctgtaatctatcatgcacatgcacacctatataatgtaccactttgtgccaaaccacaggcaagaccactctcttgaagattcttgcggggaaacatatggttggaggaagagatgttgtccgtgttcttaatggttctgcttttcatgacacacagcttgtgtgcaacggtgacctttcctacttaggtggttcatggagtcgggctatcggttcagctgtaagttttcctttctgtttactttctataagaaatagaaattagttcatcattgatttatatttcttcatgatcaatgtttgtacaagtgcatttcttgctaacgtgctttttccaagaaattcatggaagccattccctacttttcaccaatgttagctgaatagttatttgtaactttggttcattctgttttactttcttagattttaggggtctttgactctgaaatggtttatgtgctgtccaaaataattattagaagattcatgtttacttaattgatttttttattacatatgtgtggagtttgataacagtaaatggcatgacaatagtagactacacattgacaattcattcttgcgtttgcctggtttctcagtgcaatttatatgcatataacacccatgtaactttctcagggtgacgttcctctgcaaggcgacttctctgctgaacacatgatttttggaggtactgtatgcacaataatgctcctcatatcccattgtcattcttgggttcttatgggatgaaagcaatgatgtgcctcacatactcagtggtccttgaattatttgaaaaccctggaggtttcaatcctttctttcagttaactttctgcttgcatgtttctttcttctttttttgtttaaatagatgctgctcctagatttgttattcagtttagtcaagcttaattaatgaagtcaaccttactatagtaaaaatgcttttagcagttcatgctggtgtggtagatgtaagcatgccttttctttctctaccctgaaacatgagcagttgatggggttgatcctgttaggcgagagaagcttgttgatctactagatattgatctgcaatggcgcatgcataaagtctcagatggacaacgccgcagggtacaaatctgcatgggtcttcttcatccatacaaggtgataccgtgttcctagttttctgttgtttcttttatttcatatgtagcaccctaagagtgactcacagacataataactcttgagtgctccatcatacatttgtagtacgccatagttattggctcattgctgggctgagtgctccctgatatgataatggtattgtgcccccaaaagggtaatagcattattgcctagactattctgagaattcacccaacacatcattttagtttaaagatagaaaaactaccttatgtttggctagaggtattctcatggttaaatttgtgttagtgtagtgccaaagactgctatgaaactatgacacctgagatcaatacaggtactcttgcttgatgaaatcaccgttgatcttgatgttgtgactagaatggatctccttgacttctttaaggaagagtgtgaacaggtacagtttttgttctttctatctcttctgtctgttatgcttctcattgcataacatggaaggtttcggcactgcagagagaagcaaccattgtctatgccactcatatatttgatggattggaatcatgggctactgacattgcatacatccaagaaggtgaattgagaaaatcagcaaaatactctgacgttgaggagctaaagagtgccaaaaacttgctgtcagttgtcgagtcatggctgcgatctgagaccaaactccctaagaaagaacatccccgtcctgagacccagcccaggcgctcctctccatttgatgcttcaccgttccgatcttcacgccacatggcctactaccgttgatgattgttcccacctctacacctattctggtgctaattaatcatacttccacaatttgtttctgttctgtttctcatccctttctacggcattgtacctaatatataaataaagcgaacttacccttgtgccgatgagcagtgagtacccatcaagttcatttctgtacttctttctgataatctaatactacatgaattcagtccctgtcattctttagaaaggcttgatgtacattaagaaatggccccatttatcacgagaaagtaatgtgtacctgtcttctcaagtactagcaacttcactgcttatatgaatatataaaacagcttaggaggcttgtacgagctgatcaggtatggtaaccttttctcctttgctatctggtcaact

SEQ ID NO: 8762 - DNA, 1605 bp, Oryza sativa
caaggtcgacactataaggacatgttttcatccgcctatgacatggccaccatctatctcggtgctagggttctagacattggtcctactccagaaccactgaaggcataggcggaaaaaaaaagacaatgtccgtgagcataacatccaaccaaccaaaaggaatgatgtcgtttagcggagcaattaaaacgagtcaaacaaaacagttatagaataaatattatatgacgtggaaccagatcatgtcgtatcccattttgagatctatacgcacgtcaacccttatcctaagaatgccctatcctacctttagaagccacctaaatactcatatgataacatatttacacgcgcgagtttcaattctcaccgtacaaggcattcgaaggagtaggatattatgattttgatttgtttagagacacaaatgcactccttttatcaaaagtgcaaaatagatagagttcaagtataatactctataagtttcgtaaaaaaaagattcccatacttttaatgtttttaatgctacaatcaaaagatagtaattcaaatcacaaattgctatgtcacaaacatagaacaattatccttttgagtcgggtttgtgctaccgctactgcactctcaattccatccttagtattatgatatatacacaacaacatattttgtaggccatatagaaaatcctcggtagctcctagctccgtcataaacttatataaagcagtatcatttagtataacacgaaatcatcataagataattttgaaaggaaggtaattatcacaagatgctacgctattaactcgtgtttctgaacttattttcccatatatcataatcaaaatgagaaggaacacaagcattagtttttgttaccacgaaaagccccgaacgtgtacatcacttccttgttttaagagcacaacaagcatggtacgttcaaccactactacaagtctacaactaaagatactccccttgtttgaagcaactatttttgaccctcccctttcttttaaagctaaacaatttgttggtgttttgttttgaggcattgtaaggaaaaggggaccaaacaaactgctgctactatatgcgtactacacccatcaccataacaaacaagaaacaataaagtgccagaaaaagagagaaaagaagaaggaaaagaaaagagcaacaaaccaagatggccgcacctgtcaattacttgtaaaaacgaaaaaaaaaaacaaacaacctgctcccagttaatcagtttctttaatcgggtggtgtctatttactaatcgtcccctctccttcactctttttctcttgctggtctccgtcttcgtcttctcctcctccaccctctctctctctctctctctctctctctctcctcccctttgttccgccgcttcccctctctctctacctctcgcggcgaattcgccgagagggcgcagggaattttattaggagaaatcccctttttgtatccgtttctccggatccgcacacctcctgttaatccgccgattcttctttgatttgttcatattcgttttttttatttttttccctttgtttgcctttttattcgttcga

SEQ ID NO: 8763 - DNA, 25607 bp, Oryza sativa
  unsure (1)..(25607): unsure at all n locations
gcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcaggtacaccgaacacgcacttatctgggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgaattctttaacccgaagggcatcgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgtgaagacgtcagcgtttgcccgcaggaaagagacgagcgcgccttcctatttgccgtccagaagaccaccaatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctctccaggaccgcgttgtagggcagactgaggtccgccacatcgaagttcacccgctccgtgcggaaattggcgggtccaccgaaggtgaccgggaggtcgatatgacctagcggccaagtgtgccccggcgtcactccaatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtcggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcagcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtctgaatggactgacctcttcttcctcctcctgtcacgccgccctgtctgagcggcggatccgggggcggccgaagctgccacaccggaaccggaagggttccaagtccaggcctcctccttgcgagccactcggtccgcgagctgaaaaaactccgcggtagtctggggctccttggaggcgatcttttcgagcatgcggttgtgccgcacgccccccctgaacgcgtagattaccgcgtgtgcagggatgcatggtatggtgttgcggacttgacagaaccgctgaatgtacgagcgaagtgactcatcatcccttcgctgtactgcgtgtaagtccgcttcttcacctgggcgcggatatgagccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctggtccccgcgtccgtgttgaggtgacactctagacgaggaagcgccctccgttgcgtgggcagcacgtcggtcattacgccggcgctcgatgctggcgcgggcgtccggccccccacgcagatcttcccgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagtatctaggcgctgccgtgcagtcatgaccaatttggccacatcgtccagccaacgttgggctggagactccgggtcatgggcgacaggcgggtgacacaggagcgcacccgcagcttggagcgcgccctggggcgtgctgccgtcgccgtagacgaggaggcgacggtccccatctcgccgcccctttccacctcctgtggatgtcgaagtcgcggatccttcggccctctcgagcgcctccccctgcttaggactttggcgtggagggggcggtggagtacgagctcgacggcgtgggttcggctccccgtcgtcgccactcacactcggagagaggtcgtgcgcctttgcttgctcagccataaggctaaacaggaaaagcttggtgcacacgaaagagtgcaagagctcagaagatcactcgcagagtcccctacctggcgcgccagatgacggagcgtggggctcctcaccgggagaccgcgctggccctcctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcattggggacttaccctaccttttcataaatggacggagatttgcatggttgccgtccgagtcaccttctgatgggacggcccacaactacctccactttcgccgggagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacatcaccctcgggcccgacgtcccccgagggtgccaggccacgtgggcgattgtatctgcctcaaacctctagtcatgatactcccgatcccatgtcaccgacagtgtcctataaggactttatcttttccttttatctttaggaaagtttctttcttgtccgacaaggacttgtatcaacccataggtataaatatgtacacccagggtctatgtaatctatcttcacgatcaatacaattcggcgcatcgccaccttttaccttttctactttattttatcgtccgacgggacttggcacctgacgtagggctgcatcggtgttcgatctccggcgaaggggtaagtccaatgttccgtcggcccaggcaattgtatcgtttacgtcggtgtcgttcaaggctgcatcagtgcattcgacctcttggattgctctggtttggatgatatatttgcctacctatttatcatatgtttatgttaatctagtcttagcatatcaatttagctctatcggctgcttctcgttttagggtttctgccggtatcggctaaatcgtgttgctaggttagattagcttagatatctaccaccctgaaaactcagtcaacggcttgattgtctagatattatgtttcttttcatacttagtgctgcatcagttgagtttgatctactaagtcgtgcttagaaccataatccctagcctgcttcttgattgccaataagggtttcatcggggtttcagccggtgagttatctggacgttgcatcggcttataaggatagcgtatacatataagttggatttagccgatgacaacaaaggtttcactgttcaatctaatcttgtggatttcatgacatcggacctccagctgatgtgtgctttaaccttcggatcgatgcttatttatcatataattatttgccgattggtttatattggattatattgttattttattacaccatcatcagccgattgcctttatatcattggacatatagccgattgctaaaaccctatcgctatcggctggtatcggcatcggctgagattgctccatcagcttgtcagccaatcggctattttgatatactatttgcatatcttatcagttgcaggatcaaactgactggcacgcccgcatctcaacaacctttggacctgcactggagctaagcagatctcccaggccggtgtgttcgattttttcgtcaacaggcccatgatgggaggcttgaattaggcatctgtcaaggaagttcattgcacacctctccaatttaaaggtacgtaaagaaatatttgtggaatatacgtgtgtgttttatgtttaatgcgccatgaatgcacaacttaccttcttatttagtcatatttaacttgactatctcattaaatatgtttattctagtggctgataaatctgaaatacatagagatggttttcaaatcccttatgttcttatttaaatgtatctattctagccttctacaaatggtcaggatttgtctttataccatgtctctttcaccttttttcttcaagaaagaatgtacatgtgccatttaacgttacacagttacatatcgtttgttggaatcacacaaggatcgttggaacacacacgaacgcgagagcaagtggcagagcttgaaatgcttgacaatggcaacaaatgccgccttttttgtatttaactcggtggccaacaatacgatgaacatgtgcttttataggcccagcgcgacgcacaacggagcacgaactccatccccgacctttgctcgcactacccgcacgacccggctccatgcgacgaacgcgttaacaacaaacacacacacacgacgcacgcgcggactgacctgacacacaaggtcaggtttatttcctaacatcgttggtctatatcattttgtgatttcctgcaatcttattacatcccacatgaatttctacatggttctttcattgcaatttattatgcatgggagctatattaattgtccaagaaagatttacatgttaagatttcatttgcaaactctttgtcctttctgcaatggccataaatttgctttttcatgttcatagaaaaagaagtcatatctgtgttgattgatttataaaacataattcaaaacagcgtgatctacatgctaaatgtatagttacggccttcttccaaatacaagacattttgttgctcgagttggtaatttgcattctgttgttccctgccgagcaagctctcaatctcctctgcattgtcttcagcttcagcccatgggtgctgctggtatctccttaacatctccagcctctcagcaacctctttcatcgttggccgttcttctccattcatgcttatgcatcgcatcaggaggtatgtgatctcttctagcatttcagcgctcatctcattccttacttggctatctagtagctcttgatggcgaccaactttcattgctgtggtgaagcatgacaccaggctcctgttttcctctggcccgtccaagtacaatgctttcttccttgtcagaagctctagcatgacgacaccaaaactgtaaacatcgctcttatcagtcaactggcatgtcataaggtattcggggtccaagtacccgcaagttccctgcaccaacgttgcaatctcggcctcatcagttggtgctagctttgatgccccaaaatcagaaactttggcgttaaacttgtcatcaagcaagatgtttgccgtcttgacatctccatggaggattgggggtgaagccgatgagtgcatgtaggagagtgcctcggctgactctgccgctatccgaagacgagtatcaagtggtatgtcagctttgggttccttgccatggatgtagtggtagagggtgccatttgagacgaattcatagaccaacatgggcacttcaacttcgaggcagcaaccaagcagcttgacgacattccgatggttgatttgggagaggatgaacatttctctcgcaaactccttggtctcggcctcctccatcatcttcgacttcttgatggccactactgtcttgtcttcgaggacgcccttatagacaacaccgtgaccaccacgacccagaacacggtcagaggcgaagttgtgggtcgccctcttgagttcttctgtcgagaatatcctgaacccatgggtgcctccgccggagtgcatctgctgccggaggatcactccaccgttatgctcgaagaacttctgcttcgttctgatgagcttcctcttctggagccccaagtagagccagaagcacatgaacactgacaagaagacaccgacgctaacccctgaacacgacgccattgtatacccaatattactccgttagatttccatttttgagactgaatgtaatttttcatgatggacgacagttataattttttttacctgtaactactttaagagctaaagggaagttgtcctttgggcggcaaccgttcctgtcggtccaatttccactagtcccaggagggcacacgcaagtgtgacttcctaacatgtttgtgcagtctccgtagcatccgtacttttccggacgtaagcactcgttgatatcttccattcacaaagcaattaatttcgtcatatttgatcatcagccaaattaatctatggaaattaattgacagagttaattaagatgactgctacctgtgcatccaccgtcgaggtaggggttgccctcgtagccctggcagcagttgcaccggtagccctggccgtcgatggtgtcgaagcactcactgttcgtgctccggcacgcgtagtccgtcgcgttgcgcttggcggcgctgcagttgtagacgttccggattgcccagtcgagcacgacgggcacggcctcgaagtcgctccggttgaaatccttcgtgtcgttgtacacggtgttgatccaggtgtgctccaccaggaacacgtacctgcacggcgtcgtgccgccgcggagctcgttgtccaccgccgccgtcccgttctcgaagttgaacatccgcggcacgtagaagttgagggtaggtggtatgatgctctggcagcaccgctcgccggtgcaccgccccggcaaccgcggcactgtatcattgcccagcgacgggcggcggcacgcggacatgcagccgctgacgtagttgccggagccgtcgacgatgtagccgaggttggggcagccgagcgcgacgaggcggttcttctccggcgagtagcggtaggtggtgctgccgttgatggacgtgtacgaggaggtggggacgtcggaggacctctcttctggaggagggtagcacttgctttccggtttgaggaggacccgggcctcgccatcggccagggacaggctgacgagctgcgggtgttgctcgaactgaagcgtgagtaggcgcggtggcgacgcgctgtcgtcgcagttgagctggaagccttcatcgcgggcgcagcgggcgccgatgccgaaggggtagggaacgttgatgtttccgcacttgtcgcggcagcctgtcagctgctgagccgacgctgctggtgtcaccggcgaaaggcgacagatgagcaagactgctgctaatgcaatcgcctgcaggtgcagggtattggtagccatttctgaaatggcttgcttaatgtccggatgctacaattttataagagttaattacattagcggtcattaaacttgcaacgaagtttcacttagatccacgaacttgcaaaacacgtatcgagattcttaaacttggtttaatgtatcatcccggtccaaagcctagtttaaccgtggtcttctctatgtgacatgccacgtggacgatgacatagctaaattttttcccttttttttcttcccatcttttttctccttcctcacctcgtgtggagaaaaatactgcggaagggagaggaaggaggcaaagtggagaaaaaaaagataagaagggggaaaaaagagggaagaaggaagaaaaaataaaaaaaattcatgtcatcgttcacgcagcatgtgtcacaccccaatccggcaccgccgtacaacggcacctgataggagcgtgtcgtaggaataacggcgcgaaccgcttcctacgaaaccgcgatctcgttaccagtcccaggacatagtgctggtacccacggtgacaaatatgaatcattgcaaatccttaaaataaatagaggacttatttaccttaacttaggttgcagcttagaacagcccgagaatgcaaccgacgtcacggacgaggaaacaccaacaacagcagcagcagcggaaccaagagcagcccgagaatgcaaccgacgtcacggatgaggaaacaccaacagcagcagcagtggaaccaacggactaacacccaacgccacaggcgacggctgggaaccaggacgaaaccctaatcttcacttcacttcatcttcacttcacgacggaggaactatatatacatatatagagcaagggtgagtactttcgtactcaacaagccacgggaatttaggtgtttaatgcaagcttggaagagaggcaaggttgttttgcaaatcttttatttgaaatccattttgaaaccactaagtgatttatttcttttcaggtttgggtcgaaaagagacttgcgtctcgattcaactttaagagatgtttttcaacaactcaattgataatgaccgacctcccgggtcagatcattacttctcggctcccagagccatttcacttgattaagcggctcccagagccttattcattttctcggactcccagagtccagctgcccagcagcacaacattccgcttccactcgggaagcctagtctatgatgcccgtagacatcccgaatcacacagattcgtttctgaccactcaggccatccatctgccacataggctgattctggttacgattcctatcccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggatacctcatgccacatagaaggatcaaatcctcacataaatataggccattttagttttcacaaatcaaactccaaccacctcgatcggtaattcagcaagcttctctttcttgcttaccaggaacccggtttggctccaatcgaccccgccccggcgttcccaactattggcatgcgaggtttccctgaaccgactagttacttagccagggtgtcccattccaccttgtggttgcactttgttatgcttgatgagtttcccacaggaattggtccttatatgcaaatacgagacagtgccacataggcacggcacccgcatcgcgaattttcacaattcattttattttcaaacacaccgacaccacatgtcgggttttcaaggcttctcaaacccatttcccaaattttcgacaatcgacggtgtatgtggaatatttggtatacgcactcagagagcacgaataccgaagtaccacaaggatggagcgacaaggaatcagggtagtacaacctacaggaattagtgcgactactgggtaggtccgtcggtttgtcacgcaaaccgaggccaagcatgttatatgtgtgtgactctaaaaatgcaagttgcaaacaaaataataatgattttccaattataggagaaattgatcaaagggtgactttccttgctcaaggtcttcacgaagcttcacgaatctacgagaaatccctgatcgacgaaaatccggtaaccgcggctatacgcaaacaatcaaaacctaaacgaaagaccaaaagaaagaccctatttagactaattaatagtgccattaaatatatctcaattttacggcagtaccggaagttgaacggagtcaatcggagctacggattgagagatatgaattttggaagctcgaatgggattttccagactaggaaatgatttatcagaattttctggaatgtaaggaatggtttatggaatttatagaaataatattctcaagaatattattgacattcactgatgtgtgggaccaaaggaattgatttatggaatttcggaataataaggaattgatttatggaaaaggaaatggacgagggatgtatattagactttttcgggcggcaagggcgccacccgagtgttgaaggaggctcggccgagccatttgggccggcgtgggcgcggggaaggcggcccattagggcgcgcggaagagagagggagcggtccggtggaccgagtgcacctcgcgggtcccaggtggggcccgcttgtcggtgacacggcccacggtgggatgggcgcacgtgagggcggcgctagggttcggtggggatggcgcacgggcggtgcgccggatggaccgagacgcgtcgggcccacgcgcagcctcacggctcgcggtggaccgcgcgcgcgagcgggagacggagggagcggcttaccggggtcagcttgacccggtccggccgagctggcgccgacgtggcgccttcgtggcagccacgcgggccggcgggaggaggaagaaggggaggccgagatggacggcggacggcggcgcggcgagatacttgttgttttgtgtaccctggctggtcctggacagggatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaattgtctcctctcgcccttcggcaattctttgtcaaacagtttttcaaaattctcctcccagtctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtgatgttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacgacagatcagtaggcaagtggtttagtaccttatctttagcaacccctctcttcctcctctcttccgccctggcagaagatagtcagtgttagagagaagagcaacgacggtgtattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagccggaatcaggatcagagcgatagtcagtttgttttcaaagaggaagcacccgcaacctcagatagtacgccaccaagtcctcagcaaatcagcacagctaagccaccaccaatcccaggagtaatatatgctacctattgtggttatggttttcaagcgcagtttttgcaaagtgtccatggaagatgtatgacagggcacatcttagagggttgttccccggtaagacgtcagcgtcatcacatccctaactcctcaagttgtgtcagttccaatgcagagtcgatcagttcagttttgaggaatcaactatgcaactcgacaccgaagtcaagctagaagcaggacagtcatgccagtagttagaacttatgggaaagttagtcaagagtcaatgtgtccctgagctaaatgagagtcacttttatgtggaatctcccatcagcaactgaggattaagttccaaatcttgctgggatgaaagtgcgccgtcattactctattttgatgaatcggtgaagtttcagttttcaaagtgagggcctttgtaagcaagagaagtgttggttatttttcaaggacaatagtccaattgttcctagtcaggagaaagtaagactactccctgtaagggggtaggtctcggagatgagttttggctcacttcgtcgctgttttagttgaaggttcaacccagtgcaacaatccgggtagtacttgaagaagccagttgcaaggtgtcagcagagtcaccccaatctcaggtcgacaggttcgattctaaggtacacctgtgaagcatgtcaacagtttagcttagaaaagcaacagcgaggacagttgtagtacagacgaaaggcaggtcaagcaggttttcctggaattacttgtcatttgaattgggaccagtcgaagcggacatagggtaaatgatttacaaatgccagattcaattttcatcctcttatagccagcgtggtgaattctaccaaaattgccaacctcaacagttcagtccaagataagtaagtttcaggagcatccgcagtcctagtctgggtcagttcaagcagaaccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctcctttcttccccttcctccctttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccacttcgcccacgatgtcacccacgtcgcgggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgccctctgtggtcggtcgggccagccctggctgtgcccgtgccctgccaccactcccctcagctgcccgatcggcttggcccgatctgggccgtccatcccgtggaccggcggtggaccgtccttgtggtcccggtccacggtgcaccgagctccttgacccgctgacgtgtggggcccgcgtgtcggcgccggctgccccttgctgacgtcagcgaggtcctttttcctttgtaaaaataattaataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctatcctttgtcaaccttgggtaataaattgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgggctgaagacgaagttagaggaccaaggctcagaccccagttgagttttgcctgtggagtggagctgaagccccgctgctgctgcttttgtttcggtgtgaggactaagcgcctcttctgtaagtattttacgctttatttacgtttggaactgtatattacttgtcgttttgtgtaccctggctggtcctggacagggatttaatacacaaaatagtctggaaatttgggctaaatttctgggcgtgacacatattaaaccaagtttagagatctcgatgcacgttttgcaagttcgtggacctaagtgaaacttcgttacaagtttaagtaccgctagtgtaatttactcattttataaatagactatagctggcaggtgaaatatctaggattttttttctcaaaatgaaaatgacgtatctagatttgtacacgctcataattaattaattgattggagatttttctttgggaggggggaggggggttaaaaattgcatgctaggtgctttcgttgaagaggttgtttgtttgagttttgacgcacgcgcttcgtcgacaaataagatgcttagcagggtgtatactattggttgactactaaattttgagttccattgataacacagttttcgacaaatttcgaccggtttttgataaattttgactgaatttcgaccaaatttactgtttacccttcgaaattccaatcgaaaattaattccgagccatgtcaaaacgtcgaaatttcgtagaattcgaccggttttcgttggaattgtgaaccctgatgcttagttttccaataaaagttgcgtgctgggcactgtttgtatcagtcatcaacagatcgatcttatagcacaaaacaatcttatagcacacagcatacagcaacacgaacatcagaataacaaaacaagcacacatacaagacttcctataaagcatacgtacttcacaacccggtgtccacagtcaacggaagaaatcaacctttgagcctttcaaaaccaaactagtctgctctacatcagcctctacagatggacatcaacgaacaatttatatggaaaaactcggcactccccaaggtccaattttttgcttggctactgacaaaggataggctacccacatgcaagaaccttcacaagaaaacaatcatccaattgccgttgtgcgctatttgtcagtctgctgatgaaacttcaagccacctttgcttcctatgcccgtttgtggtcagcttctggaattcaatccacagatatcctggaggcgtgcacactcatgacctgcacttgattgctctaccaaacaatctgccgcaggcacatttcaaaaccttctatctgctttgcctatggagtactctctccgtccttaaaaaaaaaaaagacaaaccctggtttccgtgcccaacgtttgactgtccgtcttatttgaaaaaaatatgaaaaaaattaaaaagacaagtcacgcataaaatattaatcatgttttatcatctaacaacaataaaaatacgaattataaaaaatttcatataagacggacagtcaaagttggatacggaaacccatggtttgtcttttttttttgagacggagggagtatttggaatcaccgacaagaagttgtcttctctgaccagcaatcatccttacatcggcttcttctccgctgtaaggatgagactactctgtggacagaacgacttcttctgcgcgacgatcgcctagttgctataacctggaaatgtattttcaacatcgcaattaattctctacacatgtaatgcgtgccgctggttacgtctgaactctatacttgtaaacctcttcaaatggtaatggaaattcaggtgggaacctctccctcctgtgattattccaaaaaaattgcgtcaaatttttttttacgtaaacaaaaaaacccaaactagtactgtacaaaatcgtacacgcttcgtactagtttctctggtggaaggtcatcagggcctcggttcctttcaaaaggcttattcgtttcaaacgaattgtaaaggaaaagtgcaggactatgcaatcctttgaaatgaacactgtattgacatttgtttcaaagaaatgcaccaaagaaaaaagggaacatatcctaagcacataaaaaaattttcgtgcacaccaactagcaaatgtcacaaaaaattctagaaaaaaaaactaaagatgtactcttaatagtattacacatatctacaaactctcatatttaaatttattatattttagccgtgacaaaaaagacaaaattctgacaaattttatctcttaggccttctttatttaggtttaagttttattggcttagacttttaagtcaacttattggcttatataatttataagccggtggatttaatgtcctaaatttagtggtggagtcatacatctatctcatataagtcaaaaattaaagcttctccaatatagcttttggcttaatagtgttagagtggtttatggcttcaaaaagccaaacgaaaaagctgcttgtttgtttaggcttagattttttggcttataagcctaaactaagagggccttaaaactgtcagattttcacttatttgttacggctaaaatataatgaatttgaatatgagactttgtagatagtgtaatactattaggagtacatctctaattttttctagaattttttttatgatatttgctagttgatgtgcacggagtgtgcatataaagcttgtatgcataggatatgttcctaagaaaaaaatttttatccctccacttttagagggaaaacaaaggaaagaataatccactccaattcaatgttttcaatcctttggattgtttgctacacaaccatagggaagtttcctatgttttcaatccttaggttacacatgtattcccatactattcctccattttccctatttctacgttttgaaaatcctacaaaccaaagaagtctttgcaacaggctttcacttttcctcgctcctcgagttgaattaagcttcatccaacaacatatgtactccctccgtctctaaatatttgacaccgttgacttttttaaacatgttttaccgtttattttattttaaaaaattaagtaatcattaattcttttcctatcatttgattcattgataaatatacttttatgtatacatatagttttacatatttcataaaatttttgaataagatttatggtcaaacatatgcttaaaaaataatgttgtcaaaatatttaggggagagggagtaccatgtaaagcaacgttgctctctggatggattgacggtttcgtggttgaaagatgaaagccagaagattatacaagcgcggtcttcggttagtgcagtaatgcttgtgtccttgtaagctattgtttcgttccaatgtttcagcagcgatgaaaattcgtgttcaccccaaaaatgaaatttttttattgtcctaccgaaaacctaccttgcgtaaattgacatggcaagttgtgttgtgtattgaggactatcggacgaagacaaaatgtagagcaaaggatccgctagattaggttagagaagaccaaacacaaagctgcgttgacgatgacgaccgcacgaactcgcgctataccggccggcccgcaaatgcgggagctcggcccaactactcgcgtacgtacatacgtatacggcccaactagacgcgcacgcaatcccgtcccggcccaactcgagaactgctcggctgccagcccacgtccccgcggcgcacggcgaaattgctcccctcccatgccggaatcccaaaaccctcgccaaaatcgccgcctccgcctattcgcgcggcggcggggacgcagctgcggaagtgcgggggggtcaccgcctcggccgccggcgcgacgacctccacatcctcgtccattgccatggtacggcgtcgccagctccaccttctcccccctctccttcgctgctgtttgcggttaggaacatacaaatgcggaggggccgcggcggtgtccaattttagttaggttttcgaaatttcaatccctggtaggcgcctgtttagtagcactagtcaatagttctgtagattgtgaaattttgaagggaccctgtgttccttacttagtaagggctataattgggctttcgtagaggaagaactgtgttgcagcagcttggtctcttcttttgtgctaccatagggccataggtggttgatgacagagatttcgccgaaaaaatcactgtagttaagcttggtctacctcacaaaactattggatctgccactattccagcttgtgcctttcaactgagcagtttaatgacaatgttgcattgtagtccttaacaacagagaattgtatccccatgcgtttaacatcgtggtttgtattcaacagcaaatttgttaaatggatcagtttcgcaaactatcacatccgagtatgtatgcaattcatggcacgctaatctcatctgccataccattttactgcctctgtttttggtgagctagtccatttctcttatccttttgatgccatgtactgtttaatttccctcaatccacattttttggatctgttagaaccctgccagctttatgttttgcaatttatgtgataccaaagctggctttgcatagtggaactgtcagccattttcagtcctgattttctcatgtgaaatttaattgttgttcacccatttcttcttcttgtcagtaaatgtgttgtcttgaattgggatcatttactcgctgaatcatgaatacatgcagaactatatacgttatactgtacatatattgcagatgaacagatgggcaacattgattgtcttgtaatctttaagcccatcacatgcgtctattcaggatccaccactaccttgtcgggtggagttcatttcgtagtatgtttctttctcacttgcgacttgtctgaattgaaggtaattgagggcatgtgtggtaatttgacttgtacgagataactctatactagactttctttttccttctactatcaaatggcccagttattacattgaattatcacaagttgcttttgtgcgtgcatcaatttggtctttttttgcatgcaaaccttgacctgaacttttgaccagtttgatccaaagttttctttgtaagcatgcaattttctgttcaatttaccagtattatgtgtattttccattacccaacaagcttcatagaaagtaataactaatgtacagtgatttttctgtccaggtgtttctggctgagcaatacacaccaacatcatagatattgcaggttccctccagaagcttgtttcctgagtaaatcaccaatgctgggttcaatgaatgcatctttggtatgttgtgccaacccaagcaataataggccaaggaattcagatatatcgaggcaacaaaaagatggcctgctttttgggaaaaaaaaagctttaccaagaaatatatatgactgtgagaacatttatgattttgattgttatatagtgttctccaaaggtggtccagccatctctgtcctctggggcaagcaattcacgcccgctggcaacatcaactccagggataaggtagaagattgtagagctatttgaaatgatccaggcacaactgtgagcgaggtcaacatccggagcacaaaaggcctgaacctacagaagatcagtgggagaggggcagtgttgatccaatccttaatttgctaaggaaacactcatggaactcaaaaggaagatcaacgatgggaaagaactgagttctgatgaaacgtggagaggcaatgattctgggaattaacagaactcaaggatctttggtgtgaaaaatgacatttaggaagagcgaacgtcctactgcatacaaggccaactccaaattgcaggcgaaggtctcttgttcgtggagtgaggttccagcctgttgttaccaatggcgatatgcagttgcagatgccaagtctatcacagatagcatggttgataatgacaagtctgtcgcagatagcatgattgattattgcaatggttgattgacaatggcaatgattgaaaatcacagatagcatggttgatgctgatctaaaaggtaagatatcaccaggcatgtttttccatacgaaatatgaccagaaaacatgtctttggatgactttggcattattccagatgatgattaatctgattcttcggatactaaaccttacgatggaactttctgatgttactggtagcaatgtatctcatgataagatcatggaattttcttgtgcagaagctctgatataaataagctctttcaaggttctggagctaagagaacttgcgaaatcttgaggaatcaagggctattaaaaaacgagtaaaaataaattggttgaactgttgagcaacatggtctgcttctgatccattaacgacagagtctgaccttgtatttgagccattctgctcaactatgtcctggacatgtgtgccacgtttgttttgtcaataccaatccatttagatagattaacaatgtaaattagtaagtttaacaactttacgctgttctgtgttgatcatgtgcagacctacttttttctaccaatttaagcttcttaatgaaacagctgcatttcttgtcttccctctactgtagtgctgttgacccttgattgcattgttttacttggcgaacttgtaaagctagctctattaacctgggaggtcctgcttacattgttctgatctgttggtgctctatctgtcaggtttgcgccattttctttaccaatacaaaaagatatatgaatggtatcgcctaatattctttttctataatgcaggcaaataaaggtgtatctatacagttctgttattgactgcggctgcagctttgctcgtgaagcgaagaatgaaagcggcccagtggattgcagacggcagaattcctggctgcattattgttcggcctctgtcttctcgtccagtccaagagctttgcttgtgtgttgcatcctgctgctaatcaatctctcgtgatccacgcacgcggcgtctcttggccgtggccggggccctcccctcttgatttctgggagccgtcagatctgagcgattggacggttagttcccccgtctcacgtgcctctgcccctgctgtcctcctcccctggccctctttgcctgcctgtatattgtctgttggaaccctgattaaagctgcatcccctcgttcgttttgatacgattgcagatcagtactagcaacaaatttccagtcgcgactctttcagaaaaagaaaaaggattcagtcatcaatcactagagagaagtaaaaagaaaaaataaaggtaatcctctactcctctcctctcgaacttgtgtagaactactttctttgtctggtcgcctcacttttgcagccactcgatcagcatgcatacctatataacttttatgcatagcttgctttctttcttttgctttccgtcatcactagtaattaattaaacttctagtaattcttttttttgcgcaaattcatggccttccaaaggaaggcctaattaaatagattgttaattagggctgttttggtttgatgccaaaattttccctaccaaatagttggcactttaaatagtaccttgtagatatttggtttgatgccaaaatttaccaacggtaatataattcctataaaccaactttaccaaaatattggtagtgccaaatattatccatgatttagcactactaatgatttggtagggcatcaaaccaaatgagcccttaataaacatgaatactgatcatatgcacatgccgtaggcacgagtcacacgattagaagtctagaacagaagcaagatacaaatgtaggtgcatggctgttggcatgtactccgtagggatagtagaagcgcagctggtccatgtatatgcatggagatgaagaagtgaactgttcgaactcggcttggaagttggaattaaagcacgacgaggccaggctagcaagctagcttctagctgggttactggaacccggccaatactgttcgtataggtcagtgccagtgcacgagtcagccatgctgccatggcgtcgtcgtcgcatgccaatggcttgcatgcatacagacagttcaaaactgaggatgaccagtccacatcatacagcgcccgtgcatatatatgtacgtggaccttagaccatacacatggagtttgtgaatttttggtgagcttatttcctgcttacatcacactttgcacatgtgacggagagagataacatgaaaatataagagctggctatcatgcaagagctatcttagcatgtgctcttagaaaaacaaattaaatagatatgtgagattaagacaaaatggtaaagtgtgtatacaccttgtagctccaaaaagttaagtagatatcataggtatattttaatattataaagacaaaatggtaaagtgagtggattatagctatatatgtgattacatatagctactagttgatatatcgatttactatatctatttcatattataagtcac

SEQ ID NO: 8764 - DNA, 4509 bp, Oryza sativa
ctctcttcttgtgttagttgctagattataattttagaatcagggcttagaactcgatcatgtagtagattgcgactcataaaataggatgcaatcataatgtttgtggaagtaagtattgatatatcataacaaacgacatgcatgttttcattccgggagcacacacacatgcacgtcctacgatatgtagtcacgtgtagtttttacatgcaatccaagctagaaagttccaaacattgtactgtgagatggtaaaactgaacaagattgacggccggtgtggatcgaacaggaaaagaagctagaagatggggagggcgtctatctgggagctgaggtcgccgtcaagattccactatcagtggatgtagaaatacacaggtacgtacgctgtacctatcgatctctttctcaagctaggacaaaagcttagctagctagctagttgcattactactggaatgcatatagatgagatgtgcaggtgcagctggctagtcccacgttgcgtgcatcgtatgcagggagcaaccagtccatgtacagggccgctccctcgttgctgaccggcggccggcatgccggattcccggccgctgccttaatcctgggccccgccggccggcgtatcgccggtggggcacccggccgcgcgcccgcgtgccttcccccacatacaccgaccgaccatcaccggtgtgtgtgcatgcatggccccggcctcggccccgatgtacatatgtaagcatatactccattctctaaatgttttacgccgttaacttttctaaacatatttgtccgtttgtcttattcaaaaacttttataaaatatgtaaaactatatatatacataaaagtatatttaaccatgaatcaaataattaataattatttaaatttttaaataagacaaacggtcaaatatgtttaaaaaagtcaatagcgtcaaatatttagggacggatggagggagtatgtgctagctagtacagtgtttgcacgcattgcatgcttagttaatgtgcatatttgatcatggtctcgaccaaaaccacggccttttgaccgccctagctatatatgagcatgtagcatataaaccatcatatcatgcccgcctgtctcgatcgatcgatcgagcgatctagtagtagtggcagtatagtatgtgtgtcgttcgatctagtgatgagatagaccgtgcaattgctgtcaagtcatgagaatcagaatctgaatcagagatggtgctgttgcatgccatgaaccaggcagcagcagctgcacatatgcagtgctgctagctaagcttagctagctgatcgctgtacgtacatgtgtccacacagtgtcaatcagctggcccttctgcctaccttatgtgtgcctgactgcctctcggtcctcgggcatgcagtaacgtagtaccagaggcgtacagctccctcgttttcgtcgttgcagcggcagcgatgaggggggcagcgtacttgcatatattcaccaatgtgcataggttctgagggtactttaccctgctcccagcccacggaacgacgattgggaagcctactttgtactagcgcactgcgccccatttccatgtagccatagagatttattgtatgtagttgatgggtgctggtcaatgtgcccagggcataaactgtagatgcacatatacaatcctccttctttccgcaccatatgcatgcatttgtgctatagctaggagtactaattaatattatcaccaattagaagcctccatctaacccatcacacacaaaatgcagccaagaaccagctagctgttactgttaatatatagacatgcagtgttgcatgcatgcaatacaatgcaaatgcagatcgatcgagaaaatgcgcatgcagtgcacaggattcgtggtgatcacaatatacaggagcagtacatgttagatcacggttcagtgtgcccaagctttacttcaggcaatgcaccagccaaaactccaaaattttgcgaatgaccattggttcgtatgcttgcagatgatgcatgatatagctagctagcaagaccacacacagcaggcaagggtaactagcaaccccctttagtctacagtcttcttctcagtctcgcactttagctgccttcctttatttggacagacattctatggctcccctaactccactgctcatttatcatcatcctctcctcgatccctctgcatgcccatgttcatcttatagctagctagcagccaccgatccatgtgtatgctcatccatctaatttctagttagttcctcatttctatgtcattttcgtatgcccaaaacatatattctaataataattttggcaaagttaacttattttgactatacagattctagaacgacacttatttgtgaacgaattgaagggagctagcagttggcatctagtttagacttaaaaaatttcccgttaaaatttttgccatagtcacatggtcgtaggagtgaaaactgatcggatattatctgatccgctctgaatttgatcggatatggtataggtttttagaaatctagtgaatatggatgcggttgcggatatgatatctctaaaatcctacggacgtggattgtccaacatttctgctagattatccgataggtcgtttcccggataattcgaaattattaacccatataaccactctatctgttgcatataacatgagatggcgcatctaatggcctaatttaccaattaacctaaatttcttagtttgaggctttcaccatctatatcacacttgtttagttgtatttttatattatgaatatcatgtattcatattgtttggtacttaagtacataattattaagatgggtcgttcattgattattgcattgttgtcccttgcattactaactcgatggtgtattttttgcatacacacataacatccgataaatttaatctgtttccaaaccgagtccacaccaactccgcaccattttggacatccgaaacaatcagctctgcatccgcatccactccaaattcgcttaaaaaatgctttaggatttggtatgaccactatccatccgaatctgttccgttttcacccgtacaaggtcgtgtactaatgtagcatgcattatgcagatttggttgtcccatgatggtgtgttacaaatagcttttattaatattaattctatagatatatgtagctgaaaactaaattttaacccaacactttcttttaagaaaaaggacaaacgaaatgtacatatatcatcacctgtactgcagtccaagctacgcgagtactctctccgtcccaaaataagttaatctagtagatagtaccataaatctaaataggagaaataagttaatctatactggatatgacacattaattttactatgaatttggataacttcaaattcatagtattaaaatgtgtcacgctcgctattagattaatttattatgaccaggggtagtattgattattctctagtagcactcaggcaaattttagtacatttatgttctgaggcaaggacgagtacaatcatgatcgaccggtgcgcgcgcctctttggccgaggcgactgtcgtgcatccatgtcgatcgttctgacatttaattgtttgcccaccggccttgatagtaatcggtcagctggttatagttgagtgttggatgttgcactggagatggagagattagcaagcagtttctgtttatgagctgacgtatgcacggagatattgatggtaggtagcactacacgaaccgtccgaatcagccatatacactgattgaatgtgtgtatgtacgtacgtagtcacgtacaagcgcttgcagcctcgcatacatcatatctactcgaggtgtctacttcatccctttggatagtgatgtaggccttgtcattgtgtcaataatttgtatatggagttatatacggctctgatcggtcgagcagtcgagctgctacgtttgacaagtcaaattatgaagaaagcaaccaaagttaatacataagtataaatttaagttttaaaatttaaattttgactgtcgataagccaataagatgaggagaacctatattcgggcttaggtttattggattaaactcgtaagcaactattttttcttatatggtttatgagctggtggcttttaagccctcaagtgtaatggcgctacttaaaaaaagatttttgtatgtggtcagaattgatcttcgcaagtggctggcggaccgcatgcacgcaaatgtctgcggaaatcagcattttcgcatgcgggaggcccaactgcttggggagattcattgttgcaggccgatgagctatgtgagctggttaagtcactgaagtgttcattcttaaatgtaaatattacatttctcagctccttagcaaattcttgatatagtgtatcaaaggtcttccactaaagagcattggtggattgtcgaatcataccat

SEQ ID NO: 8765 - DNA, 738 bp, Oryza sativa
ttcctgcagccaaactactaggccttatagcgtttcaccaaatcgttttcgtttcttccaaagatctgcgtggtacaaccgtacaaagcaaccctagtagtcaatttggtcaggaggagcagcagcagcagaagctggaccagtgggctgcaccggtgacttggtgagcagtgctgctgctgattcaggccagggaacagatctgcctgcgtggggcctacatctacagtaatcatatgccattttgggccgggatcaatccgtcaggcaggccggccgttcgattggttcgtttagcgaagagttgaatccagacggcccataatctgttgcatgggcctagcaaaattgaagttagagctaagcccaggcccacagtcagatgaatagccaagcccattagtgagattccctgtgatcctgccatactgggccatacttttcggcttttcctttggcccaacttaagaggcaggcccacggtcaatcagtcactccagctggttaggtgatcttactggaaaaacgtaattaaccactgtagtaagaaaagtattcctaccagctggtcaaaaaaggtaaaaagtaggctgacatgcaagcaaagcatatgcatattgcatggagtacatgggcatgcaaggttgggcggtggtcaagccaacaaaagctggccgcttttgctaacactgacttggacccatccataacccagcctgcttgctgcctgcctagctt

SEQ ID NO: 8766 - DNA, 1479 bp, Oryza sativa
ctaaggtcaaccatgagcattttaactaagtcagaaatgttttgctctatccgatccaaactgtaagcattgttggaataaaatccaacagggattgagagtctaccaaggaaacaacgcgatttctctatcgttgtctccattgccctctttcgaggagcgaattacaattatatatccctagagattatatgggaagttacgaaggggccctttggcctccgcccactacgtggaggctggctggcaggcttggcctcgagagcaagaaggtaaaactctaggcgaccagaaaggggctgcctccattaaaccccccatcacggggttccgacgaatctcgggatagacagctcgaggccgaggcacgctatcgaggcgcctcggcattcctgcttgctctcgccgcggatacgtcattgatggttgggttcattgaatgcaccctaaatggcccgtcttctcgtcatagatgcttcgtgaagtcgcattttgccggagccacctcgaggatggtgccattctagactaggtccttcctggaggccttaccaaggcctcaaccgggcctccttcagagtcccctctggttggtaggctagggcacctacgctgagaagggtgaagatactcccccaagaagcatttctagattatttagtagatattaaggttaagaaaagaaaggcttcgatgtattctcaataaattgtaacgaatagcggtgggaggttagttagggggtaagatggaaagaaattttaatggtaaatgattgatgggaaaagtaatactgtgaatagtgctaaaaatccttgtattatagcataagatttaaatcctattttttctatattttggaacgaggacgtatgtactatatagtctaccatgcatgtgttaaacatagtacatatcttgacattttctaaaccgaaactcctagataccagaagtacgtacctggtacgtacaaagcagtgatgacgaatgaagaacaaaaattaattgtgattgccctaaactaaagcactgaaccaatatagtagtaagattgatgaaatacgtacggtgcactttggtacactgcgtgtgggtaaaattaagccgtgttcccgtagtggagtacacatacacgactgcagtatactgtacgttaggatcggagtaaatgaagggagagcggggtaggtacagtacggtggaaatgaattgaatgacatcgccaacagtggccctttgtcctggacacaaacgccacagatctatcccgcggctaatttttctgatccatggacgattactctcatggagttttctacgatcgatcgagcagcagctagctagcagtgtagtagtattttttctacactctctttcttcttcttcttcttcctccttcgcattgctgatcagagcgattcagagctagggtgtgtttcgttcacacgtcaaaattaaaagttttgttgaaattgg

SEQ ID NO: 8767 - DNA, 5497 bp, Oryza sativa
tgcagcccaacgaaggaaatttagtaattgtcgtattccaaaggaggcctaggggtcaaataaaacactgacgatactgggatacctaatcaatatacagtatatatactagctcaattaggtagaaaaactcatcacgcatgcatgcaaggtatgcaaccacaatcaagcaagctgtggctacagagagtcagtcagtacatatatatcaatcagacatatcactcacataaagattgaagccggccatgtgctaaaaattcttttgaatcccccaaaaaagagaagcagattgagttgcacgcaaagttgtcgaataaattaaatagaagcaatacatagaacagtcgactttaatttgtctgttccatatatatatgaaagaaaaagttttctcaactacacatatatatgcattgaaaggacaagcaaaatctaagatagtgatagatgcatcaactgtgtgaaaacaggaacttgaatgccctcctgctaagctggtagcaatgccatatcatatagtatacatatatatacatggggacagcagagatgaagtgaaagaacatgtgtgtggcactgttgcattgatagggacacaaaagactttagaagtgaatagttttcatgcaaaaagaatgatctgatcaggttctaacaaaggtggtaaactaactttaaccacaaagagaattgtagttttactgctgtctgctagctacctgaacatgcattctcccttctttctctttttttgaaaaaacctctgatcattgatcatttgagttgttacagaaacatatatatatgtgcaggtcagttctactatatatactcatcatcaggaataataaacaagtgaagacaaattaaatcaagtcaaatccagcaattcaaacttgaacaaggaaaggaatcagaagcatcaaagcatgggcaaaaatagggatcacccaatcgtactagtgcacacccaattgaaccctttatatatttttggtgcctggctgccttcttttctctccttttttgaaaagactcctatctttctttcttcttttgtttggtttgtttgtttcttcatctgttaccactttgcacatattgtaaaagtgaaagaaggtagtatccagtactgtaaaccattcaaaaactggcactacacaacaaaacattgttcaaagcaaagaacaaaagcaacatatttttgtataaagtctagctaccagcacacacatgatgaccaaagggagcacttgatcatgaatatatcaagaacattgcattgcacacagatcatagcccaaattaaagcatttggcatatatatggaatctgttcccaggacaagtacacataacacatgttgtttctgtcttaattaagctaccaattgaaatcactcatcatctcatcagctagtcgatctctccctttttgcccttttgctcaaccaagaaaggaagaccaagacatcatcactagtacatgatagatagaaggaagcattgctgacgccactgcacttggctagcttggcgacaagctattacaagaacaaattctacagatactaacactagctagcttgctatgcctacagcttctgctacttttgttcttgcaaatcccccagactaaaacaaatattacaactcctaattaggctagctagcttgagattctcatcaaatttactccagttcttgcatcaaaataattaaaccaaacgggacgagatcgatcgaagacagcagctaccaattaattgacgtcccaaagctaaggaaaaaaacaagaattaaactaagtactcactcatgcatgaccttcgtcctagcttagaaagcgagacagagatgaaattaaaaagaggagaaatctttttttgcaaaatgggagagatcgaaaccaattcaggaggaaagaagagatatgatgccttgtactggcaaagcaagatggcatttctgccaaggagattggaatttcttgctgcgaggctcgatcgatcaatggagatgcggagatggcgatggggatcgagaagaactcacgggatgatgaactgcggcgacgccgacgtgtcgccgccgccgctggccgagccgccgggtggcggcgggctcccctcggacgagggcccggctccggcgccggcggacgagggcttcttgcgcttcttcttctcgtagctgatccccctcgccctggcctgcgtctcgcgcacctcgcgcaggtagaggcggacggcgcgggcgccgaaggggttcatctccggcgtgccgccgttctcctcgtaggcggcgcggaggcggccgatgagcgcgtcgagggagccccaggcttggcggagcgggcacgggcatggcgccggcgggttggggtggccgtagaaggggcacaccggcgtgtgcaccttcgtcttcccgaactggtccatgtacttgaggaactccagcacgtgcgcgccgctgcaccgcgacagggacagcggcggccggtggttccgcaggtactgcccgaacgtgttccagtcccgccgcttctgcgactcgtaccggctcagcgacggcgacgagctggacggcgatggcccgccgccgccgcctcccgccgacgtccccgcgcccgacgacgacgacccggcgccggagaacatggcggccgcggccgggccgaggaagaagctgtcctgcgtggcgccgccggcgccgccgtcccccgccgccgggtcttgcccgccgcccgacatcatgtgatggtggtggtggtggtggtggtgatggtgacgatccatcctcgccctcgcctcgccgccgtaatgcaacctgaatcacaagaagcaagcatcatttcttgctccgacgaaatcgaacaagaagagaagaacctaagcaacgatctatatctatatataacatgtaccggatgaatctgcttcccgatctaggtcaggtagcagccgatctcctcctccactgctccactcgcagcagcagctgggatcgatcgatcttggcatgcacgagcacgagacgaggagaggtgtccgtggatccgggcgacctagctagcgatcctccaatcatccatgaggaattgaacagcagctagccaagtactacgctatgctctcctcgctctcaggtggtcaagccatgcttgacagcaagcaaggcagcagcagcagcagcaagaacctgcagggatcgatggagagagagagagagagagagagagagagagatggagtggatgaacagtggatgatggcgatgctggaggagtggggggaagagatggataggtctagccttttaggcaggcagcctgggaggagtagtgtgggtgtggagtgagagagcctacttgctagctaggtgtgtgaggtagaaatgggtgtagtagagcctagtagggtataggaaggctagacagcttggtgctagctactcagggggtgagaaaatgacaggaaagttaattaaagagaaattaatattcgaaatacaatacagatgcacacgtcgtcgtctgtacatactctgtgacttcggcaatttcagacatgttagccataatttctgtaaagtgtgtatggtgggtgtgtgcatatttatagctagctttctgggaggtgtaatatacaaactcaccatacacacttaccagaaattacagctaatatgtcttgagattgctgaagtcacaaagtgtctcactattggtgatgtcacctaccagttaaagatgtttcttttttgttttatcccatttacctttcactctcttaattccaaagtttgaacaatataaagttaggatgtttgtataaatatatttcattttcaagtatatattccatccatgtactagcaataatattatctttgcaattccttccatgccttgaggcctgcagggaggggagaagcatgacatgactgcaggataatctggaggggatggcctcttgtttctctcctgctgctgcttttcttgtcgatttttgaccgaccctaacttgttttttgtgtttttaaattctatcattttgcagatttgcagtgtggccgccggataggatcatatgatgggatggatgggtgcatcggtgttgcacgggcacacaactgatagaaaaatatgcacactatgtagctagagtgaacaggccacttatgttactactgtagacgacatgaaatatggtatgtggtgcacaaatatattgttggatgcttattatatatgtgcatcccttatatgtacacgtattgtaggtgtagtgttttgctgtagaccattgactggtgtggtcagggctgcatgttcccatccacctgaatgctgaatcatcctctctctctctctctctctctctctctctctctctctcatgcatgatatgcccctgcccttaattatttttcatatataccgtataaattgtttcctagattatctatatctgcttaattcgggaaactatgtcgtatctgaattttattttttcccgcaaatactagcgtttaataagtattaaaaaatgagaaacatatcaagggaaaatttattatttgagaaactatatcgtatctgacttttttttgcaaatatatcgtgtttaggtattgaaataaaaatgagatacatgcaggggaaatttattatatattgcctgcaatatgtgtgcagtcaaaatgtgctctaaccaaaacttgcctagaaagtatgtttggctatatgaaaatgataggagtaaactcttcataaaatgctttaattaatctctcaatattataatttgatagctagtatactgatacataatattaaaaatatagtgatcaaattaagttatggatgcatgttaaccataaaagatcaatttttttttcaaaatttatgactagctagtttagccaatatcaaaaattacgttttctcctatattttgtctggatatgaccaataaacatatatataagttagatctgcttattgttattctaaaaaagatttataagagatatatagccgaacatatcttgtggcagaatcgagtccatttgtgtgcatcgatctggccaaaaaaatgggggatcgaatagtaaattagctttgagcacatacatgcaggagacaagcgcatatgaatgctcagtactgattgagcatgtacagtacagacatgcatgcccaataatactaagctagaatgtacacaactagaaaatagctagccaattaatcttcgacaactaatctctaacgattctcacagaaaccgtttgaaatcaagtgatatataacgattccataagatatatgcaaccgttactgggtttgtacttcatgctaatccctaatggggtgatccagaactattagaggacatatacgacatgaaactagttatcataaaatgtgtggacccccgatatggtagctgctcttgtacaaagctcctgagggctcctttaaaacgtag

SEQ ID NO: 8768 - DNA, 1839 bp, Oryza sativa
agttaattttccaagagcttaattagagctcatgttagatttcctccaaaatccttatgaacttggccatattccaggaatttgaaagggtccattccatttatccaaaggagcatatatataggaaaatattccaaaggattcatatctacaaaattcctttaataaaacctttgtttcaaaggatcccacagagattacaagtcatcatgccacgtgagccgctgccatcccgtgggccgaatttggccactcctagctcggggtcactggatctagaccccacctcgccagctgtctcctatcctcctcacttaccacaccagctgcctacgacatgggagagggagggaagatagacctcaacctggacttgggagagagaaagggagagaagggggagggggagagggctcgatatagggaagggagaggtacacagggaggaagagagctagcgtggtgcggttggcaccatggtcagattaggagggaaggaagaagagggaaactatgagagaagaagaggggattttgttgacgtggggtggggtggggtgggtgcgactgataggctaccacaacttatgttttcagccgtggagccttaggaaatttttaacctctcctagctctggtcaaatgttggtcaaccagttttctctatcggttcatggcataagctggcaatgatacaaacactatcagtttgtgataaaagccgacaataatactcagtataactgctggattatgtgatcagtttggaccataaatcacggtggatcgacaatgatacgctatcgctgtcggttcacactgaaccgacaatgatgaggcgacatggatgatcatttatgtggcaatgttaagtggataatactgagaggtatcacactctttgaaatctaaattttgatagatagctctcaagtatctcagatactataagataccaattatttttatctcttatagatagtaaaatttctttaccgcagtgtccttaaatgaacgattagatattactattttgaattatcaatgattaggctccgtgtagccgtgcatggttgcagaacataaaagaaatttataccaggcaaggaaattaattgaacaggtcgctggctgcttcacaacggccaccgtctctcttcgattcggcacagtagggccatgaatgtacgcgcccacaacccatgtacaaacacacgaactttttagagagagtgaaggggtgtagcatgcatgaacagtgccttttcagaaggaagagtttgaaattaaagttgtttggagcgacgatggagaaggagctgaggtaggaggacgacagtgacaagtagtgaaagttagtttgcatatggtaatttttttttcttttcggaaatcaacacaacgcagagtacagggcgctctagtacttgcaaacatatatataagcctatgaggagatagatcatagatctggcatcccactcattgcaatttacgaaaccctaatcctttcttcaagcacccccttaatgctccatgcagctacttacccacaagctaattaattaattcgacacaattcatatatggcattggcgcctaccagggtttacaaaaccgccggtaaccgcggttaccacgcttactgtgggggtacggtaaaaagaaaaccacggtaacctccttaaattcaaataaatttaaaaagtaatttgaaattttgataaattttacacggtttcgtacggtttgccacggttaccgtggttaccgcgcggtaaccgtgcttaccgccggggcgcgataactccggccccagtggtttgggataccttggcg

SEQ ID NO: 8769 - DNA, 757 bp, Oryza sativa
ttgaaatgttactttgttatcgccttctatgactggtatgattgagttgaccttccttttttcttggctaaagctggtattccgcacttgaagtggtttggcgtggagggagagtacaatgtgatggtgatcgatcttcttgggccaagccttgaggaccccttcacctattgcagtaggaaattctcgttaaagactggcctcatgcttgctgatcagatggtgaggacactgatgctttattttcaaatttcctcaatccatatattctaatttgttaatcgttgtagaatcaaactggtatctgtatcttgccctatatagattcctgacgtaacaccatttgttcgttatccagatcaatcgagttgagtacatgcatcagaagggatttcttcaccgtgatatcaagcctgataatttccttatggggcttggtaggaaagccaatcaggtttgcgttcctacctggctattaccattttgtgtttctgcatgtttaaccacatcaatagtttcatggtattccatttgatacagtggtgccctaacgccttaaatttttcgtaacttggtgctcttcattgctatgaaggtccaaaaagatgttccagtagaatgatatggcttgggttttaagggcctgttcactttgatgccattttcaaccttaccaaattttggtaaagttaccaaaaaagtagctacatttagttttctaccaaattttgataactatataagaaatcctaccaaa

SEQ ID NO: 8770 - DNA, 6406 bp, Oryza sativa
ttaataataattgtagataacttgtgggatagaaagaaacaagatttggttagcaaatttttgaatccagttaattttgactattttggaccttgtttcaggtatatataatagattatgggcttgcgaagaaatatagggaccttcagactcacaagcacatcccatacaggttggtgtacaactttaaattacgcctatgcctactgcatatgctgttgttttatttgttatccagcacaaaattgtataatgttataaggacattggcaaatatctcaatgcacttctcttttcaccttttttatgttgatgtcatgttcattatgcagagagaacaagaacctcactggaacagctcggtatgcaagtgtcaatacccatcttggtgttggtgagtttactgtgtcttctagctgatggagtacatttgataagagcttttgcctaatttaagttttatgttcatacagagcaaagcagaagagatgatctagaatctcttggttatgtccttatgtacttccttagaggcaggttggtttgtgatattcagcattgcagacatctggttttcttgtaatgtttttgacatcattttctgtaaacaatgctaaatatttgctatcattcaacttccaacagcctaccatggcaggggctgaaagcaggcactaagaagcagaagtacgacaaaataagtgagaaaaagatgcttactcctgtggaggtaattcatgatatatacttttggtatctgctcttgtttttttcaaagatcaaactgcatcaaactgacacttttatattgttttttgagctaggttctttgcaaatcttacccatcagaattcatttcttacttccactactgccgttcattgaggtttgaagacaagccagattattcttacttaaagaggctattccgtgatctctttatccgggagggtatgttctcttaaacataaatccttacctcatgatcataaattgtacttctttccatcttccctcagtgttttttttaaactgaggataagttctgcacatttctaatggcatcattgatacaggatatcaatttgattatgtatttgactggaccattttgaaatatccccagataggctccaaaccactgatgagggtatgcattctgctgttataattattggacaatgctctcctgtttgatacacttgatttgactttgttcttcttgttgattcagccaagtgaaagaaccagtggagctgcgggaccttctatggagaagatggaaaaggccccaggtctgttcttccacccatgaaagacgcctaacaaaactataatacaaacaatacagcccgtaagaacatcttattttaagcaggtgaagcatctggcagaaggaatcctactggttctttgaatcagagtgacaattatgcacaacggccgtcaatgtcactaaaggaaatcgtaagttgaatccgtccccgcatgaacttgagataggagtccagttcctatgctgtataatgtcttccccttgtgtatctctcctacgtgtaatttgacgatcatgaaatggttcaccttctcagatgcatagcaccgaccggtccggcgaaaggaccgtggaaagaccccgtacatcctcccgtacaggcagtgcatcaaggagagcggttgcgtcaagcagcaggccaggttcatcggtggaaccaatggagcagcaatacagccggacaagcaggttgttctcaagcagtggaagccgtccttccagcacgcagagggttaatccatcggttggagagacaagggccacttctctctcacgagcagccgttgcaagagggtcccgcgacgagcctctccaccgcagcctggagctgctgtcccttggtggcggtaagaggaaataatatggcaagagaaagaggaatctccacaacggaaagagaaaggaagaaacgctgtttgcgactctgtaaatgacaggattatcacctatttgtcaacagttcaccaggagcatcccataatttcatggtgctccggccctgttgtatcattgcttcatagatagcaataatttgtttttgttgtgtgtgttcgctgttgcgttagggccaagtcctagctttgtgatgattaatttagaggtggtcaagattcaacatatttatgtttctttaccttaccccccctggacttggcaacttttcctgagagacaagtattcgtgtatcccccccttcttattcaactctggatttgcttattcaacagaagttgataaaaaggatctcccctgtgcaaagctcccagtctcattgttgcggcaacgtggcttgtcggtggttatggcaaagaaagttggcacaccttccttcttgtgtaagcgttatgatgaagtttgtagttcacacatctttctgtttgtgttaacattctttttccggagttaatgaggaaatatttttggcctgggctccaagaacgcacttacgtgggccggtaaatcttctgatgggccacaaaattttccaaaacattgggctcggtctctgggcctcggtagcctcgagctcgcaccacctcacgcttcacgcctcctccacagtccacacaccgcgccgccgccgtggactcgccgcaccgtccgccgcgccctgctccgtcctgctccgccgcgcgcagccgcctacacaaacctcgctccgccccaaatccagtaggagaagaagaagaaggggggaatccagtagcgttttgaccggaagaagaaattgaacaaaacgagctccaaccctaggaggtgcgaggcggcggcggcggagatggaggtggtggcgctcgtcagcggcggcaaggacagctgcttcgccatgatgcgatgcctggactatggccacaaggcaaggcaacgaaccgcagcgcaacccaatcacccagttctattctatcatccgtttttcattgacatgctaatgcttgcagattgttgcgctggccaacctcatccccgaagatgacgccgtcgacgagctcgacagctacatgtatcaaactgtatgcactcctctcttcactcatcgttagctgattagcagctgcttctagcgctgggctgtggccattcgttgctggtattctgtcaaattcgctgattgctatgcctattgttgatgtggctggaggcttcaggttgggcaccagattgtcgtgagttatgcgaaatgcatgggcttgcctctgttccggaggcgcatccgtggatcctcaaggcaaggcatctgtgcagggattgtctttattgttgttatatgctgctactgttcttatctagatgaaatttgatgcaatttcattgattggacttgcttgtagggagcagggtcttaaatataatgttaccacaggcgatgaagtggaggatatgtttgcgctcttgagcgaggttaaaaggcaaatcccatccatcactgcagtgtcttcaggcgccattgcgtctgattatcagaggcttcgtgttgagagtgtctgctcaaggttgggcctggtatcgctggcgtatttgtggaagcaggatcagactttgcttcttgatgaaatggtaacttcaatttcattttttcttcttctgcatattgtctggcatatcagaaactgtttactcaaattactagttctgttttggttattaatgtttgcagataagaaggggcatagtagctataatcgtcaaggtatatacagcacactcatgcatttgttctcttggtacataattttttttaacttccttgcaagtatgtatttaactgtttatcacatggaatatctgatgtttggactttataggttgccgcaatggggctcaaaccttctgctcacttagggaaagaactggctgaacttaagtgtcatctgctccaactgaatgagtatgttccccactgcctacatagatcccatttagccattttcctcttggaggtttcatgtattagaagaccttgtatcctgttataacttgtgggttaatgacccaggccttagcttctcgtagtgatcaatgagggagtggtttccaagaaacatatcacaacatatcgctctctttatgtctgttctcatgattttcttactaatggtcaatactagtcacttgcatctgtgcagcttgtaatttctccttttgtttttctatatcccactaggagttatggaatcaatgtctgtggtgaaggtggcgaatatgaaacactaactcttgactgccctctattccgtgtaagtttaaggagataagagctgaatgtgaataatctgatgccacttgtctgaacatgtggaccagtccttaagcatgaatcacattcaatgaaacgctgtaacttggctattgactatattctgagcatgcttatcagatttctgaagcatttcataatttatactactattatgtgctatgtgcagcagaagcattttgttaccaagatggaactgatgagtttcttgtactgcagaatgcaagaattgttcttgatgattttgaagttatactccactcgcctgattccatcgctccagtaggaattcttcacccgttaaaatttcatcttgaacacaagccaaattcttttggcaccgttggtgatagtgctattgcccaagagaattctagttatttgtatgaagtagatggagctattgcacacagtgatgtcgaaaagaaacaagagaccttgagtccagttacaactgttgatgcttgcacaaatatagacctatgcatctcaaagactggcaaaaagttgttctccattggttgttggattcaggatccctgtggtacttcagaaggtgcatgctcttgtgccttattgttctgtgtaacattaaattgaccatagtcccgcctgacaggaatatctcctttcttttgcatcttcatttgtgggaaacgtccatttaatatctccttatgtctataggcctgaagacagatctagtagcagttttgagcagaatcgagaatcagctcaaggaagaagggttaggttggatgaatgttctgtatgttcacctcttcatttcaagcatgaaggaatttggattggccaatgaagtttatgtgagctttattactgaacaaaaatgccctctgggtgttccttcacgtagtacagttgaattgccactagttcaggttggtttaggccatgcatatgtggaagttctagttacaaaggagcaagtcaagagagttctacatgtacaaagcatttcatgctgggctcctagttgcatcggaccttatagccaggtaagagaagcactatgtggttatatgtcatgggtatgttgaaagttgtatgcttctatacaatattctacatagaattcataagcaaggttcctgtagattagttgctagccaaatctaccagttcttttttctcctcagttgtacattctcagtgttaaagttttttgaattttgcttaggcaacacttcatggagagattctctatatggctggtcagctggggcttgatccccctacgatgaagctctgtcctgggggcccaacggctgaactagaattcgcattacgaaacagtgaagctgttgctaatgcctttggttgctccattttttcttcggcaatacactttctggtgtactgttctgcacacttgacgtccagtgaaaaagaacaagttgaacatacacttcgtagttcgtacatcaccagtttggattgctcaaataccggatcatatcccaccattctctatgtatttgcatcagatcttccaaaagggtaaggatatccgtcattctatttctcaaaaaatgctttaatgctgcctggactctcatacttgaaccaccacaatgtcaagtgctcttcttaagttaaaatagacttttcctcattttttcaaaccatacgtggagataaaaccaatattgtatgtccccagtcccactaatgatgatggagtcccaaccaaagaacaggaggctggagggtcattgccagcatcaagcgaagcttttagtgcctggagcgcacaatactctgacctggatgattcatgctgccaggtgcacacaatcggtgggaaaatttgctctgctgttgtttcaatcacaaatgatattgcattgaaaatctggtctacaactgaacaactataccactcggaggagcatttgaaagctttggctagattttgtgcattccagcttgctaagattctgatagataatggcttttcctgggacaacctaacggtacgtatctgtcctgtaatcattttgcatctgcctttcccgaactctaaccatcatctctgggctgaaatctgcagatgttaagattctactattcag

SEQ ID NO: 8771 - DNA, 1633 bp, Oryza sativa
gtctccccgtctctctcctcccgaccccccaaatttagccgttacaccaccttccgttctctctcctctctctctctctctctacggccaaggatctcaatcacagagaaggcacatcatcaaacaaatcaggaaaggaaggaagaaaggagaggaaaggagggagtgaagaacaaatcttgattcgtcctcactgcgcactgcccccccgtccgtgtggttccagctgatcaccagcagcggccggcgtcttctcgtctcgatccctcctgcctctttggccgcggctcgatttgggcggtcaagatgaacaggatgatgttcatggcgtgctgctacaacgatccggacatgctcatcgatccggacacggtctaccccatccgccccgagtgccgcgaagacgccgccaagacgcgattcaagcccagggtaattgattcattctatccatttctaattctccgttttaatctaattccgcgtcccctatgcccccgtccccattttgacagtgcccatcttgcgctggattggatctagtatctaattatcaactgttactgttacctttttttttatcttaactgttactgttacctggatgagctgaattaggctcagatggccaatcgattgatcttgcaagatgatgagggcatttagtttgaaggtagaattttgttgtctcagatcgatttgccgagcggaagcatcgaggattctgactagcgagattagtgccagccatgtatttgattatgaagtgcattgactcgttgtgtgctgtttcctcttccttttggcagcctggcctcactctaagtccaaggagatggaagctgcttcacaatgaagaaggtgtcctagacatagctggaatgatcaaaagagtgcagcgtggggtgagctatacttttcgattaatcccttgcatgctccgaactagctgaatttacgccgtgattgcaccacagcgccaggctaaattatactttttcagaaagtagaattatactgttatatgcttagaaatcaaataactagttttttttattattctgagattttcagttatcctacattgtattgatgttgactcttcattttaatctacactaatatggatctgttacacaatcaacaatgtgaactatgaactatttatttttctccaattaacatggtaaattgtagcctgatgaagtgcaaatgtggaggctaatatttgccttgttttaataatttagtaatatatagatatttgcaaaaattccttctcactaacaacacaagcctaggtccgtatgtcaatgagacaatggttgacagatgatccaaacatgatgggacatcaggaattcctcattttcttcctgcattcatgaatcatgacctcacactaaggccttgtttatttggttggctaaacagggtacccacccaaatatcaaaggagaagtttgggagtttttgctgggttgttatgaccctaaaagcaatactgaacaaaagagccaattaagacaacagcgaaggttcattcttaattgcacctttattgtttgatcatgtatattcattctaatatctcattctaattttttataggttagaatatgagaactgaaaa

SEQ ID NO: 8772 - DNA, 5953 bp, Oryza sativa
ccaatgtcgatcctcttggaacacgaagcggatgcgttttggtgctttgagcgacttatgcgcagggtggtaagcacctttacacatgtagccttttattcactaagaaatatccagatcctttaccctaagggtcagtggcggatctagaaattttattgaccccgggcaagccactggcagtactgtacaaatgaaaatgaacttgtacaactctacagaccattttaccattgacacaagtaaaattaacagtacgagttgcagtatataagctgtgatggcctatagggctccatcgtttggcttattataagaataagccaaacaacatatttacaaacgaaaaataatttatgaatacaactttaatatacgtgctcttagcgacccaaaagcaaaggctgaaaaataaactttgataaaaaaacctcaccgtcaactctaatttaagattgaaaattcaaattttggctaataagcataagcataagcaaaaagatggggctgatgactgcaaacatgtgatggtgtgagccttaattatatgctttgctaattttctcaactaatctagcattcattaaggtaattaattaaaaaatatgctaactttgcatgattaatgaattgctaatctactgcagcatcttaggcggagcctgggcatttgccatggctggctgggccttgactccgccgctgctaagggtacaatttatacttccgatatatgatgttaattaaaagttgtgcacaactgcagtaatgttacagtaaacttaaaaggtcaatatggtcgctgtaatatgcagaaccgttttctggaaatatttttgcaacttagcatggcctatcaaaacaataattgatattgatatgaactaatgaacattatatgggaaaaaaacccctaagattgattatagtggttttgctgcatgtgttatctgtctctgttaatttttctacagatactgagagattgatattgtacatgctaactctgcagcgaggaaatttcgtgagtagttcaacctccattggagttcgatctcaactgaccatattgtcatccgtaatgaaagccgttgatccgaagctacatgagcatttaggtagagttgtttggagccaaatattgttcattagaatggccaaaggaacaatgccttttctttctgaattattgaactataagtagcgtgatttattccatgatcaaaagattatttttgcagaaaatcttgatggaggggaatacttatttgccttccgtatgctgatggttcttttccgaagggagttctcttttgtagacacaatgtacctttgggaggtaagcttcccaacaaggtcgcataatttaaccttttaggtgtgttgattagttccctgcaccataagaattttcttgacttttcaattattatctcatgattatcctaataaagcataatcaaaatgtggtttctacttacaatcaagtattgatttgtactgtggaaggtttataaggctgtttccttgatttacaaatgttgcagctcatgtggtctatggagtacaatccaggtctcttttctatgttggagagtgataacagtacatctcaagcaaacacaaaagatgaaaatgccttaaagcagtgtggaaaattcgaacagaaaaacttacaggcggctaaaaaggaagagcagatacctctatctgtgttcattgtggctagtgtcatagaggctagaaacaagcagatactgactgatgcaaaaggtctagacgatgtcgtgaaggtctctctctctctctctctctccatgtgtgtgtcatgagatgatgattgtagaaagctatacacgattatgttgtttatgtgcttgtcccctgcaaacagatattaaacgatatcactggaagtctggatgcaaagaaggcatgcagaggggcactgaagattcatgagagatacctaaccacagtaagatttctgttaatccatttgtataattatatggccttagacgcactcaggagtcaggagtcaaaactaaaataactctctactttcctaaactgcaggtaaaagcatgatagtagcatttacagatccttattaatacatcttaagtgacgatattcgattgggctttttgtgaactggagaagcagctacatcgcaatttttccccatttttgatacgtgtgtgtattatacaattctttgattttctttgtaatactacaaaagaaaggaacgccaatcctgtaaaggtacatcacgaaatgtttggtatcggtggaattatgctgcaataacatcgtcatgattcttctttcctactgttcttgacactgcaataaatttgttcactatttcttaagaatacagtgagttaggaaaaagaaaatcaacttgttggattccgaccatgtgtgtaaatattgtttaaaggattatttttcattttctttgttgtagcttccagtggactagagacggaagtggcaaaacaatttggctacattaagaaacatgaccaggccgcttgaaagtcttgatcgaaaaagctaagaaacctacgataatcatactatatatcaaaacatttgcaccgatactttatccgttgttttccaccggacactccatactgattgaatcaagtattagatcattttgcgctgctgaactcaagctccaatgcaagcttcgttaactacctacgaaaggatatgggatatgatcggaaattgtcaaaataagaggcagattggcttgttagctaaatgacccctttttcatgttctgagttgtccatccccgccatttgcgctgcagaccagttaagcaaaaccagggcctcacaaactgctgtatgtcaaaatgaacttcaaccaaaaggagcctagaccaaaaatagggaaccataaatagatcgaggcaacaaactttctgcccttccatttctccaacttggaagagagaatctatgcttgttcctgtttgagctttggaagggattgcaattccactaaattgtgatagatcaaacagcaataggtgaagagaattgctgcagacacaatgaagatgtcataaagaagatgaaattcggtagatcatgcttcatcaccctcttaaatctgctttgcaaggtatgtgagtctgattcaattaggcgccacaaatttgtgtgtgtcaaatagaaactgaacttcagaatgttgaaaagaacaaatatatacattgctgaatcttcatcttccagcaaatcatattacgatagaccacaatagttgttttgttttcaatgctacgtggtcggtagatgtaaatctcaccccaacacctatagcattatcaacattgtattttgacgaaacattcagatggcttttctcgttttttttatctctgttcacggtggtatttcatatttgtaaaatcaagcttatggtcaataggttgtatcccatttcatagaattgttagttcttacttttgttttttaaatgatattggcccggcgaaaaatttgtaatgttattgcttacttgtgaaggctagatcaagggacaaggggtggaggacaaacatataagtggtggattcctcgcagagcaccgcgggcgggcagccgcctgtggaaccggttaagatgaagggccttctcaagggcctccgatacatctcacaaattttcggtacgcctcgaacaccatcaatttccaagtctaacgaatccctattccccaattccccaatccaattcacctcaacattgttcatgccacacattgataattcatcatcattcatccacacaacgaaaatcaaaatgcattacgggatggcgttgtgagagattgtgtaccttgtctgacgaacacgcgcatgcccgcgcacgctggtgttgtggggttggttgcttgcagatccgagcgtgaaggagccggagatgcagatcgggaacccgacggacgtgaagcacgtcgcgcacatcggctgggacaacgcctccgtcaccgcgcccagctgggtgatcgccgccgccttgctcctcccccccgatcgcgccatctcccatgtctctaactgctccgatcactggtcgcagatgaacgagttcaagccaacggcggggggcacggaaggcggcgaggcggaggagaaccaaggaggaggcggcggcagagcggaccaggcggagcggccgcggcgggcggggcggggcaaagagcggcgcgacggaggcagcgaggggtcgcggcggccgccgaagacggaggtgggggagaacaactgcgagggagaagccgccgcgggggcggcgccgaagcagcggcggaggaaggcgagggcgtcggggggcacctcgtcggggcggtccaagtcgtcgtcggtaggcggcggcggcggcccctccgcggcggcgaggccggccgcggcgggggatgacgacggcgacaagtgcttctgaggcgacgctgcaacgcgcgatcgctctctcgttgctgattttttttttttttttggcgtggcaagcacgaaacatatggggggaggatttcgaatttgtatttgaggttttcgtctagactccgggctgcttgcaggagaagccatcaactaggaagaatttatatgggcctttctcttttcttttctgatttttctacatcatttattcctttattttgtacttatttttgtggcgttagagtttgtatatgtaatgtagagttgggccgagaaaacaagtgacggcctgtcacgttgtactgtatactaatgttataatgggtcaagttgggcctcgggccgatcagttcatccgcaagccgaccatatgggcttcttgcttccatcacgggccatatgggccttttttccacgcctggtccacatgcctcttgggcttacctttccccacatttgccctcagtaagtttatatttcagtgtactctagtactctaccaagctgcctctgtgtgcatttgtaaattctctctcttttttacagtatcttctttttgtgttgcaccgtgtattagttttattttatacttatttgtattatttcagaaataccgatcatagtgatcactaattgactactccatattgtaactcctctcaatttaaaaatgccagttcatcatttcgggtcctgtagatggagacatgacgaaaacaaatatagaagatgctagataggtatctggttgcattctatgttcagtttgtctgcaccttggtgatcaaggacggagaaacttaattttcagtaaaatgagagaatattaccatctatgaaacaaagaagatttgtcatttgtcttcttcattgccaacaatgacaatacaccatcctggggcaagcctctgaactgtaaatatcttcattccacattattccacatattataatcttttgtccatgcttggtcattttcgtgcaaacatacatatacatctgctacattaacatgacatttacaccaattatagtggggctgcttaagtggcatccacctcagatacagtagcaagtttcagaattttcagaaacagattattcccaagaagaaaaggaactttcagaaacagtggtctatcctgttctttcaaatatattctctgttcacagtatccatctagcagtacatctcctgcaacactttggattagaaatcattcagcacatatatgaaaattgaagtgggccacttgcatccaccctttacgtcttgctgcactctgatagcctgagtgcctgacacctgttgcattccactcatcgccactgttacactcggaagagattgtgtatttgtgtgtagatgctggtcagctggtgccttgttcctttcctctgtgatcggtaactcgtttctactgaacctgtgggctctgtatacatatgacatagatgcagcaattcaatgct

SEQ ID NO: 8773 - DNA, 1220 bp, Oryza sativa
accgaccaaactgaaagatagcgtttttgattcttatcggccaatagagagctgaagtagatgtccctggaccacagagagagagagcatcattttctccttgattcgctgttgatcgatgtgctaccatctgtgtgatcgatcgatctatcaatcgaatcgagatcgagttgctgtcggcattattgtagggtagttcacctaccgtttttcctgcatatatctacctgggtctcagccccttccctcccttctgaaatcgagtgctcagctgccgccgcatattattcagagattagttcagtattcagtccacagtgacgagcatgtccgtttgcaacgccgagccggcagttcgccggacagatcggcgaggatgattccatccccatcggcattgcacttgcacctggctgtatctatattagaatctgtgatcagaaacacagcaaggccttttggccattttctgaactctgaatcgaatggcaggttcagtttggatcgacccgtgaaccgtttgttggtatctgtggatggagcatgatccagtgtgtgatcttgcaggctagctgctatcttagctcttgactctttcccaagagtggtcgttttggattatcgcaaagattagtttaacagtaatgatactgttttgtactgttagtgccgcatgggcatgcagatggatctggacctagatagatagataggaaatcgagattgcgtcggtgatggatgatcgccatggacgtctctttctcccttaacatccatagctaattaatcttaattaggagctggatttggatcgatcttgagctttagggcgatcgacggagatggaagcatcaaatcccccacacgtttgtcgctggagcgatcgctgtgactgagctcgctcgatcgatcagctcgcggtctggctaattagtggaggggatcagatgctgtcaacctctccacatttaatctcttctcttgcagttggtgtcattctcctttccctccttttcggcggcgagatcgatcgatggatcgatcggccgcgtcagttttgggggtttcttgaaagcaaattagcattcaatacagggcaaaaagggtcaccaagatcgatcaaatcaacttattcctcgtgcatccaaggtttaattaactgatagtactacctttatccgaaaatatggagtaagaaatgagatatggagtacattcta

SEQ ID NO: 8774 - DNA, 1724 bp, Oryza sativa
taaagctaacatatataatagagattagctataaggtttgctataattttttttctcctctttctatctcttacttatacatttgatatatttgtcttcaagcttatattaagctagctcttgtatgagagctaacatccttaatttttttacacctctcctccacgtaagctactacctccgtttcaggttataagactttctagcattacccacattcatatagatattaatgaatctagacatacatatatgtctagattcattaacatatatatgaatgttgataatgctagaaagtcttataatatgaaacggaggaagtagcttacagtaggtttatactccctccgttccaaaaaaaaaactcaatctaggagaggatttgaccgctcctagtataactatcttttatctagatttgttgttttaggaggggtcacattatttgagattgagtttttttagacggagggagtagctcacattatccttgctctaattaagcgtgctaatctgtatgcatgcatacgggttaacattaggacgcgtgccttgctgcaaagtgtagtatagtacgaggtcgctgtctaggagggaatatttgctgacgacgagtcgtatcaatcattgcggctgcctgccacacggcctcgccgcacgcctcctccgacctctccttcaccaccgcctctgctccccgcccggccgcgtcctcgtctcctcttgctacttctgcatccatggcagatggcacaagtttaaacctctcaggttaacttagggtctgtttacatctcctgataaaaattttcgctatgtcacatcgaatgtttcaatatatgcatgaagtattaaatataagttaaaaaataaataattgcacagattacgactaatttacgagacaaatattttaagcctaattactttatgatctgacaatgtggtgctacagtaaacattttgctaatgatgaattaattaggtttaataaattcgtctcgcagtttacaggcggaatctataatttgttttgttattagtctatatttaatactttaaatgtgtgtccgtatatccaatgtgacacgccaaaacttttcaccgctggaactaaacacagccttagttactactactacctcctgaaagatcagactgactacttgttatacagatatatatttgctttcattaattcctgaacaaaatgaaattaacctacctcaacatgcagtggatgcatggttcatgcagcagttggctggccttcagagagctgggctagcttaggagggtgtatatgcgacgttgaaaatgactcaacgattaagcataactaatgctgtccatgcatagtgcacaggccattcctgaaatggagacacacagcccactcaatatcaccacagtacatatatgttttttgtgttgcataattcctcttggagatcagaggagcccaatgcaagcactgcacatagaaaaaaaaaatatatgcatggccgttttgcacatcatgcatataccatcgatgggacatttgatgatttcgtgtaatttggatcctaatggtagcaaggaaaagagacagaggaaggataagcgaagctttttctttcttggggaggaaagcttgattgagctcttgatctcgcataaattttcagtacgcagccaaaaaccaagcatcaggctggtagatgctgcagggctgcagg

SEQ ID NO: 8775 - DNA, 1685 bp, Oryza sativa
tgatggcagattacatatgcagcttcggttgcatgcgtacgtactttgctttagccttaaccctgccctcatgacaatataatactagttgcaattacatgttttaattccggagtcaatgcttcaatggaatgttcatgtagactttgagatatactactactcgagagaaaactagtttaaaagcgagaatttgggggtgctcttttggtttctgtcgctttcttaggatttgaaaaagggcactgttagtgttgagtctgattagtaggaaggaattggtggaagaaatggagtatggagccgtcactcttcctataaacaaccctagaaaaactccagcagggacaaaaaagaaatctctgaataattataaaaatatgtacagaatgccatcagctcatgatgattgtgtccgttatattcttttctagagaaagggataagggccagttccatttaagaagcttattagtagtaattaataactaagcaaatgtggttatgctttttagttgtgttgtggcagtagtattcttaattagggatccctatctcctccattggcttccgattaagagcagaaacgatcacaacgtcgtctgtcttttctctgtttctgttcagagaaggacaggggatcaactcacaaatttaagatgcctccagaagtagcataaacaattcatttatatatgcatatcttggcattatatatagggcctacttaagtggaaactcatgaattgttggtgagaaaataaatcacaatcttgactgttccttttttccagcaccttttacctgtacaagaacaactctaccaccaaacatttggacaggagcttttcactgaatccttgatagcaagctgcagcaggatcaatcaattagtactatcaagaaatggataatatactgtgtgtttttatccgataatgggatggtaatgtactgtgcattgacaacgaacaaagcataattaacatttctgtagacctgattgacactttggaaagtttggattacacaagctagcactccacataagcactgcacagtgctctaatgctctccatctccactggatgccgcgtttgcttttccgcgtgcactcgatggcaccccatgactgacttgttcctcagacatgtagctacatccatgcagcatggtcactgagactgtttctggaccagatcgattctctgattctctccctgcctgaaccatacctttcttgctggattttcgactctgctgcacttgtgcgacaatatctagctgctgctaatcagttttaattttctcagacatatgtccgtcgtgcacactgcactgcaaacagatctcatgcatcgtctgtttgctggcttatcagccacaaacaaaatttaattttaaaagttatgttatgattttttttcaccgtagtagcatctttttttcagccttatttttaagccatgaatagtatagatataagagatttatttataaattatttttggttgcttctttcatttcgctacgactcatcatcagccatagcttaacaaattgggattttaatctcctgtttgcatcattcataacaagtcagaatatgtagtagcaagtactttatgtagtactttaccggtcttgttcttttctcttttccactgcccttttggagtaagatg

SEQ ID NO: 8776 - DNA, 8928 bp, Oryza sativa
tgtttgcatatacatgttaaatttgcttctttttttccaaataatcttgaaattccaattaataaatacaaagttgtatttagtttgtagtcgtagtccaaaatttattattcctattttaatggtttaatatctttaaaatttaaaacaaccaacaaataattctattttacaagctcgaactattttatggatcgtttaatccctccctgaaaaaatattttttctcatatttggcctaaactactaaactggttcactttactccctaataacatttctcttttttttatttttatataagttatattttaagttgcaattttatagtgccatagataacaccactatgaaagttcaaaagtatttttaattttcttcatgattgtttgcttggttttagaatcttgatgcttaaatcagccttaggtgcttcagccctatgaaaacagtgataaaaataaaaaatatattgagacgtaagttgcaatacatcggtcatcatcctaacatttttttatttacaaaatacgacttatatagggagaaagaaaagagaaatatgttaggaagtaaagtgaaacatttttgatggtttggcggtgcgaatgagattttttttgaggggctaagtgctccgctgaaatagtttgaaggggttttagaaagaaagaaataatttgagggggtagtccagcgaaatggttttcattacttaatatgtgattgtattcgtcttgatctctcgattttactattataacaactccgaattctgaaattaataattatcaagttgtaactgatgtggtctcttatgttagtttgaaccattttatttagccatacacctacataggcggttcgcaagttgtatgtggatgtagactaccttattaatcgtgccgttaatttctcttttcaattacacggaagacgacacgcacacacaggtttaatacctagacttgttatccatgatatttctttgatcaacatgctcgataacttctctgaatgtacagtatacgcaagctagcaagtgtaggcggattgatatattcaggggcgctgatccttgttttatcctccgtctcgatatttttgttggcttgcattttgcataattaatcaccgtcctatacagtacactgtgtacccatgtatgtacctgcactgtacaaacacagtacacacacatagatgcacttacttgtaagcaaatttaacaagcttagagcatagacagacagagagacatgtagagatgcatactagaggccgggatcgaggaggagatgctgtacgtaggacggatcaataattaagcctagctaagctgtgtcatatacgtatgtcctcatcttttcgcttatacttgtcagtcaaaatttaaatttttaatcttaaatttggatctggttttgaggttttttttatcaaagtttattttttagcctttgatttttgatcgctaagaatattataaaaattttatttaaaaattatttttcatttacaaatatgccgttttacttgtaccacgaataaccgaaacgatggctccccgatcttgcacgcggttgaattgatatgcacacaaacacaatgataatgggcagctagagatcgatcgagctcgcgttttttccccaaatgcgtctctattgatagtgccatgtatgttgccgttgtcgctgcacttgggggatatgtacatatcgatcgtccatcatcaagtgggccggccgtggcgatgatctttcttgcgaccctggatctcctctctctctctctctctctgtccttcttcttccttgattcctcttcctccccaaccccacctgccctcctcctcctcttctctccagagagagagagagagaggtcgtcagtgaatgcgacgtcgtccgcgcacgcgtcctctcccgcgtcctccgcctcctcccgcgcgctgcgtacgtgacagcgccatctcctgcttgcagcagctagcaagcagcaggcgcacagtattactgcaaaagctctcgaccgattgatcgatgctcactgccatatacatgatacttacataccgacgtactacacacagagatagagatcggagctatagctattgctattgctagccatagtatagtagtaccctttgctcctgctgctgctttgttgcttgcttccctacacttctctctctcagctgctagctgcgcatataattattccctcgccaagctatatatatttgcctcctgccttcttcccgagctcacacaatcgccaacctatacagatatatgtgctagctacttccaagttcctacctatcaatttctctcctcctcttcttcttctctgcatcaatctgcagcttaattcttagctatgtacatatagctagctaccacttccaaaatactccacagagatcaatcacatatagatatagctagattgctatagacagagagatcatcaaagaaatttagcaggtgatagccacatggggttgagggacatcgagctgacgctgcctccggggttccggttctacccgagcgacgaggagcttgtctgccactaccttcataacaaggtggtgaaccagcatcgcttcgccggagttggaggagccgccgccgccggcggcggcaccatggtcgaggtggacctccacacccacgagccgtgggagctaccaggtaatcacttactcaatcaaaattaattaattaattactactcctttttcctctcccacaagcgaccctctcactagctccaaatcatttatagctaatgtaatagtcaattcatacaatagttgcttactgtactattaatacctggtcctacctgtcatacacatattacgtcttagagtccgtgctacagctgactatatacctatagtctcctgctcttctctctcttcctttatctttttaaaatatgtttatagctggcttatagcttgctattgtacctgctcttagccacgcgccctctctctcccctcttctgcatgattatggttaattaaatcgtagatggttcctccgtttccatggaatgattaattacgcacgcaaccacgctttattggctccaattaggattgtcgttattcttcccccttgttaattaaccaacaaggcacgggtcgatccatcacgtatatctctgtgcgcgtatgtgcaacagtgtgttatatattgcttctggtgcaagcatacatatacctatatctataatttatttctttatgactgcaagtgggctatctaagctctagctatagcttgttctctttgtctcttacgattacgatcaaatttcccatcaatttttatacatgtttaaaatttaacttatttcattccatatcaacattttcttcaggacatactactatatgtgtgcataaactctccttaatttccccgcgcgccggcccatcctattctcaaaaaaaaaaaaactgagaacaataaaaatatacataatattgaaaaagattaaattaaccggtttgtttaatttccctcaatcaaatcgatctgctttccaaaatttctgaataattaacggtatttctttacaaaactgcaggaacaagtttaatcagaatcatatcgaacaattaatcaagtagctagtattataccacatactgaatatattacggttgatctcagattagtctagattaatcgagttgtgatgtgaaaaattaattatggtgtgcatgcagatgtggcgaagctgagcacgaacgagtggtacttcttcagcttccgcgaccgcaagtacgcgacggggctccgcacgaaccgcgccaccaagtccggctactggaaggccaccggcaaggaccgcgtcatccacaaccccaagctgcacgccgccgcccaccgccgcgcctccatcgtcggcatgcgcaagacccttgtcttctaccgcggccgcgcccccaacggcgtcaaaaccaactgggtcatgcacgaatttcgcatggaaaaccctcacacccctcccaaggttagtcctcacaatccaactaatttctccaataatttccttactcctttcatcctcaaataaataaaatccagcacgggttatggtaagacctgtttagtcaaactgttttaagtttaaccaagtttgtagaaaaaataataatatttttaacccatgacaaatttattaagaaaattaattcaattattgatttgataaactaatttagtatcataaatattactatatttatctataaaattagttaaacttgaaatagtttgactttattagagttaaaacgtgttataacctgaaggagtatagtagtaacttttggttaatcaagagcttgagtttgtgtgtttaattttgcatatgtgtatgcaggaggattgggtgttgtgcagagtgttctacaagaagaaggcggagacggagacggagtcgtcgtacagcatggagaacgagcaggaggcggtgatcgccatggcacggagcgccgcggccatcaaggcgggtggatgctactccaactcctcctcgtctcacgacccagccgccgccggccatcactcgcccccgccattcccggcgtcgctcgccgcctgcagcagcagccaccactacagcagccacccaccgccgcctcccgatcaccaccaccaccaccacatgcccgtcaccggcggcggcggcggctccctcaacgagttcatccccaccaccagcatggcgctgtacagcagcatcttcgacttcagccagcatctcgacggcggcgccgtggcggcgtcggcgtcggcggcgggatcgagggtcgacggcggcgagcagtgcggtctgatggagctagggctcgaggagcactacaattacaacggcctgatgccgatgtgacgatccaccataggtgtcggtgctgctagtgctagcttagctagcttacacacactcccagctgctagctagctgcagttctgcagcgcagctagctagcgtttattattaataacctcttttcacctcgattgtttgatctgatttgtttcgtggtgatcgattccatcgatcagcttgtgcagatttcgttgattgtgcatgcaaacatgcgcacctgtgtatagggtatagtggtacgtcgtatagcgctgttgcattgtttggaggtaaattatatatcttagcctttaatttgattgagattgcagtagtagcagacgtcgtcatgcatgtgtacatataatgtatgaatgatcagtttctgttgatgggtggatatattaatggagtacttaatttggaaccctttttctagtcctttgctgtatctttcagtctgtatcagtgtggaagcttcaaacttcactaactgatccatacaaattaacagctgcaggtagttaatattagctacctggttttagttaattatatatcctagtacataagagagctagttttagttcattgctgtatctgtgtggaattttcaaacttaactaactgatccacacaaattaacagaggaacttaaccatcctacataagagagccagctagttttatacacgtaattgtagaatcatcaacaatttgcccaacatactgctgtaaatatgcagtggccattaatataggatctaacccacaattgactgacaaccccagcaaggtaattaaacactgttaggaaggagttgagaggagggaaaagtggaagattgagaagatacacaaaataagatgaaccatattagcgtataattaattaaatagttaattattttaattttaaaaatggattaatatgatttttaaagcaacatttctattgaaagtttttaagaacaacacatcatttattagttcggaaaagaaaatgtatgaggtaaatcttctcctctcaatatcatgtgaacaaacacaacctattcattacttcaaccggcttatatgccaacactcacctctacgcgaggttccctcaaacctcgagacgagactgaaatagaaatgagctacaattattgatttaattgtgcatctgacatgatttgaacttcagattttcggtctcgctaacatattgagttacgtacactaactaattcaacttaaaagcttaagctgataaagaaaataaacaacaatcatcgaaggagcaacagtatgcaagctgctaagtcaggagaatcatatcagtcttgctgctgcatgcatgtgggtgcaggctgcctcttgtatgtcacacaacagtagtactgaacgaagcacacacaacgacccaagccggccattgtcgtctaggttcgtttgttctctttctcgttaatttctgtgatatgatctgatgtcttgtcctccatcggcgccggggcccctatctcgcaacgtccatccatcaccacgctttctgaatgcttgttttggcagttagctaagctaagggcacagggatctcatcatccatcagatgctgcctaattgtgcattgtgcactgaaaattaagtacatgcaaattgattaattgcatgtcaaacagtgcttctgctagcttaatttctatggtcataataaatagcatagcatctagagcaggcaggaccactactaactttttttttctgaacgatcatgcatgtgtgttcccctacacattgatcgtttgctgcttaatttcttacatatatatcatgtatagattgggtaggaccacacactatactaatgcaagcatacatgtatgcatcagaaaaaaaacatttgtttttcatcaaggaataattagaccactgatctttatggaatcttcttgaggcatatatgcatcatgaagagtgtgcagctttatgtttattcacaatcagaagtactggtcctgatgttgactctgtgcatgattgtaaactgattggttttgagatatggatatatcggatggattgcaatatatatgtgtgtttaattagcaaaacgggtggattgcaatatcgatttgttcggttcaatttaatttgtcgtctctgcagcaaccaatttgctgtgtgcatgtgacgagttcatgcatgcagacctgtactgttgatcgaaatctggtcgcatgcacttaagaaagaacaaattatctatggacatgaccacatatcatttctaaatgatatattacacaaacagtatacgcaagacacgcagagcatagctaatctaatactaattgcagattagttgctgtcttgctgatcattggctgtgtcgattggttacgtcatccggttactaaattaacagcagcaaagtttggtcggttacgtggcctctaactgatagatatataacatgggatccccttgaccattttaagataaggaagatatagttatatcctctatctttgaatgtaggatacacacaaccataaagctagtttgagttaaaaaaaataatctcagtaagaaataaaacccgtccccggccatgagataaaaaaaatgtacaaagtaggagcatataaattatgtatatatataaatattacgttaagtacaaaagcataagtatgaactgtattagaatcctgttatccaaagtggataaaaaggtccttgacgatcaattccaaaagtgtggcaaatatgttgacctaaagtagaagagaaaattaatccacgaaggaaactaaaagagaatttgctatctagcttgaaaatgcgtacacagtgttattacgtacaatacgtacatgagctatatcgagtacgtgatgcatacatgtatatatattcaaatggcatgtgcatatattgttaatatttacctaactaattccatcagagacgatattgtaaagtaattaaaacatgcagctaatggaccgactaatataccgcgtttacttgatgattaattatttatccccaacttgcttgcttctagcttaattgacaattgcaagctctaatgatcgaccatgtatatatatgtgtgtatgcatgcatgacctagctagctagctaattaattagtttatcagcctaggtacatgctgttccgaatgtattagctatagcgcaagtgtcctttcaatataacaattaaccgagatgtttgattagaagcaactaatctgagcacactggatatatatagtgtacttatactatattgcagtgatgagttaatttgtaattaagtattcaatcccttccatagttccatataaattattaaattagcatagtaatacaaaaatgccgacagaatgtccagcatgcagtaggtgcatgcatgcagatcaggccatatgcatgtgtcatcccctgttgcttaattattttgcccattgctaaagcttcactagtttgggatagctttcttatatatgttaattactatactatttaccgttaaaatcaagttctggccagattgaatttggccggtatgcatgcgtatgtatatgcatgctgaggatgaggatgaattctagctagctagctagctgctggaaaacaagttggtgtgtggatagctgctgtttacacgtaactacgtcattctgatctgtgtcgacagttttaatttctacttgatcgatgctacctggcttaattagttaccatcaatccttcataccgtagttgtagtttacatataaattatgaagcaatgtagtttaatatgataaagctagtttagttttattatatgttgaatcaccataggtgtggtagactgatgagcagtgccttaattggatagtagtaccgaactagcacactgactacgtaacgtgatatgatctatataaaaggtaggtttaactaggtagtaattaattaattaagctattgctcctatacagatggcggccatacaaaagctatctaacttttgctgag

SEQ ID NO: 8777 - DNA, 8947 bp, Oryza sativa
actgggcacgagcagactaatgaggatttttcacattaattgatcgattgattgcatcttacatgccagtacactacagtatttacagactgaccgacacatatttacagactgaccgacaccatggacctggatgttactaccttttgtacacacacaagatgatatagctacagacgggagacctcatttatgtacatccgaaagctctctgcgattgtgcagtttcaaaagccacaatcagaagggcaatgccaactcaactcgacaaaaagaagcccaaaataaactaatttatgccctcctcagcacacggaaaatttacaagttttggtggcaggatagcgttagggtcaatgagaatgctcaggcaaaggtgactgcacagtggggctccttgttcccacaagcaaaaccttcaattctaacttttgggctgcttgccccgcaagatggagaacctacttcagctcttccagcagactttttgccgaaagaactccctaaaggagaaaaggaaggtatgtttttaccaaactgtggatcatggacaatggggttgttagcgcgcacaggaggtgagccacagaaaaagcccacctgggtgctcgaatcagtatcaacatcagggtcattctgaaacaaaacgagacaattggagaattataaattcagaatatgtatggaggcagcatagatagctagcgtaaattgacagtttacagacagccgcaagaagctacaggtaaagcaccttactgaggatgaggtcgaggacatcagaagcagagtcagctctgtacaccggtaatgtcctgcaaataattaaaaagcgcgcacaggtcagcaataaccctaagtcattatgtgaaacgtatattttgtcgtcacatgtgaaccgtgtgatgcccattgctgaatttgtcgctacatgctcgctgtcgttactagagcctaggcactattgtgcgcatatagtagaataatatttcgcatgaaagaatcttttgacaattattgaattgaattaaaattatgggcagtgttgtggtatggttattggtaccatatgtgcataaattttggtgagcctcagctcctttgttggaaggaatgcattgcatccaagtgtacagcctggagtagatatgtgctaaattaaattgcagctaaaaaaaggagacccatgctcaatatggtttgattagggtttgggggtggacctgttgatggagtcggataggaaaggagggcggggtgacgggcggcgaggcatgggacagatgagctcggtgggttgggaatccatctgccaaaatcttgaccttcggtcgggcatggggtctactagtctccctcctccattgctgaacttggtcgagtagtgttccatgcctctcgctctcttgagtgtagtgtgtagcagagacctgaaacaagagaagaggaaggcgcatgatgatttcacaactcaatctttgattcactacccgataatataaactaatactagtgggcggtagtaaacagcatcgaaattattgtagtggagtagtataaagaaattggaaatcgcatgtataagggcgttgggttattaggtaaaaaaaatactgaaataataataaaaaaataaacaaaggaggatagcggcggatctcatcagagcggacctgaagccccaatttttttttgggaagaaactagtgtcgttagtggtagaacataagagtggagaaggttattagggcaaaataagttgcagatctggaagagaagatagggttaggggggcgcaaaagagaggagatgtagggacggggtggggcggggtggggtgagtgctcaccggtgggcgaggatgcggaggcacaaggacggcgacggcgagcggaggatggacggagatagatcggcgaaggaagtttcaggcgagggggatggacggggtagctagggcctaggggatggatggtcttggcgcgggcatacctgctgctggctgctgcttcttcgtcttcctcttcctcttccaccgccgccggcacaccaccactgcgaccgcgatgcggatgcgaaccggaaacaaaaacaaaaaaatagaaaataatttctccgtcgctgtttgtttgttgggttgggacttgggaggagaggagagacccccgccccggcatttattaggggtgggccccctgtctgtatgacgcgtgggaccatgccccacacgtcagaccccccatcccatctcatctcatcccccacaagccaagcagcctccgttcggagtccgtgtaagacaccgtctctcatctccacttcagtccggttctgtcttgccccaaatccaaccatctctctctctcagcttttgcacaaacaaacgtgcttaaccaccacacgattcatcctccttacgttacgctcattttattagatcagatcggagaaagtttatcaaatacttttacaacagttctgctaagattaaaaaaaaggcaccatttacaccatcgttttatcattccttatatccgttgtgatcgaattctatattggttgcctctaaaatatcaacggtaaagattaccacttctatcatttaattctaatctaattgttggtctctagaagagatacatcaatcaaaaccatgtttgttatcctatctcattatcgggctcaagagatatatcatgctactattagtctctgtacaaaagagtatatcaataagagtgacactaattaatgtcctcgaggtatataagatgcgtcatagtcactccttgaagagagacgtctaacgtgagcaacacctctgactaaggagataggatgtgtttccatcagccttataaaaattgatgatagaaacaaggatacattgaaatgagacgacgatgaaagtagacgtccgtctctaaggctagggtttcataaacaaagcctaacccaaatacatttcagatattcacatcttataaccataagttttatcaaatttactctacacccctacgtgttattggaatatttgtattgattttttatatctattgtcttgctgcagccttaccttctctatataattgaattgaagttttttaaaaaaaatggaacataggatgggaatattatagaagataaaataccacaagcacaacatgtttgatttggcatgacaacaatggcatgtcgttttgttccaaactatattattttcttcctaagacgcaagcgcttttgtcttgatgtcaatagtaccctccgtatcggtaccgttacgaatatatccaacatggatactgtcatcaatcccatttcattagtctaaaacgtgaaaaaaaagcatgtgattcaagtaagatgtctttctaaaagcaacttagcttgtgtaaaatcggggcatgctagatatactataaaaggatagttttgggataatacgcaaacgtattgttataaagagaccaatagaggtaagtgaaatggtatccaaagagtcagtgtgcatggacgaggcgttattagaggcatggatctaatatcgtgaattacgactgtttggagtgattccgccgccacattgtccctcccccttttcatctccgcgcgttcttgctagagataaggatgaagggagcctgtccctcctttggttgtatataaatacaccccctcccccccaagcataaggaactcatgactcgactgtctggagcgactccgccgccacctcgtcccctccctttcatctccacgcgttctcactggagataaggatgaagggagcctatccctcgtttggttgtatataaatacaccctctcccccccccgagcataaggaactcatgactcgattgtctagagcgactccgccgccacctcatcccctcccctcctttcatctccatgcgttctcgctggagataaggatgaatggagcatgcctctcatttggttgtatatgaatacatcctctcccccagcagaagaactcacgactcgtctggagtgactccgccgctacctcatcggcccctcccctattttcatctcctcgcgtcctcattggagacaaggagggatgaagatgtcccccatctggttgcatataaatgcatccgccctacccaaacagaaggaactcacaactcgactgttaggagtgactccgccgccacctcgtcccctcccctccatgtcatctccgtgcgttatcgccggagataaggaggaagagaacaagttcctcgttcgtcttcggtaggttttcaataaatcttgtacgaggttagatcgattagatgttgatgggactttggcttctctaaagtcttttgctttttatccctttggtggtgggtattccattcgtaaggctatatatggaaaatttgggaagacttctctattaggtcgtcgataattatatttgcggtgttgacttaggaccttggtttccgatttattcgataacatcgggtcaatgttgtatgggaagaataaaaatgttgacgggtgtttgttcatatgttttttgctgtgttgagattggttagctaccatgacagtggctgtatgcatgtttatcttgtgtcgttcaaagatgtagagcctcttatgctatattttgattgtttctatattttaaaagcaaagtttataaccatgggccagaaaaaggaaaactatatattggtttatatggtccggtttagcttttgttaaaagaagactttagaaaacgtgagggtgagggatattctttttaggtgtaaagggcggtttaatctattattataaaaaaatgtgaggagttgatggatggatgtttgtttgcggaagttgtgacagagaggagagagagagagggggggtggagtagtgttgtgacggtgggtcacgccgctgaagggggaaagacgtgggtggtggggtgtggacaactggcaaatggagagactagagaggaaggtggggggcatattggtcatttcaacctgccgcgcgttttccttccttcctttcttgcttgtttgatttccccttccttcccaatttccatcggcgggcgcgggagcgggcgggtgcgggggcgcgcgcgcttctcccagttcccatccaaaaaaagaagggatccttttcatttcattttggtagcgtggcgtggcgtgtggggtccggttggcagtgagtgcggggcgggggacgcgttcacaccaagccacggcagctgacgcgtggggtccatcatcgtctccctccggcgatccacagatagatagagacgcctgggctggggctggggggctacaaatagcaaggacgagtgaagaggaggagaccaccccactccgctgtcgggttgggttttgagatcgaaaatttttgagatttcaaaacctcctccattccctcccttcctcgcccccaaaaaccctagccgccgccgccgccatgcctgatctcccctgcgacggcgatggcgtctgcatggtctgccgcgtcgcctcccctcccgaggtcgatctcctccgttgctccacctgcgccaccccgtggcactccccctgcctctccaagccccccgcccttgccgacgccgcccaatggagttgccccgactgctccggggactccaccgacgccccgcccccggccccggcaccgctcgcccctgggagtgccggccaactcgtcgccgccatccgcgccatcgagtgcgacgccaccctctccgaccaggaaaaggcacgccgccgccaggagcttctcggcggcgccgcgcccgccggtgccgacgccgatgatgacgagggggacgacgtcctcgaggtcatcggcaagaacttcagctgcgccttctgcatgaagctgcccgaacgccccgtcaccgtcagtactcttgcggggcctttcccccattcttcctcttactacttgctttgcttatatgtacgatgatttatcttaacgctagggtgatgatgggggctatcctatcccctctcttcacacatttatattcattacttacattagagttgtatcatccctgattatccgtcaatcttattttgagttgacgctgccatttattcttttctgttgttcaatttgcatttcctgttatcgtttaaggtttctaactagttgaaatgaccatgtaccatttctacatgatattgtttgcttttgctactcatttcttatatttcttatttacgctaccatttgaattccaataacggaacaagtcttctaaaaaggcacccacataacctgcttaggtgctaggcttacatcctcccaccagaccactcttaactgattatcatgaaccagatcatcgatgttacgcacctcgtagagtgatgcttacatttctttatttctattaattgagactgcaatgcttgttacaattcaagtttaacttgttgaacacatcgattgcatgccctttctagatgataattgtttgctttggtaatgccaactggtatgtcactcctaattttcaccacatgcacacatttactatgcctagatatgtttgttttagctcataccaaatccaccgtacaattctgataatgcaaacagtattctaaaaaggcaatccacgtaacctgcctaggctctaggattaggcttacaccgtcctgccttgccagcctagctcattacatcacccaagcggctgcctaatcagtcactagacatttgtatgtggtacagctagcttctattgccatcacatgcttgttcttctggattgatgcaataccttgcattgttaaaagtgctgtcttgttcttttggggtattggtttaaccttccagtttctgcacataattcttattttgatccatgcattgtaggtaggtaaaagttcttgctattctgtcaattcattggacccttttttttttgggtagcgtttctaaccatcagattctacttttgtcttgggcagacaccatgtggccataacttttgcttgaagtgcttccagaaatggatccacagcggaaaaaggacatgtggtaaatgccgggcacaaataccagcaaaaatggcagagcagccaagaatcaactcagcattagtttctgttatccgtatggctaaggtttcaaagaatgccaactcagctgtctctgcagctgcgtatcattacatacgaaatgatgatagacctgacaaggcttttacaactgaaagggctaagagggctggaaaagctaatgcttcaagtggccagatctttgttactatcccacccgaccattttggccccattcttgcagagaatgaccccaagagaagcattggtgttctagttggggatacatgggaagacagacttgagtgcaggcaatggggtgcccattttcctcacgtggctggtattgctggccaatccacacatggtgctcagtcggtagccctctcgggtgggtatgtcgatgatgaggaccatggggaatggtttctatatactggaaggttagcaaacttgaccatttgccatcattcagtttttctcagtgatctctgatatgagcaattgctaatacactctataatataatttatacttgtacagtggtggaagagatctaagtgggaacaagcgtacaaacaaggagcagtcctcagaccagaaatttgagaagctgaatgctgctcttcgtattagttgcctcaagggttaccctgtcagggttgtgcggtatgttctttctgccatgattacacttagcagtttaatcttaaggagataatgttatgcctgagtaaattgtcatacctttgtaatctgtgcctttccattattattataattggtaaaatcttgctgtagaaagataattctgatctgccgctgttatagttatgtagatatttgttggctcttgaaacagataatttttgtaggactactactgtcgctctatggagtactactgtttagtgtatatatttgttctcttttgtttgtctgtctgttattgatgatccaaatatatatccttttcactattcaaatgatttatagtttgtcatgcccccctaactcattacattcccttaaaaaaaggtcccacaaagagaagcgttcttcatatgctcctgaagctggtgtgaggtatgatggagtttacaggattgaaaaatgttggaggaagattagtgttcaggtaacgccattctcttgtacacagctttgtgaatgttgctttgtagttttgtgctctgcagttcatcagttgataattctttttattggaaacataatggatattttgctgtcttgtctcttagggtaaattcaaggtttgcaggtatctctttgtacgttgtgacaatgaaccagctccttggactaggttcgttgaaatgcttacttttgacttgagacatgcatattgttcattattcatttgagcaacacattttgttcatactgacattatgttatttggttttaagtgatatttatggtgaccgtccgaggccactccccaaagttgatgagctgaaaggtgcaacagacatatcagagaggaaaggaactccttcatgggactttgatgtatgtgcctgtttctatgtgatgcaatatcatcatataatgctttattttggctccatgtcaccatactatgctaccgctaacctctgatttctattggttcataacaggagaaagaaggctggaagtgggtgaagcctccaccaatcagcagaaagcctaacctatcaggggatcctgcaactgacaaggaaatcctgagggttgcaaggcgtgcccagatgtctgtgactgaaaggctgctgaaaggttctttctgttgcatgcttgttatttaatatgtactattacaacttgtgttcgtagcttcgaagcactaaatggctcactctatat

SEQ ID NO: 8778 - DNA, 2022 bp, Oryza sativa
gcaatggtgctgagtcatctggagatgatggaaacaacgaagctttagagaagggagaggatgatagcagcttgaaggatgatggcagcttgaaggatgatggcaaagtggtcaaggctgtggttgtaatcaaggaagaggacctgcagcctaagaagagcaaaggagaagatgagaaagaacaaggtgacaagaagatggacagtgctgatgtggtggacattgcagttgaaaagaaacaggcgacgaagcgggcttctgagaaggctgagaagaagcaggcaaggaagcgcaagggggatgctgttgccacaaatgatggtaaaaggatgaaaacaggtggtgatgctatggagacagcagcggaagaggatgctcccctgagcggcggaactcctgtgaagcgcaacagcaggaagagtagtgaggttgatgccaaaggcggtggcggtagtcctgttgtgagcagccctcgcagggtgacgaggagcaatgccaaggctagcggtgaagctgatggtagccctgcgacaaggaccaggagggctacccgcgctgaagcctgaatgaagatggatgaatggctggttggctggctgtagaggggaagaagacggagactggagccattttggggtcgtattcgtatattctatctatttagtaatttaggccgtttgccttgtgctgttgctctagctcttttgatccacaaggggtgaactggaactgccgcggtgtgcttttgggatggcttgggttgggttgttagttgaaggaatatatacttatatacagtggttgctttacctttacctgtatggatgtatgatggatgttcctcatacaactttccaattccaattactggcatggtttgccttggattctcatgctactccttttcctagcactatcattgtttgccttgtttcttgctgcaatgtcttgtaaaccatctcatctaatctgctgcttagagctcctatatgttagctcttaaatttgccacataagattaagggatgggatgaggtgaatgagagaagttaggagagaatgagcattgggtaatctccacaattttcaaaacaagtgtaagatggtgtgagagtgaattaatattagaggttgtgtattatatgtgatatattgcacttgttaccttttaattaatgagtagatgatatatttaaattagaggttgtattcaccactactataaaacttgcccttagacttgtaagtttgcctagctaggtctgcacagcactcttttttgcaggttttgagattgatgtgcaatgaactccaacagctcgtgtactatttccccatgcagttgtgtgatgtgcaaggggtgaagaaggggcacaagagtcagagacacatgtactagtagtacatgaaatgaatgaatcaaggcgcagtcaatctgagaagagaatgaatgtactttcggtggtcaatctcaaccaaagactcgactactcaactcatcaactgtacagcttccagttctcatctctcagagagtcaatcacattcacacgcacacacttgttgctctactgaagtagtagtaccgttacaataccaaccagttcacagctccatccatacacagggcaaaactgatgatccctctcataattttagtggaggtgatgccttgcctggcagagcctttcattcatcattacactcacaggtcacaaactttggctccctgatagtcaaataaatacttagcaaaactgggaattccctagtttatcattacagcttcttgtgccctccagttagtgattaggtttgctccaaggtcgtacggcaagttgagttcgcggtgccgacagaattgctttcttggtctggggagcttgatggacttgcatctttagtgtccaagctgatgagcgacctatttctcccagccctagaccggacattgttccccacaggaaaagggtcctgcaataataatatgtatctttatcagaaaataataatatgtataaa

SEQ ID NO: 8779 - DNA, 19435 bp, Oryza sativa
ctgcagcccggtcactcatatggtatatttagtgtatacaataagcactagagatattcacacctgatctcctgcatttggaccatctttgtggaaaagcataggtcgacaccatttgtcttcattcatcaggctagaattctgaaaatgagcaatcaaagcactccttccttgaatccgggcgtatgcgagcgacgccaccttttcactattgaatttctcccatttcttgccattaaatgtctgcagcaaatgtcaagtccaattaatcctatgcatactttcaattagaaaatgccaggggaaaactggcagtactctacagggcagaaatactttttaaaaaatcttcctcccacaaaaaagaatgcaacacaataataaaaatactgttatatcatatgctatgcttagatcttggaaggtacattaaaaacggagaagcttaactagtaatgcatgcatgatatgtataccttatagaatgggattatgtgctgcggatcagtcatattgataaaagcataccccacattacatttgttctgagaaaagtgaacattgcaaaagtcagtcctgaaattgtactcacagttgcaatcttttacactaagaaaaaaaaagtagaccttaaaatcaattgggagatagatgaaatcgtaggttccacggtggttctcatcaatgacagccaaaagcagcttacagttgtacctgtggatcacatcaagtatgacttgagtcaacagaagaaaaaaaagatacctgagtaatgtgcaagacagctggcaaccggtggcaagatgtgcagaacctacttgtttggtatgttcttgatcatcagggtggtgcgtgaatcttcaccctttgctatgcgatcaatgtcaagctcaaattgccgtttgttttcagactgtgcaggatttccatcatgtctgcgactcctcatccgatcattagtagcatcgtatgaagtggaaacatggatcataggattccgaccattgattgcattgcacatttgctgaagggattgaaatccaccgccaactggggagaacaaggcctccctaaaatttcctctgctggatgcaaaggcagataattctgatggatataactgagggctaccatgcaaacctatgcttccgagagatcctggatgaaaagagtgcacatttccaaaactgcctccattgtcaggagctgaacccaagtgatgctggtccatgggataagaacctgtgttcagcatgtgaggcggcacaccaggataactatgcacgtgcattgggtgctgcaagttcgaccacagtattggagctgagggactttgtggaaaaacatttgtgtggttccaggtgtagtgatatccatgaagggggcaacttccaatttcagtaaagccaaatgctgcaaaaaacaatttctgtgctgatgaaattctaacaaaaaaaatcattaagctggtcaattcatcaactacatcatccaatatttccaaaaaggttcaccattatgttgttatgataataaaaacataggttagtaaagccaacaatgagcagttgaagctgagaactgttaccttcattattttgatcaaaagaatgaccgcaaaaaccagcagggcccactttttggatattgtgatccactccgtcttgtctagagctagcattcctaccacttactgtcatggacttagagttattacaaatgcggttgtgatgctctggcaatgagcgtgggtggagggtttgtattccacgtccaaagtttccttgaccaaagtccactaagatcgccaacagaggcttgattattgtgctgaagtgtagatttaattctgataggtgaagataaaatttgaggaccagtcgtagagatgcactgggttgggctctccaattgttggttaactggagaaaataaattatgaacagtgctgttgtcctgacatttggtgcccaactttcctgttttggcatgaaaaagggcaaaataagtaatgatcaacaatttccaaaatatatccaagtaatatattgtaccaatggtcccaggtgaagagtttttaggttggtgaggcaaactgtcttgcttccattctctagaatgttgctgcctcaagctgttaagtacataaataaaatcttcaccacactaatcaaataacgcttaaaaaaaagttacacgcccagttggtttgtccctaatgaaaatttaaaaggttcaagtgattgacatagagttgatatttggctgttccacaaaatgaaagaacgaccaataggtgtgttagtggctgcaaagctatgagaaaaaccgtgaatgagaacttgagatacattccttgcatctaggagtatttgcataattttacctaagaaaacagtgaacatattttattatgatattatcccatctcccaaaggtaactaacatactaaacctatagtatgaaggaaggcaacgatagctagcacgagtatgaaaagataataccaaaaacgggtagaaaaaaattcagccaagcaaattaccaagatcctgcctctccatgttggctaagttcaaccttgaactttgggcctgaaattccacccttattaaggtcatgtagtgcttcttctgctgctctaacatcatagaactctacaaacttcttggtgcagcttataggagagctggaaatctataaacaacaaatgattaccatagtgtgtggatttcagttttgtagtcaattactcaattatggcagtatagctacctcctttacatcaccataaacactgagcatttggagaagatcatcattggagatggaagaatcaatgttagataccaccaacattcccttatcaatatccttgcctggaacattttcctagcaaagtacgcgacatgacagcatcagatattaagtgtttatctattgaactcataaagtggcatgcagacagatttagagcaaatatatagcatgttagaagtagcgcaattaccggaacgactgcgtgtctcagtactatgtaacaacagcatttaattttcaaaacatagaatataaatgattattgcatgctaaaaggaacaaaaaccaataaataaacaaggggcaccagtaaaagtaatagcatgattttgtagcaagttagaatgaaaaatgaaacagaacaacattgcccaagtaacaaatggcatgataaggaagatatatagattaggtagcatgcctaattcaaaactactgatattattatgcataccttaggaaaagaaaattgcacatcaagtttcatcagccccagaggcttgctatgcagcgctctcattgcattttgggctgctcttatgtcataataagaaacagttacaaacccatggtgcttgaaggaggtatagagcatgcgaatgtccccgtattgctgaaagatatatatgtgtgtatataggttcaaaaggatattgtttactaaactaaaaccaaaatttgaaatgaaataaggaaaaggttcaatacctgaaacagaaccgtcagatcagaatcctcgatgttagcagtaatatttctgactacaagagttcgggaaggttgtttattgatggagtgtcctgaagaaatttggctcttgaaggatccatcctgaactttgtcaccttttacggaatcattgttttcaagttccattcctcctccagtgcagaatatatcttcatcggcatcatcctggttggtcgacatgccagtaaattcaaatccatcggcaatacctgatattaaatcatcatcatcatcaggaaggagatctccaatagtttgagcttctatcgcttccatggactctagaggttcatcactgtcgtagatggaggtatgtgtcccagtagattgacaaagaacaccacttactatttctctcgctgcagaacatcatgaactcttagaaaagattaatcttcaatgaacaatattgtggtttctttcaaaaacagtacttttggttgtagtgcaactaagatgataaaattctactatcaacatggcttgtaggggaaaaaaagaaggcaaagggaactcacatttgccactgaatacttcagagagggagctggatgaaagtcccttcccataaccaggcacatgttgatcagcagtagttggttcaacaaaagctgtttctcttgtagacaagccaagcctcgatatggggtttgtgaggatctcaccccaagaaagtgacggtgaacctgaagcattttcttgccgcatcaaattgctgaggctaaggatgtccaggcccttgaaggcttgacctcctggagtttccggatctcctgcatgatttgctccattgggttggatcttttcaagtggagaagcaaaaactgacttgctccctgccattaatgatcacagtcagttcctgaagaactatttaacctatcaccatattacaaccttcaatacatgtatcatatgataaattgatcatttaatatcgaactgtgctaaattaactgtccaactagttcctaccaaactgtcttgggacaaaattccgtaagcattctcccacaagtaaagttcctactcattccctgctgaactgtttcagggatatctttacctaccaaaattggatacttgatcacttttagccaaccagtgcagtatctagtctaaacaggaaatccctggcagtaaataatctgaactaataaaatgatacaacagcctaaaaattctggttttataggttatagttagttagttaaattggtggcaaagaacgggcgggaagtgaccacaataacaagcaatcaccaatatctcccataaacatgaaagatgagttcccgaactgttctttcaagcataagttgggtaaggcaagtcaggtatgatctatttaggagattactattaacaagaatacagaagagagcaccaatctgaataatttccatcatgtaagaagcaacaaccatgagataataattttcaaatgaagcatgatccacacctttgtgatccaccattgactctgaattccaaaatccaacttgcctctgcaatgaagcatggaagggaaaataattgaggtgctacagtcttgcagaataaaaagaaatcagtggcaggcaggatggttttctggtttgtttattactagtacctctgtagggacaaggtcctgagagaagaatgaagatgaggagtcgtctgaagttggggtgaatggcgacaggtgcctcctgtcaatggctccagaagctatcaccataggtgcaatggaagagcccttttttttttcctgccttgggtcactttgggattcctgtttttgtggtttcttcaccgcctcaatctctcaaacttttggcccctttcatcaacttcctgcacaaggacaggagagattagcaacaggacacccaaaagaaagagagaagatgtgtgcccctcaagggttagggattagaggagagcaactacacatgtacaaaaagatggcccattccaacaaggagaaaatatatttctcttaaaccagcagaggataaactgaatcgagccaaaagagaaggaaaaaaaaaggcagggtaaaaatgagaaaccagctccttctttattaatgaaaaagaggcagccctcctgccctcttattcgaaaaaaaaaagagaaaccagcaggtggtgaggcaagaagaggtggtggtgatctcataataaaacttgtgtaagaaaaagatgtgacgattaagctgaagcctctagaaattttggcatgaggggaggaaaggacgactcagctcacctgaagcagcagcagcaaagaaatgaagaggttgcaggaggtggaaagggagagagaagattaatggcaaaatgcagtagtaacagggagggaaaggaagcagagcagaggtggttggggttgggattggattggattggggtttgcttatatgaaagaaatggttgcttgctgaaaatgcaagttgcttctcggtgagcgtaaggcagcgattccaaagaaaagaagcaaggacatggagatggaaatggacattagcttagcttaactagttggagaagagagagagaggcggggaaccctggccaggggcttcatctccttcttcccccgcactgcaagcaaacaagagacgagaaccgcccctggccctccaaaataatattaatagaaaaaaacaaatcttttttcgcgttgccttgccgccgcacgcaaacaaacaataacgcaaacaacaaggcgagcagcaggagtactagcctagtttgccactactctcctcttctcttcttcccttgttcgggtcgggcacgcgggagaggaaagaggaagaagaagaagaagaagaagagaccaacctccatccatgccatccgtagagcaatcaataatagagccatgccatatcatagaataggaagaggggagagcagagcgacagacacgaggaggaagaccacataccaacacaacgacacgagagtactagatgctctcttgagtaccactgtccgtaagacagacacacaatgacaacacacaacgtacacaagagctagagggaggcgagaggagaaaacaattgttggacctggattccccataccgtatgctcttgtagaatttttggaaacttcttgtgcatctaaaatagagtgatatattagcacataattaattaaataattattatattaaaaaacttgaaaatagattaatagtttttaaagaagctttactatatatatatatatatatatatatatatatatatatatatatatatatatatatatattaagaaaacacattattagttgtttggaaaacgttagcgtgaaaaatgaggagtagaaattagaaaagtgtagtgacgaatgcacccggctagctctacgtggtcgtctcaaaatgtcaggagttttaagattgaaagaaagttaatggaattaaatggggagtattatgattggttgagaagatgagatgtataaagagatagtgagatatgtcatagtgaaccaacaaaataattattagggttgtgtattagaggtaatgtattatacatgttgcctcttaattattaagtagatgacatggttaagattagaggtggtagtcacatctactataaaacttgctctaagacaattattccttacctttacacacattttgatgtagtgatgattaaaagtgaacttattaaataaataaaataaggtaaagataaatttattttagggcggagggaattgaataaggaattgggagagcaaagtgcaatgcaggaggcgtaacctctcccgttcacgcgagacggttgtcatcacctcccgtgtcctgcctaatagtgatattaatataaatttgaaaatactctttaaaaatctatagaaaagttattttaaaaaatcatattaatctattttcaatttcaaaataattaatatttaacacgctaatttatcaccttgtttagtgtatcttatcgattttctcatttcctctcttttcaaacgctctctaagttggcgttatacacttatcttcatggtatataactcctactttattagtggtagttgatataatatggtatttcctcgatcccaaaatacaacttctgcatttttaattttgttcaaaatataacaacctaatatttgtatgaagtgacatttaacactaaactacctatagtacttttggtattatttaaaccctaactatttaggtctatatataatccatcctgagaagataattttatttaaccctctctttaatggaaacatatcctactcacattgtttttttttaaaaaaacatatcctatgtatactagcctcccatgtacaccaactagcaattgtcacagaaaattctacaaaaaattggacacatacttccaatagtattacacttacatgtgaaatcttatctttaaattcattatattttagccgtaataaaaaagacaaaatcctgacagatttttacctgtaaaactgttagatttttcactttttttgttacggctaaaatataatgaatttgaatatgagactttgcatatatgtgtaatactattagtagtaaatgccttttttatagaatttttcgtgatatttgctagttagtgtgtatgaagtgtgtacgggaggtttttgtgcataaaatatatgatcccctcttttatatccgcgtcgaaagtaaaattttgttatatttaactctttaatatccacatcgaaagttaaattttgttatattttgagatggtgcaacggccgtgtcacatccattgaaggttagatggaggagtataggaggcagcagcagcatattgatggcgaacatatctttatcttaaacatgtggatattggccattgattactccaaaagaaataatctcttcgaaaatcacgtgtccacatcacgtgtatcttatgcttccgcaaacaactaaaccactactattaccttataataataataataataataataataataataataataataataataataactactactccttccgtttcagtttgtaagatgttttgactttggtaaaatcagactacttcaaatttgattaaatttatagaacataataataatattttcaactcaacacaaatttattatgaaaatatgttcgattgttgatttaataaaattaatttggtattataaatattactatatttatacataaacttagttaaatttaaagtagtttaagtttgaccaaaatcaaaacttcttatgatgattgatacgatacagtatctttctctctgtgttctcgagctagctatagctgacttgcatgatagagtaatgttgatgtcatgtacttactgattgattcatggttggcacgtactagatgctatggattttgtctactgtcttgagcgtgtatatggatatatatatagagagagagaccagtagtatcttgagattttggatccaaattctatcattaaaggaaaaatccgaaaatgtaagatagtaattgctgctgtagctaactagtaacatcctgcgacgcgacgcgtgcatgtttgttcgtactacagtcttccaacagaagctttgttgtttttccttcctcctaggtagtactccatccgttccaatatgtatcaatctagaatgagaaatagatctaatcccatgctagattgctacatattgagatggaggggatagtatggtagaagcagcaacaataatacatacaacacaacatgatctgcgtatggcacgtaacaatacatacatacatacatgtgacggcttaacggcgtagaagtggcttcggctcactatgttagagccacaccacctcatgacacatgcagtcttctttctcctttcacacggtttgttgacgagacagtaaaagagagaaaaaaagaggtcaaggaggcctcctccatcgctcgggtctggcggctccattcccgatctcctcctcacctcctctgcagattcggtggcattggtagcggatgtgctgatgcggtgtcctcgacaacagcgactgcgtgtggtacgtgagggaccaggcatggcgggggtggggtgagctttccaggatcgatgctttggatgctatgctgcttttctagttttttcgaggcaaggaactcgcgtcttacctgagggacgagagcctatgcaaaggtaatagggcccacaccctccctcctccacggcatcacgcaagtggggtggaggcatgaagcaactcgccccgcgtggtccactgtgaaaggccataaaatgtaggtcacacatagatttgtcctaagacgacaccggactacctaggaaagccacaaagtacatagattagtactcctaccgttattactaattattttattttatctattttccattaagcatcctctccacgttgttaatttgaatatattcggctgggattttttttatttactatgacttataaaccttgacacgggactaaagcaataataacaataagacatggcttttattaatggtgaaattggtgttggtaattccggaccaaccggctacgtaccgttctgatttcatttaggagtaccttttcttttttccaattgaaccatctgacaatggttatcaacaaaaacaggtgaaaatagtaaaaaaaaaagaaagcaaatagaaacacaaatgatttttctgccccaccgactgtttgtttggtttaccatattttcacaaaaattgttgtttttataatacggtaaattactttatttcttttttttgactggaataatttcattccattataaccttggtggggcagaatcaccatcaaccaaaattctaaatacctagtacatgtccatctccatttgtccatacatagaggccgttcgtattttacgagaattactaattaattttccgaccgatactgcatatgtttccatttgaacagttatattttctttgttttctgatatttttcattcatttgaatagttgagattgttttgttcacatcaacccacatgaatgtgaacatctatcatcgtattaataattacacgtctttcggcaaacacataaagtcaaattgatcttataaggctgtgattgcaatcccattttcccgatccctctccctcattttccgctcgcacgcttttcaaactactaaacagtgaattttttataaaaaatttctatacaaaagttatttaaaaaaaatcatattgatccattttttttaaaaaaatagcaaatacttaattaatcacgtgctaatggatcactccgttttccgtgcggggagtttagttcccaacttcctatatccgaacacagcctaaatgaagaaagaaataagctctccatcggcctttaatttaattacttcccatatccgaacacagcctaaatgaagaaagaaataagctctccatcggcctttaatttaattagaatttctttctccattgcgtgtccgtccacgcacgcaagggaccagtttaatctcattagtttcccgaatacaaatatgtatatatacttagattagattagagggaaggcgaactagctacatgcaacggattgggtagcatattattttgtgatcgatgcgtagagtaattaattaaataaattccactaactttatacatatagttaattagagtagcaggccagccgccgtagttttccagtgaagtcaggaattatatcgatggatcctatactgcggcaactaggctaataaagctgaaacgtaaccgagtaaacgaactcttgtcttggattgagctggcatggatgctcgctcatggagtaacaacaattaatcgcctcccggccttatgctatatgtttgaagaaaataattatactttaatatgaaggggcaatttcgttcttgctcctgcttcaatgtacactattgattttgcctcagtttttttttcgtttttgcctctaatttttcgaaacgagtcagtcgtttgcccctgttccgttaattcttgctaacggtgttaaatgagggtaaaaatgacaagcatagccttagatatttccccgtacttttgtacaccacttgcacatttgccctattttgagataagccattttgacacgaactttgaacatgttgtaaattgattcttcctatgtttcaaatttgatccaaattttggtaaactttcacaaaaatttgacaaattaaattactgctatagaatggcattgagatatttgtattttgattatgtcaaaagtgcgagaaaatatctaagagtatacctatctttttacccccacatttaacaccgttagccagaattaacggaacagaggcaaacggttgattcgtttcaaaaaaagtggggataaaaacaaaaacctaaaaaaacatgggcaaaatcaatattggacatcaaagtaggggcaagaataaaattgtccctaatatgaacatgtgctctatgtaccgaaacatgattcaagaagattcagaaatagttgcgctactgaatcatgataaaaaaatcagaattttttagaaaggttacgtgtgtatatatattgggtttaatatatatagtataactagtcagtcatttggattgatactaatttttacccaaatcaacagagttgatactactcttccctattatagtaaaaacttactcaaaggtttaacactaccaattagggtttcgaaccaaacatatccttactactaaaagtattgagtaattgatttattttgtaaaacgtgcgcgacccatgtttacaaaagaggtgaatatggtcaatggataacccacataacacacatttgatatgattttgtaatgtcaattcaagatgaactactaattaagttattatacccaccttgcaatttattatattattagttaatttagtagaaaggtactaagaacctgtttagtttgctactactactttcaaatctatcagaatttagtggtactaaacggtgatagaataacaaactaaacatatgtatgctaatgtcattctatcatcatttcgcatttttggaagtttgtccttacgaaaaggctagcaaaatttagtgaggcaatgaatgaaaagacatctagcgatactaaaattaaaatttgataaccctaaaatgtgtcaaactttggcatttcgtgaaaatccttcaatgcgaattttttgtgggaagtttgatttttttttcctttgattgatcatgaggtgggctggggctgagatgggccttaatttgcagtggatcagataggcacacggaccagaataatccaaatcggaggactcgtttctgaaagcattatccctcccacacaaggaggaaatatatatatacatccccgcaaaaaaaaaagaaatatatatatatatatatatatatatatatatatatatatatatatatatatatatatatacagaaagagaaaaaaaaaactttgatctggaaggaagggagagagaaaccgaaacgagtcaaacagaagaaacaaacagacacgtaaggaggagaaatttcccctcccttccctgctcttttcgtactacttgcaaggaggagaaagaagaacacgaggaggaaatccaagccaatcgccgcctccgcctccgattccttccgatgaagaagatcttcggcgccaagaagaaccaggagcccccgcccagcatccaggatgccaccgatcgggtttctttctgtctttcttgtttcgattccatcttcaattctattctattcaattcatccaccaagcaatcgaatgaatcgaatcaaacaaacccgcagatcagcaagaggggcgactccgtggacgacaagatcaagaagctggacgctgagctcgcccgctacaaggaccagatcaagaagaccaggccaggccccgcccaggaggccatcaaggcacgcgccatgagggtcctcaagcagcgcagaatgtatatctccccttttttttttatttcatcatcattacttatcatacttatatactcttagattagattagaagattggttactctacttttgcctaataataataatctctactgcaaccccaaccatccaaccctcacccaaatatcatacatagacaccaaagctgagctcttgcaacctgcccttgtgttgcctatcaaattgttgcactgccttcttccttgtggacaacaacaacacatgaatgaaaaattaaagaactcgccattgatgacattataaaccgttgcatcttgtaccaagtcccggttacgccaatttttacaattcatcgtcttacaagtcatttgagataaaaagaggcataattttgactctgtaaattgtttgtgtcctttcataagcacagagtcttttcctttctaagtgtacttcatcttctttttttggttaagtaccgatgtggttcttcatatatattttgaaagattttcctaagggtagcagttatgttataagaaaaaaagagacttctattttattacttagttaaggaacccaatcatcatttaccattcactctgtatatcttgttgagctcttttgcttctccttcgaattacttactctattacggtactgtgctcatctgtatactgtcttatatatgctttcctgacaggtacgaagggcagcgtgacatgctgtacaaccaaacatataaccttgaccaagttgcttttgcatcagagggacttaaagatgctcagcaaacggtatatagctatagtatactcaagaagttttatttccatgatgttttacatcctgattcccaaacttatgatacaagtgttttcatttgggcagatgactgcaatgaaggcagccaataaagagctgaaaggaatgatgaaaactgtcaagcttgaagatatagatgtacgcagcatctttttgtgtaacatattcgtcatgttttcaagattttctggcttgcaatggattttcgttgtttccctgttttcttctgtttccaattgcatctgaatctagacccatgcttttcttatctgcagagcttgcaagacgagatgatggatcttatggatgtgagcaatgaaatacaggaaactctcggaagaagctacaatgtccctgatgacattgacgaggaagaacttatggggggtatggatcttatttttcagttttcttagattatactggcaccacaaaaatgtttgccttgaagttatgcagtcaacttgttttttctccccacaattctgtccatagtgtagtcagggtttgccatagctgcttactgccgtctaattgaaaataatttccagtttctgatggtgatctggtggattttcttttcaacctaaatttgtatgcgtgttgaggcagaaaacagtctagatgctcatgaattgttatttttttctgaatccatctctttggtactttgctattggtccttcaccagttctgtgttttgcatgtgttgacttaccgaaagcaaagaaacaatgcttgtctgcttgatgtcctgattctttatgtggaaaatgcagagcttgatgctttggaagccgacatggactttgaatcaaattcagtcccctcgtaccttcaaccagataaggaatcagatctagattctgagcttaacttgcctgctgcaccaacgggtcacacacccgccccaccaaaccggcagcaggtacatggactgtgacaatgtttactttcaataagactgcttagaagttcactctaaataattttctttatcttgatgtgaactatttgataggatgcagatttgaagatctttgtacttgtatttattagatttgaattcatttactcactgcagaatttggtacttcatccgtttcataatgtaagactttctagcattatccacattcatatagatgcagcatgaatctatatatataataatgtttagattcattagcatctatatgaatgtaggcaatgttagaaagtcttacattgtgaaacggagggagtagctgataggatagtacaccgtgtaaccgaagtctgtaggggtatagattatattctacagttggtcgacctgccctttatagaccagatattcacaacgtgacggtgatggggggcacataaaaggataatatgaaaaccttttcatgccaaataggtcctttggcttcatttataatgaattcactcagagctttggaaacaaataccccatttaggcatagttaatggattctcttgtgaacaataataataatttgaaagttgcttttatttgttggtgcaggaggacgaattgggattgccgacagtgccacaagcatcgatccgtagttgattggattcgttttgtaaaaacataatgtcgtatgcaataacaaattcagtgtatctttgctcatatactactgcaatttgttaagattggaaatagctttctcattgttttgtttagggtctatatgtaagagcatttgttactttttgaagtacagtgtaaatttaattggctgctggggcatacatatataagtccttattctgtgttggtgatgagctgcccttgcatctcggaacaatggttttgcctgttgcagacctctttctgtccattcacttgtcggcatatgtcatcagactaatctgtttgctggcttgcagttcatgaaggattgctgatatcctgttcagtttggttgctttacctgattcagatatcttgtgtattattactactactccctccgttttataatgtaagtcattttagcatttctcacattcatattgatgttaatgaatctagacagatatatagatatatgtctagattcattaacatcaatatgaatgtggtaaatgctagaatgatttacattgtgaaacggagttcacagagggagtagttacttttctcaaggaagtccagtagactagagagatttgatactagtctgcactgctccagaatttgagcatatatgtataagcgatctatggagtgttgttgggctgatgtatactgaagattgtggcaagaaaagtaaaagcttgattagtgtgactgagtgcattgttattaatgcgtcgagtgtctacaccatttgtctcaaaataagttcacttttaaacatgaatttgaatatatctaaattcatatatatattatacaagtgtttttttataggatgaaaggtgtatgcattactggcgaccggattaacttgcaaatgctttgccttaatttgagctgaatattggctccagctgatgaactcattgtgaatgctatccctactatagtaccaaccctagcagaaaaggattaaacaacattgaattctcagcccaaaaggtgcagcagagcatgcatggcaacatagcactgtagtcctatctacagcggccgtcatacatgtacagatgtactgtacataacatagcttgcagaaaggaagttgcataggagtatgtagttaacctggtcaaggctcaaaactcaaaagacaagcatccgatctgagaattctgaaaggtgctgggtcagcagcagctttgggaaagcaaaatttttttttgatgaatctttccaagtccaatgttcactggctacaagcccagatatggcccttgcttctcctaccattttcatttttcatgtgtccaaataggagtacaagcagcaggtcaggtcagatcaggttgcctaataaaagattccacttttctgtgcatgcacacacacatttgcttttgcatttgcaagctttgaatggatcccagagcagagataaagagagatggtacagtgtacaagagaggactggaggcaggaggccaagtcatatcgatcaggctggcagcatcaagtacacatttgcaaggcatgcatattgcacacacacacatgcacatttctggagtattaaacacatgaaaagggagtagagtatctacagatgcaacacacagaagagggggaggaacagcacagcagcagatgaatgaatgaagcgaaacgcaggaggagcaacagtacatgtcctcgtcttggtactgtctgcatgcagtcttggtgacggtgaaggcagagatatcgatagtgtggattttggagcccaggaggagatggtacagctgagccagcaaccaaaggatccttgcgagatcttcaggaggttcaactctgtcggcttgccccactcttcttcttcagcttgctcacttcacttcacttgttgattcggcatctcctcctctatgtgatgctgcttcgtggccattcctagtttgtacaaatgttactagatagctgcattagtctggtaaatgcaacagttaacacatcatcagtcaccatttgcaaagaacataagctttgcttcttgctaatcaatcatgcttgtatctcaattaccagaatatgcatgggttctactactaatgaaagaagcagtggctgctcatctcgacctggtgaagagagccctgctgctggccttgctctccaacttgcatcaccaccatgttaatgtggctgctgccatcctgcaatgcaaaggtgaagcacagacagcgcatgcatgatcagtgtcacattgccttccttatctgctactcctactactcttgatgagtgcttggtggaataatttgtgttcaacacaggagaagcgacatcacatctgatgcagtcatgcagattgggttcagattcagagagactatggttatcatcttgacctgagcaaagcctgtgggtcctcctcctagtccttggagtgaaatgcctgtactccccatttggcccatgcactgcaccatctcatgtggcatcttgcaagcttaatcaaacaaggaaggtaatactaagtactaagagagtcagagatattgatcgcatgcatggcagaagcaaaactggaatcacagaattcttcagagatgcttgcttgcgtttggattgatgctgtcattgttccctattttactttacctgtcgaagaacatctgggtgcatatcaatgcccggtccaaactcatacatcaaagggctaagggaggcaagcttcatggacagaaactgaatgagcacaaaagaatgaatcagttcttcatatacagagcagaagagccatcgatgatactacgtgctcaattacgctatttcaattcttatctgagtgacatatagcagcacctcaacttggttctgcagagattgcacatagctgatgatctcatctagcatgagggctttccctgtgaccttgtcacaaccaggaaccaggctttgcagcatcttcatcctctcactgatcttctcccttctcacctataagtaacaaatcaacagatgttactactcctgtagttaagtgaagggcactaacaaacagctgttactactaattaagataacaacgattcagataagagaacaaaagactggtgagtgagtgaccctctcagcaaggctgtggctgtctgttgcttggcctctccttgccctcacatgaatgtacccagctggtggctccccacctgctgcctccttggccttcttcttcacatcatcatcatgttgatgtagtaccacccttcttgcctttttctcctcaagtcccttcaagcccacattgctcctcttgtgctttctactcttgccccaacttgcatcctaaatggcaagaccacataaggtagatcattacatgaacacaacataaaatgggcccatcatacatatttggacacttaccaaaggggttaacaacttaaacatcaatgataattctacttgcatcagaaa

SEQ ID NO: 8780 - DNA, 19329 bp, Oryza sativa
  unsure (1)..(19329): unsure at all n locations
aatgaacaaggcaacttccttgaatgccaggcacccatttgttgtcgccggcagcggcagcggcattgtcaaagacaaaggaaagagggcactcctgtggctgcagcactattggtgagtacaccattggcattgaggtggggtcaagggagctgcagctgctgctctcatactcataggccgccatggctgctgctgccttctcttcaaggttgctgcagccggcagggaagcctgggacaggaagaggctctggagcagaaaggaagcagtaggggagaagtgaagatgaggaggattggtgcagctgctgctcatgttcatgctcaagctgcccacacaagctctccattggtatgctgcctcctatgttgatgctctattgctactactcctagtagtatctctagtaactcctatgtgcctagtatgtgctatgtgtaagaaagagttgtttgcagttgagttgaggattcaggtctctatctgcttttcttccttctttagcccccctagctgctgcttatatttactcctatgtgactgatagtgggcagataggctagaattctgtgcagttaattgggtgggccaacttccacaaggctcctgccccagcatcatgttatttggagtagtaagcggtttgtactgcatctgcatcatcttgtctttccaagctttagcacacaaataggacgatgattgattcatacttaccagtacttatctctacggttgtaaaaacagagtcctccttacatccccttgctcctccccccaacacacacctgagcgctgccccaccgtgaaaaaccaaaaaaaaaaagccattcatacctcagtttagttctaactcaaagaattataatttctttccatcaaggctcagatatgcagaacacaagatgcaccagtgtcaattttcaataacatgcatcatgtggtccctttccgcagtacatcgtagaataggatctgaactagcaattcaggagacagggaaacatattaccctgtgaattcgcctctcaatccatcatctgctccttgtacaattcacctgctcctcagggaaaaaaaagaaacggctaagcttaccatatcatacactattatcttaccgcttacagtagcaatcaaacaaaatctccccgagaacatcgcttgaagctaggttcaagccctatccgaatcacaatagacaacactcttacccttgacccatgacgggagatgaaatgagaaccaggcacaaaaggttgaatgtactaaaatgatttaagatgtatcaaatctacacctctgattttaagtcagtcagctcaggcctcacccgagatgctcaactacagaaggccaaaatgacagatgatgccttagtctagttaatcccttagagtacataggagaaccttataaaacctgagagagtacattcttgtaaaaccaaatacaacaaaaaaaaggcaacaaaacagatttagcgcctcttcttgcttccttttgcagcagtggattttgacgggcttgcaaccaggtagataaacacaccgacaaaggaaacaacggagaccagcgacccatatttccccacaagtctctgcagatgacgtttgttaacacattagatcacaatgtctagccatatggttttcttttcttatcgcctatttcctacttagataaaacacataagtttacataaaacagagggcaatggcagtaccttagcctggaaaggtcaagtgcaaaagttgcatatccataagttgagtaccagcaccaaaaaagtaaggcgttgagacataagaatcaggaaaggttttactcttaatgaaagcaaatggtatgagataactaaccaattcaaacttctgttggggaggtctctcagcaagaatatcaagtggaaacatgggcgttgagtaagcctccttgagaaaaataattggcagtttaaactcaagaagagaatagtgcaggaatagtatggtgaaaatgataattagaacaccaagtactagggtcgtaatgagctatttaagctgagcaaagttagcccctttcactatgatccatggaataatgagatcgatcacactgcagtccttagaaaaggctcatccggtgctcaatactaaaggtatactcactcgattgtgatggcatgtgaaacaaagcatcacgaaacgaaaattcaagtttaacttgtgaaacaaagcatatgacaagcatcaaattgcatgagtacctgaagtgtaagtatgaaaattttgatgtacctgaagtgcggcctttgtgggaacacggtatgtgataatggcaggagagccctgaaacttgccctgcactttggtctccaagatgaagttgtgggaagcagtagcaccactgaaagcacaagaggtaaaaaggattgtcaaagggcaaatattggtgtgagaaagcataagtaactagtaagtgttgttactaacggatcaagtttttccacaatctttgatgtggttccagagataagttgaaaagcctcctgtggccaagagtcgtcgttcaagctaacatcataggcggtcctgtaaaaaatgagagagagagagagagagagtagtaaacaacatgatagaagaatagaagatgaatggttgatggcactggcagtgaagaatatagggcctgtttagatcccaccctaaaattttacaccctatcacatcgaacgtttgaacacctgtatgaagtattaaatataggctaaaaaaataaccaattgcacagattgcgactactttgcgagacgaaatcttttaagcctaattgctctaagatttgacaatgtggtgctacagtaaacatatggtaatgatggattaattaggcttaataaattcgtctcgcggtttactgtaattagtttttttattagtgccgaacacccaatgcgacaccctatataatacccggaaacgccaaaactttacaaccctggatgtaaacacccccataatgaggattccggttccccttccctaaaatagcagtgtggttagatagatggagaaatggattagcgattgatgtgtgtgtatgtgactatcaatcatgtcatgtcatgtaggagtagtatatatgcacaatagtagcgtgataatttgtgttatcaacaagtgagtcagcttgacattattacacagagaaagggaaacatgggctcgcggctatctatcaagtctagctaacagtaggaattcccgttgtttttgacctatgcgaattaatcaataaggaaaggcggatagagcaataataggttaacaaagtgaagagagggagagagagatgtggatctaaatctgggggaagagggagatgagatggggaggggactgacgcggaaccctggttgtagaggttgagggtgacggcgaggcgctccacgcctggacccgggcgggacagcgcaaccttcttctgtgctaccacgaacggcgcatcctgcccggcggcggcggcgaagggcacgaggaggaggaggaggaggaagaggagagatcgccactgctgcgccatcaccgctcacggagattgctttgcttcttccacctcacctcgaccgaggctattgttacattacatgtgtgttcaagcccatcccatctattacatgggcccccgtgaatactatgcccatcagcccattttactacctcctgcctcctatgcggccccctcccctctctaccaaaaaaaaaataataccacctcctattcttattttttagcattgtccatatttatatatgtgttaatagatctagacatatatgaatgtgaagtcttataacctaaaactcaagaaaaatatttactcaggtcctagttttaaaaaatactcaaaatacatataaggttaacaattaatttattcatctaagggtttaaaaatatgaattgtttatgtagcttacttacccaacatgaaagtttatatataaatttcaagttttcacttttttaaaaaaaatatttttgagttttttatgagagagaaattacttacgcaaaagataatttacattagaaatgaggtatgttctcgaaaaaagttacattaaaaacagcaaaaaaaaaattcttgcagtatataatggataaataattttttttaaaaaaatataaaaatgtaaaatcttaaaactagtgcataaactagcattttttttcttctgaaacttatggtaggataaatcaaatattaaccttatatggtgtattttaggtatttttgaaaatagtatagtccgatggtatattgtataataattgataacttaccgatatattatagaaagagacactgtaaataaataaattttaaatagttggattgggacaaatagagttgatttaacagatgcttttggtcccaaaaataaaatatagtacttcccccaatgaagaaggtgtgtgtgattattgtatttcctgtgcacacatatgcaaaaatgccatccattcatcccagtgcaatgccctatctacctatccaatcccaatccacctgagcgagagagagagaaagggtctcctcctcaacatcaacaatggcggtcgcaacctccttcgccacactcgtaagctcactcatccatggcctctgctctcctcttcttccccaccgagctctcaatcttattatcgtcgctctttcttctcttgtgtttgcactgcaggccatcgcgcggccggcggcggagcgggccctcctcgcctccaaaaccccctcgccgctcctctccatccgcaccggcaccggcaccgcacgcctcccctcatcggccgtctttggaggtttcactcctgcgctttccgctgctcacagccgcgcgcgcttcgtctcctccgccaccgctgaccccaaggtactgtgtccccggatcttcttcttttatctgccctacatatatctttctattgccgcaccgcatccattcttgtaatcctgtctagtagtatatcagtcaaatttactactccaccttactggactattattatgcaatcagcctccgcaataccggcccctgtttgttgcctctttggaggaagagatattgggttagcacagatgacctcgaccttccaacaccattaaattaaaactaatactagtaatgcctttgtatgtcaaattttgttatcagatttttaaatcaccaggtgaaatttatgctaccaaaattgcagtttcaggcttatcatcaccaatgctttattatgtattcacctgctctgattaataattttagttgcctcgaccatagggttctgctacttacaggtcttaccttgtatgtgcaccgaatgtaaacacgttattcatcatcagtgactgcctgcaacattgtgaggaaacacgtgtgcccttctgtactactgaaagctgggttttcctttcccatgtgcactatgcgctttcatgttttcctccactagatgttaacttacgatatactacctccttcctttaatatatgacgttggttagttcaattaacatcatacataaaagaacagcgcaagtatcgattattcttaccctatgtgggagaactggataccacgcttcaaatttattctttcagttttgctaaacttctcccatacattgcaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggtacaaagggcttcttgcttttcttctcttctgtcatctactactttacaggattacccagatttggtgcatgatacacataccattgcccttttccttttcaggagaaaaagggtttggttacaaggggtnnnnnnnnnnnnnnnnnnnnnnnnnnnnnnnnnnnnnnnnaggagactttgacaagggcaacgtatgtcttcattatttactttctttataatctactcctatgttgcacttgttcctctgtttcatctgacaaactctattggaaaaagtcacatagtgtaacattactcacaacactgaatgagctcatgtgtttgtttctatctatcaccattgagccaactatttctccaaaaaaaaaaaagtttgatttgttttatcaatgttagcgctttatgctgttttggatagaaagctgacctatatatgtgttttggatcattatacaactttgtgttatgcacttcagtgcttgccctatggtgttttagatcattatactgctttgcatcatgtacattatgagtatgaattggtagtttgtgatcagcataatgtgtatgcagtgattattgacttcatggctagattacaaggagattagcaccaaatcctttttctttaaattgatggcctaaattaaatcatgcagctgcctggtttcatgaattatgaatttttgacctagcctacatcaaatcattcagctttcaacttctgcatgtggataaagtaggtttcaaaaaatgaatatttcagggtactggagggaaaagcatatatggccggaccttcaaagacgagaacttcaaatgtacgtctgacaaatgacctaatctgatcgttctttctgcttcttatcttgtggttgtgctgattatatgtcttgtaatgtttgtagtggttcatactggacctggagtggtcagcatggccaatgctgggccaaacaccaatggcagccagttcttcatctgcactgtcaaggtaacactgtactgatatgttcactgtgtactagtgtcgaaactcactcaaaattacattgcgctgactgctacctgcgaatgcagacaccttggttggatgggaggcacgtcgtgtttgggcaggttattgaaggcatggacatcgttaagatgatcgaatcgcaggagactgacagaggggaccgcccgaagaagaaggtggtcatcagtgagtgtggggagcttccagtggtctaataggtgccagagggctaatcttcttcccccggagactttgctgtttttggtttcatagtaagctgtgaacttatcgcatgttctccgcgcagtcagagatcatgctgagttgaggccaagatttctaagttgagaagaatcctctattgttcggctggaataaaacgttcttacctgtcgagggtcaggaaataatgttgtggttcatgaaagatcaaatgtctgtcttttcgtgcatacgcagactaaagttactcctttcccaataccttttgttgctgcatactctctctgtcctaaaaaaaacaaaccctggtttccgtgctcaaagtttgaccgtccgtcttatttgaaaaaattatgaaaaaaattaaaaagacaagtcacgcataaaatattaatcatgttttatcatctaacaacaatgaaaatacaaattataaaaaaaaatcatataagacggacagtcaaagttggacacggaaactcagggtttgccttttttttttttgggacggagggagtatttactaaggccctgtttacatctcaccctaaaattcatcctatcacatcaaacgtttgaacacaaacatgaagtattaaatatatgttaaaaaatagctaattgcacagattgcgactattgctctatgatttgacaatgtggtgctatagtaaacatttgctaatgatggattaaataagcttaataattcgtctcgtggtttattgatggattctgtaattagtttttttattagtgtccaaacaccccatgcgacatcctatataattcctgatgtgacacgtaaaactttacccctcagttgctctttgtacatcctctggttttggccttatactgggcactgcactaggtagaaagaactagctgatgctacctaagtactacattgcaggcttgcagctgatgaggaaataaccgatgaatttggtggtgtttgaatctcctaaagattaaagattaagtgtttcacgtaaaatgagaggataataacgtgtgattaattaagttttaattattataaacttaaaaatggattaatctgatattttagaacaattttcatataaaaagttttcgcacgaatcacaccgtttagcagtttgaaaagcatgccactttaatccaaaatttaatccaccgttttcaggacattcgaacggggctgttgctagtgttgctgtgacttgacttgcaacaacacagcttaatctgggttaataatactacaatttttaatcaggaaactgggctataataattactagtaaaaaaaataggggagtttatatccaatctttttcttatatgcaattcaagtgatgggactataggcagcaagtactagtgtagtatagtaaacattatggtgggtagatatatatatctccaccgcacattcctcatcgagtggaccttgtggtcagctgcatatccatacttgtatgtagagaagaatgtaatactgctccagtaggcagcatcctctcctctcctatatcatcatcatatccaatccttggttggttggttcgttcacaaggaggaaagcctcgagcatcatcatcagtaggaagaagaagaagaagaagaagaagaagagcaacaggaagaagcaagcaagaagaggaagaagaagaaagcaaggagaagaagatgcaggactggggtccggtgctgatatcttgggtgctgttcatcctgctgtcgccggggcttctgttccagataccaggcaagtgcaggttgatcgagttcggcaagttccagaccagcgtcgtctccatcctcgtccacaccatcctcttcttcgccctcgacgccatcttcctcgtcgccatcggcgtccagatcaaccttggctcctctccctgattctctctctttgtttcttctaggtaatctcaattgcatatgtatagcagtatatatgcacctccatccatcatctctactcaccttagctcgttaatttgtactactatttgtgtgttccttccaattcttggcataatattgtgactcaaaggaattgatttcagagttactcattacttagtttcttcctccacatatatatgtagcaaaatcaaaagtgcaccattcatagcatttcaagtaaattacaactagcaaatttcccacgcaaaattaggcgaagccaatttttttctttttctttttagtaagagctggatttggcatacacatatattttgtttccatagatatttgtattttgtatacaatagatctttgaaagtagaattacatttgatatacaaccactagcttctatgtctatacgtccaattgtattttgcgtacaatagatttttaagaatatgttttagatttcatacacaactcttaccttgtttttcaatagatacaattatattttgtataaaactgtgtcaattaatctacatcaacacaatataattgttaatgtggtagtttgtaaacctcaagagttatctcgtactataatagggagatactaataacatatagtcagcagaggcagtttaattaattgctgcaagtgcaaccaaaaccattgggagtgcagggcagcatcagtacagtagcagcagggtcccaaggaggaagaattttggtggcattttgcgtggcacaatggtaatggaaagcatgaagtagttgccccatcgccattcacagcgactgccctggacctggacctggaactggatggatgtcaaattaagttgagctacaaaacaaaagctacacattatgtgcacagtacaaccgactgaccatccatatatccatcctattctattcctgcaaccaagcttcaggatatatcacacatctatagagtgtagtatttcacaatctatattgaacaaatctccaagaattttatccgtgtggtgtggtgtggtgtggcgttgctagctccacccggaactgaattaaatttggtatctgcctagcataataatgattaaataaccagaaaggtactggcagcataacgtagcatctgaacaaactgaactcagctgctcggtccatcttaatcagagtttcagctgaagaaagttaatcgatttgttaatcatgttgttagattctaaccaaaaactaaatgctcaagcctgctactgccagccgctttgcttgacctctgcagtatgcttacgcggattacagttaagagggaaaacaacaggttggagaaacgtaagtgaattaggcaggcgatcgatccagacgaaaggtggcctgagattagcacactgacacgacatctcggctgattgcatgcgtcactgagctgcacattttccatcctgatatcgataatgaatgtactactgttgtctctactcatctcacaaatgcagttggattatatcatctcttaaattaatggttagttggagaggctgatggagatatatatcttcttgtgcaagcagcctaggcaccaaaaaaagattccttgctttactctcatcaattcatctatctgatgatttggtttaagaactggcttaataattttcatcttaatttccagagcaaaggttaagtagttatgatttcattcagatgaagcaacacagacccgtcgatcaccacgaatgcgtcataaaagggggggattaatgaaatggaacacaccatatatatatatatatatatatatatatatatatatatatatatatatatatatataaaggacaaaaatatatggatgatgaatactatgttttgcactggtatgaaaatgtccatgcattattgattgaggtactgcttttgaatggcagcagcatatccaggtcactccatcgattgtatttggtcatctcctcctcctggaccagctacaacttaacttgatagctcaatccatatgttccagacatacttgtggcttttggtttcgtatccgaccttgatcggcttctttttctttttcaacgcacaaaagtaaagaaaagaaaaaaaaatttgtttgatctgtatatcctgttgcgctgcaattttggtccggccatagaaagaaaaggctgaaagcgagacatgaaacacaagcacttactagagccacaagcttgagattggttgtaatagttccctctatctaatccgtccaagcatcaaaaagggaggagctcctgctgctgcagctagctagatagcaccatcgaacagtctgtgctcctctctattactagcaactaattagcacacgcaattactacgcaattagcagtagtgctctcttcaaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacaggagtccgtccttaattccgggtaatcagcaaaatgatgactttgacgaccaaagtaatcgctgcaagtgcaggatgaaatcaatcaacgagatatataagcagataatacatacacatatagtaataatactatagattaatagatgggatgtgaatagagaagtagtatagtaagtaacagcagtagatggttgctgcgagtattatgtggagaaagaggaaacggtagcaatgagtcgcaagcagcatgtgcaacagaaagcgaagccgcaccaaccgcatacaaccggtacagaaagaaatatggaatggcaatgaaagcatgatcaacaagtgcagttgcagttgcagtgtagagcaggcaccggtcgaattcgagcctaataacctgcgcttctcttctcttctctgctgtgctttccatccatccactcccacgaaccgcacctcaccttctttctctttcattctctctgtactgtacgtacgttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaaattttcagcctctactcttattactcatgttattattatcatctcctgtataaatgtaatcattggatggcctgttctcgatctgattcaattagctagttgtacagtttaaaggcgtgtgctcagaatcatccatgaaatggatcaacgcgatcagtattcggtggtgtaagtgtaaaaatatatgcatgtatgtatgtatgtatgtatgtatgtatgtatgtatgtatgtatgtatgtatgtatgtatgacaggcaaacaaattaacacaggcgttgcaacaacatttagttataataatggataaccacatcaagcataaagtcgttgaagcgtagaatcagagagtccatcaggacagggaaattgcaaggcgccagtgccatcaactttacgttgacactgcaagtgctaatgcgtagtacgtctctcatcactgctcatgatccatccatccatccaaccactccatctgcgtgtgtgtatatgtgtactactctactttatacgctacctgtttgtactcccagctgaactgaagttttataccattctgttttcccaactgaagcttcaagctgaggttttgtacatatgcaatgcaccacaggctttacctagaggatgaagctgacaagcacaacaagtaactaatctcttgacagataccatactatcagatagattcctgttaccactcatagattgattgatcgaattttcgcacggggccttgtctggtcaggaacgtttaccggccatcatcttaagatgataagagcaagcgaaatgctagtcagcctcactcacacctttgcctgccttttggttccctgccctttcatctgaaacgtcacggatgaaagctgaattatttaatggagagcgtttatgcaacatctctttcttgccttcttttttcctccatttctttatacccttcgctttctgatattcaatacatttgaccgtatatacgggcatcacgacagccgcagatatttcacttaaaaagaccttcacaagtgtaaaatggagtatacattacttaaacattagctgcaaacagcacatgcactagctttccatcttgtacctagttgatcaagctgaaaaaaatattgggcttgcttttgtactccgtagctattacacgcagtggattatttttagcagcaacatagacagtattatagcaaaaaagaaatccaagttccaactcctacacagatggaatccatctcttaggtctccataattacctaccatttcacaagcaaaaacactattctagattgtaagccaggcaaattaaggtactccatccaggtgattctgatttctgaaagactaacatcttaaacatccatgaatgcttaagactgactgtaatagtgcattatgatatcagatatctacttctgaaactactacaccataaagttcttcgacatcttatctttacaccaagacatcttgttggagaagccaacaatgcagtactaaacagttactaatgcatgctcgccttgctcggttaccagtaagaaaaaaaatgctcaatcccacaagatgactatcaatggttgggttttaatcagggattgataccacaagaagaaccatgctgcagtagcatagctaaaccacaacagaaaccagggagtaaaaagcagacgagtaataagggttttgcaaaacgcaaatggcaacagcatagattatgtatggataacgctttcactcatgataccaatcagagaaaaacacccagaattcatgtttcatttttacccaatatttgcaatacagaatccctaaactcaaggatctgtagcttcctcacctagcctggtgcgatgccattagaattgtagaaatatgtcttaggtctcatcaaaattccaggttattaaatcatcacagcaaagcaaaatcgtatatcagttctttcctcatcacaaatcttccagggctactgagcaacttttgtgttgcccctttgcctcgccaggcgaacacatgcttcaaatctcttgactgcctcagcacacttgagtgggtcctgtgcattgctcacgtaacactggcggcagtttgacctctcctcagtgcatggcgtggggttttggtacggcagcttgaactccttgtcacgcaggtcttttgatttcttgatgagttcatcacgcatcccagcatgctgcttatccagcttctcctgaaccttttcgctctcttccagaacggcacggatggcttccagctctgaaaaagcaggtgggggtggtggaggagcaggggttacggggagatacatgggaggctgcagtggccagccaggaggagccttgggttcagaagctgggagttcccttgagttgtcctggggctcttgttgatgttgtttgacagtcttcttaggcttgggtttcctggttttctttttgatcttctcgtcatcacgagcaagctggtcgattagcttggtgctaatctggatggtgtagtcacccataacagaaagttacaaacagacgctgcaatagaagtaaccaaaaggaaaccaggttgaggcatcagcatgaagtttacttaagtagtaacacaatgcagcaagcacatacacaggaggtattgaaatgcagtcgtaaaaagcgcatgttcatcatatatgttagcataatacaatgaagcacattgtgctggttgtatgtgaaggaagatgagaaacatttatacagcttggttgatactgacagagagtatggagcatagaagaagaagctgtaaactaggcatgactgtgtgccaagttaaatcagagcaaacagtgtagtggcatttatcttgattttttttattttaaaaggaggagtcatcccctaattcaagatcatctatctttgtttcttcggctgccagatctgcctagacaattggctattaggaggattctttgcataaaaagtgcatgtgcaggaaggtgggcgagagatcaattaccggattcgcggcaacaccgcgattccgatggcaaatcctaacgtcctaaaaagtaggtaattgaagggatagttggcgaggggatcgagcggatgcttacctgagcggtcgaggtcgatggggcgacgcaggagaaagaggaacggcgccagaggaggagagcgagcgcgagctgcggcggcggcggcgacgacggcgatggcccgtcgccctagttcgtcgcggttggggttggggagacgaacagcttttcctcttcctctgccctgtctgtgtgtcgggctttctacttactattattgggctttttttttttttgggccagtgcgtctctctctctctctctctctctctctctctctctctctctctctctctatatatatatatatatatatatatatatatatatatatatatatatatatatatatatatatatatatatatatatatatatatagactgagaccttttcttttcttcctcccaacatttttttttcttccttccaacatctttgttatggagtttttttttctctaaaaacatttccccccccccaaccttatcgtcgtcatagtactgtgtattcactcatgatattttctttgattaatgccatgcgtgatgccatcaattccattgtctcttgacatgccaagagttcagagggacgcgggagctccttaggtaatcaatcatcctatgatgaggaagatatgaatttctcaataccgtagattaaagaaatgctgaagaacatgggtacagtttagccactcgaatctagaaccagccacgacacaaacagaattcaatctgatagtaattgatactaatataataaatttgtagcaacatcaaaagaggtgttcagatttcagctgctccgtttcttggccaagccaaactaatactaatctagtggtacagattcagtgattcctccttgtataggtctaagccattccaaaaacacatcacgttgatgcatctgccttttgcttcttgtccgtcccatggaatttcctcccggcttcaaccgcctccctgtcaatcagtttaagtaatcaacttcacttgtcgcatggaataacaaacacatacacacatgagttccaaaccaatcataacgacaccctatatatgtctatgttaattgctaaacaacggaggaattcattgcttttctttgctcacagaggaaggctttactacctgaacgcgctcacaagctcgccgttctctggctcaagctgcaccccctcatagaaggcattcgcggcttcttcgaacctctgttggtatcaccggaacaacttcagcaacaaatatataggtaggtaatcacaactgcctatcagttcccaaacttatcactgaaatcaacagacctgcagcaggcgcagtgccgcgccttccctgtagcaagctttcgcccagtctggcctcagcgctcgacatgctcttgcatcctccagagcacgttcagcttgccctgcccgtagccagcaaaggcttctgtttgaatgcaacgtggcgtcgtttggatttaactcaatagcctgaaatgtagttccattccattctactctttgaatttgagttcatatgataaacttatgcgccttttctaaaaatacacgctgtcttgcggtttggttcttacctgtgtgtaggcatctactgctactaggtagtctttatttctgaaggcatcatcacctctcgattttgcctccaatgatctctcttttgcctcagatgacacctgtacagtgtcaggaaagcaccatttgcagcaatagttagatcttgagtcttacagttattaaatagttggagccttgaagatgaataaaactataaagtaaattgcaatgcacctcaacaagttgtggtacttgtaatctgtctgctttctgagttgtagcttcctttacctgtgcctgcaaaatttattcaaccattgggatcgacaaagaacttgcaactagtaatagatcatgagaagattgaagttgcaccttttcctcgactgatttagtgtattctataattccatcaatactccaactcgaaacacctggaattggtgatgtcaaaggtaaaagaagttccacaacttcacggttattcctcaaagcagcaacctgtattggctttagtccatcctgtagaagaatataatagttattcaaccattagcattacttagctctactgctacaccaaaatcaacagtcatgtccttcagtgaaattatgcagcccagtgctgtttgctcaataataatgcaagaaaggacagatgatggaattgcaaaagcagttgccaatccagctaaacaatacactacagggttacaatagttattcactgcataataaacggtggaaattttcagagtaacacatgctgaccaagaaagggatattcattatcatacatggtgtggaacaaacagcaaacgcttgacaccctcttacgaatcattttgaccaatcaatgcacatgaacctggctattgacatttaaatatttaatgatacactggaattctgattaatgtacaacttacatcatcacatgcattggggtcacttccagctttaagtaaacaatttattatttccatgtttccaccatctgcagcaatatgtaatggggttgctccaccagctctgatattcggatgtgcacctgcctgtgtagcagattatatgatcggttttttatacgaatcatagatgtaaggggtgtagaagcaacagagcatcaaacaaaaccaagaacagaaacagcatatgacaaaagtaagaacagacactttgatcctcttatcaaaatcttttgatataggtagcacacatataagaacgtgacatactatgatttgccatgcagcaatctaatcaataacacgaaaaatgagcttgtctgaacccccattgcacaagccagattactaaacaaggaaatatagcatacagaaaccatatgaccaatgaatggcatcgaagtggataatatcctaaagtaaaagcaacagattttggtattttactcttgaaattagatttgtgtacctgaattagaatatccaagcatgggagggaacccgctgcaacagcagacaacaaaggcgtaataccatcatcgttttcagtatttggctgccaagcaataactagcttcagtaaaaaagttaaggaaaggccacatgaacggctgattgaaaggtggttgagtgctaaacaaagagaagcctgtccaattcaaagaaacataatagatacagatgctattagaaccaaaagatagcatcttcttaacaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8781 - DNA, 542 bp, Oryza sativa
aacacgtgtgcccttctgtactactgaaagctgggttttcctttcccatgtgcactatgcgctttcatgttttcctccactagatgttaactacgatatactacctccttcctttaatatatgacgttggttagttcaattaacatcatacataaaagaacagcgcaagtatcgattattcttaccctatgtgggagaactggataccacgcttcaaatttattctttcagttttgctaaacttctcccatacattgcaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggtacaaagggcttcttgcttttcttctcttctgtcatctactactttacaggattacccagatttggtgcatgatacacataccattgcccttttccttttcaggagaaaaagggtttggttacaaggggt

SEQ ID NO: 8782 - DNA, 47038 bp, Oryza sativa
  unsure (1)..(47038): unsure at all n locations
aacctcttggacaccgccgacatgtcgcccggccggatcaccgtgtggtagctgtccacctccaccagcctccgggggcacaccacgatggccccgaactccagcacactacgctgcccctcatccgccgacgccgccgtcgtctccacgtcgaagaacaccatctccggccgccgcatcgtcgtcctcatattattcatatactctagctatctatccgcctcctctcgcctaccctaccctataagatcacagacacagagtcgatcgttaatttgttagtttcccgccccgcgctcatcgatgataaatgtatggggacgattcatccatatatattggctagccttaccaacaaattaacaaagatcgatgatggatcttccaacagtgcaagcaagcaacaaacccagccgccctgcctgcctgcctgcctgaaagaaaaaggtaaatcttaagcttattctactatagctcatttcttcttcagctgcagctaagatatagctagcgtgcatgcctgcattttatgcacaagattattccatgtttatttcacaagcaacctaaaaactaacaagcctaagcgtgcgtctacgtgcatgcagatatgtgcaaggaatcgccagcatgcatgcatcaagcgcaattgcatttggaagggaattaggagcaagatgaattacgcacgcctactgcctctgcatagctctcatctcacccaaaaaaaaaaaaactgcatctgcatacaccaccaatatactactactagtactatgtattagccagcaaactgctggtcaagtaatttaaccggcctcaagtaacaagtgtttgcttgtgtgtctgggtcaccgtttcacgcacgcaccctcccactgcaggcaaagccaaacacacacacacatattctcttcgctctatgttattcttctttctccaattctcctccaaactgcttgtacggtgcttaccaaactctgacgctaactaactatacacaccaccagagcttccaatccttcctcaaaccaatccacacaaaacaaaattaatttaacccctccaatccactctcatttctagtggagttaccaacagtcagatactacctcatcttaactgcagagttctaaccacatactgcctacttaattaataccagcacctaaattaaacagcacatccaactacccctaatctcccatccatcaacacaataacgcccatcagttacaacagcaagcttacgcacagaattttgcaactaatctttcctgaaaagaatgatcaactgaatgctttcttcattttagtagactcctcacagttccaacatacacaccaccttccttacccacaatactcttgagataaaccaaaaaaaaagctaacccagatctcagcgctttaattcagctggtgaatgtgcgagatcaacttcagcatatatttgtagcaaacaatcaacaggcgtccaaacttcactcctgcatacggcaaaattcccaaacaatatataacactcattaacacaactcatatctcttgtgttcgacaagactctatagaggcgaatttcaccacacgtacctttgtagttacatcagcatcttccaggcaagtgaggcagctcaagagccctgacgatcctgcacctgcatgttccagacaaccaggcaatcagcattctcacccctttcactggatgaaatcaacattactagacaatgacaataacacaaggcaaacacctctgttttctgcatgaagccaatcttgtgagcacatcaaggcctccagtgtatcaggtaaaagcttgctacgctgtggactcaaaacccttccagcaatgctaaacgccgattcagaaactacccttgagacaggaaccgctaaaatgtctcttgctaacatctgcagagttggaaacctcttccccataatcttccaccaatctattatgtcaaagtctactgctctagggataacaggctcgtccaagtatttgtctagttctgacttgacatctgcactggagaacttgaaagcgatatatagatcgaagctagataactgatctggaccctcttcctcccccccacaaggctgcattgcaccgacttttgattggggaccctgatactgtttgatcaaatcataacagagctgccggactctatttatctcattgtatgcctcatcaccaaaaattgaggggaaataaaactgcagtagctcaagcttatatctggggtctaggacagttgccacagccatgagatcatgaacttcaacgcaatatttctcaaacaattcggctatttcatttctcatccttcctatcagttcatcctcacacccaggccatctcctcatggccatccgaattccacaaatcttggggaagtacatattagcagtaacatacttagcctctgaaattagttctgcaatgtcagaaaacagtttcaacttactgcagacctcttttgctaatttccagtcatcatcatcaggagcacaaatatactgttcctctatttgccttaagtgatcaaagacttgcttgtagcttatggcaacatttaacatggataaggtagagtaccatctattattacaatcaagagtcaacttcttgtcgagattaacattcaaaccacgagcaacatcagcaaacactacatctctttcagttgttgctgtccagaaatcaacactggcgcggatcctatcaacagcacctcccatcacacccaggcaactattggcaattctacttagcacataggcgcagcatctcatgttcagcaaagacccacctaacaaaagttgttcggtatccagcctttgctttaagagccccgtaaccgtatcatctgtagaacaatcatcagccatcaccattgataccctccttccaagattccattcgttcaaacaagaagacagagtttcagaaattgcttgagctgtatgcggccatggcacatgtataaagctgcatgtggcaatcaaagcacaataagtttttacattaaaatagtctgaatagaactttggaccgagaaaactgcaactatatttgaaaatatacatacacacatctatgcgctcgaaaaataatgaaaaaggaacacacctcagtagacggcactggaatgtccaggattggtcgataaaatgagctctgacagccacataacctctattttgatcatctgatgtccatatatctgctgttattgcaatccgacctttagcctcccacaaaatttccctggttctgaccctctccgtctcataaatgctgataacatccttcttaagactactgttgggaaccagctggaacaatggttgaagagccctaacaaacctttggaaaccgtaatgctccataatagacaaaggatattcatgcaagataatcattctcgcaagctccatcctggcaacatcctggctaaaggtggagctttctaaagaagcaacagtgggttcctgatcaatatcctttgtacatttggagggagttggcttgctgactttattactcctgcgacgaggacatttgctgagatgatcgtgcaaatgtttggtgccattcttagtgtcccctccgagcctcttatggcaccataggcactcggctttccacttgctgtcgattttcttcctcttgaattctttccacacactcgatgtcagctttctcttactaacatattcttcttcaacagcatgactggaatcaggagcagcagttgagtttttggcagctccaagacccagagggatgtcatctttcataaccaactctgaattctgcaaagtagaacaggcaacaggggtagtgagaaacaaatggcagtagaaagatgataattctccctggattttctttttcacttgggctaatttctcatctctatctctactattataaaaattcaagatgtttttgcggtactttggtacgtcatccgtgtatgagtcggtttttaagttcgtttgcttttggaaatacatattcgtatttgaataggtttttaagttcgttcgcttttggaaatacagaaggagtcgtataagaaatccttttttttaaaaaaatcgcatgctaacttacacggttggactcctaactacagctcatgatttttgtaaaatacatatattcaagcgaatttctacagtgaatttcacctgacttaaaacatataataataataagattaaaatagtcttttcccgttgcaacgcacgggcattttttctagtcatcccttaattgaaaaactagatacaactcatagctcacactctcaaaacaggataaatcttgtccccgtttgacatggttttgagcagcataggaggtgaggtccacttgtcattgaggataaatggtgggcccacacgacaaacgatgatcaagcaggtcccatctccagtttgggtaaaacccctgttaaacaggttggaggtacatgtttttacccggtttcaagagttaagggactgatcatatatgtatattacgcctagtctaaaaggaaggagaaacataaattttcttataatcttattgagcaattgagcaaagctgatgaattttctactagctgtatcgaactagaatgaatacagggaggcgcgagaattcagaatgtgtaggggcggagaggaggagggaccttggacttggagttggagcgagcaagatagtcttggatggacttcattgttgaaaccctagctagctacatgcctctgccgccgcccatcaaacggacagaaagggagcgccgtagctagggggttggatctggccggaggagcgtcggcgtcgggcgatgggcgcggggcggcggcggcggcggcggcaagggaggccgggagggagggagaagcttcggtgcggtgcggtgcggatgaacaactcgatccggtcagttcagtgcaggtggggcggaatgggttgggctgcccggcccaccatgtaagcccataaaccgcattccggccctgtgctgtgtccctttcttttctctttatctttatctttatctttatccttaccaatctaatctaacctaacctatttaaaaaatacttaatttttcgccgcgctttcctccgcaggttcacaattccgacgaaaaccggtcgaattctatgaaatttcgacgtttcgacacggctcggaattaagtttcgattagaatttcaaaggttaaataatagatttggtcaaaatttatcgaaaaccgatcgaaatttatagaaaaccgtgataacaatggaggtcaaaatttagtggtcaaccggtaataaaccatgttcctccgtcgccggcatccgccctctcggtattcttctgtcgtgtgcgcatagagacaaatgagaaggccaccatggagcagctttgctgcccggggtatgtgtctcacacatcctcgacactaagttcgtggtctctttggttccaccgaaaataataaaataatatctcgggagtccaacagctaattaccatatttttaccgtgtctacgagaagatacacgttctttgaatgtttcacaataaagaaattttaccatataataaaaatagaaccccatatttagaaacacgtgatgccccgttttgacagtaatggatccccccaaatccactcacctccaacagttggttccccatctccatcatctgtggggagagagcccgagaaatttagggttgagaggtgagtggcggcggaaggaatccacaagttgcaagggtgtggaggcggaggagtggcctcgattggggatcggaggtggtgaatctcggtggagaggcacaatccaaggcgataagcgtcgatttgcaagggtggttcgtgggcgaatggcgaatcaagggcatccaggcggagggtggcgtcggcgtccagccgtggtgaggaaggtcgccctcccgcagtggcgcaccaggggggctcctcgcaagctgggagtgagcaatccaccaaggctggaggtggagagatgaggggccagatgaacaaaggggggaagctgcagcaatatcgtccagttcagaaggagaagaatcaaactgaagagaagattgcgacatctgcagtgactcctcagactgcaacccagcaaccaactccaccacccaattctcgcactggtatgcaaactaacccacagagaattttctgccacagatgcaaaggttttggccacatggctagggattgtagcaatgttgtcttctgtataaattgtgccaaacccacacataggacagaggattgcatctatgacaagcagccgaggcctatggcaaagctagtagggtatggtgctccaggtttaggttgcatcttaattcaaaacactaagcctgacccacctaaggagcataataatcctctggctatgatctctactgtctttggtggagaattgacagaagctcaacttgagcaaggtttcacgcaacaatttaagtggaattgggtttggaaagctaaagcaatgcctaatggaagctttcagatgagatttcgtaacaagataaagtttgatgagcttgcaaactttgattatttcaatgtcaagggcactgatgtgcaagttaatgtgaaagaatggacccagaaatctgaagcagttgggaagttgcatattgtctgggtcaaaatcactggaattcctgaggaaatgaagggttaccaagctttgtatgaaattgggtcaaatctagggcctgtcttggaggttgatatggctactttcagagctagcaatgtgatcagggcaaaagttggaatgatggagctgggtgttctgcctttgaaactagtgttaacttctcccaagggacttttgttccaagctcatttcagtctagaggaggtggtggaactggggtggtttagtgatcagctagatgacacttttgagaaaattgagatacaagaaaatactctggagggtagcagtcagagagagggtaagcaagttgtggtggtggatcccatgacagaagatcaccatgtcagtaagacgggtaacgggctattgaagtttgtcagaagcaagtcctggtgccagaattgatgctgggagaacataagatcaaatgtgcacagatcttgagagacatggagttggcaatgcaactgcagaaaggagactgtattctgactcagtgctgtgaaggaaggaaagaggttgggaaaaaggaaatgtcacaggagcaggttgatactctgcagcaaccgatgaatcaaaagttggctgaagaattagaaagctcttagacagatgttccaggggataaggagaatagagtcagttttgatatgggtttgaatcaagaagacaaggacaaagtagatccgggggacagtgaagattacatggattctcaggagtctaagggaagttttgctaagaggttggggattaatctaactgaagaagctcttggaagtcaagatgaagagatgaggagaagcaagagactgaaagacaaggaagataagaggtcccaagagatggcaatggaaaggaaagaagcacaaaatgctttcatcaataaaaattccctccttcatacatgaatcaaatgtctctttaattgatattgctagtgttttaggggtcaatctgggttgtgctgttgatgatatagcctctaatattaatctgattagagacttagagatggccagaattaacctctttctgaaagagggaacaaattctgaaggtcaacattgtcttgattcctttgagaattcaaatcctgatttaaatgttttttctgatgatttggattctgaaactaatgatgaggattttaaagaaattgagcatgtgcttaaacagattcaatcttcagctagaaaaatgaaacagagaaaggggaaccttgagattttcaaggtaacccccaaagttgtcaggaaaagaaaaaagaaaactaaagattaatgaagggcctcttttggaatattagagggatgggaaatccagaaaaaataggtcatcttcaagaccttgttaaagatttaaaattagattttgtaggtattttagaaaccataaagcagaactttactgctagtatgttacagagcttgagtggtaagagaaatatgaagtggacttggcttccaccttgtggtagatctggaggtatcctggtgggagtaaatgaggataagttctctatttgaagggagtcaatgggtgacttccacatcagactgcagttgcaaaatgtttgcaacaagaaaatctgggatcttctagtggtgtatggagtagctcaaactgaacataaagctgcctttcttgctgagctgtctaaggaattccaagcctctaggagacccatagtgataggtggtgattttaatatcctgaggaaagagagtgagaaaaataaagctggaggttataacaaatggagtttcctttttaatgcaattcttgaacaaaacagcatgagagacatccaaatgggagtgagacaattcacttggtgtaacaatcaggaaaatcctaccttagagaagttggacagagttttcataaacaatgagtgggaagctgattacccccttacttctgttcactctttggttagggcactttctgaccataaccccatactattagatactggaaatcctgacaaaagaggagacattttcagatttgaacttagttggtttttgagggaggacttagatagcattgtgcaggaagtctggaatgattcttactcaggcagcactattgaaaggtggcagaagagatttggctgtctgaggagaaagctgaaaggctggaacaaaaactgggagggtgaatacaagagaaggaaatatgaaattttgagtaagattgatgttatagactctaaaattgaaacctgtggcatgaattggagggatagagaggaaagaagagagttggagcttaatctgaaattcactattagggaagaaaaaacaaagtggtttcagaggagcaaagagaaagaaactttggaaggggattgcaacaccaaatactaccatgcaaaagcaaatggtaggaagaggaagagtagaagtttttctttatctcaggatgaaggcctttgaaggtcaagctgagctgttgagatacatcactgctttctacaaggatctttttggtcattcaaaactgaacaacataaaattagatatgggaggtgctaccaagataacagaggaagatgcagctttgctgattaaacctttttctctggaggaagtgaaaaaagtggttttttatttgaaacaaaacaaagcccctggtcctgatgggttccctggggacttttacaggaagttttgggacttgattaaaacagattttcttgaacttcttaatgattttcataagggtgttttggacattgagaggcttaattttggtatcatcactttggtcccaaaatcaaaagatgcagcacaaatccaaaagttcagacctatatgtcttctgaatgtaagctttaagatcataacataagtgctgatgaataggctggacaacgttataaattatataatcgcaagaaaccagactgcatttctcaaaaacagatttattatggaggggatagtaatacttcatgaagtatggaatacttctcacaaaaagaaacaaagtgggattcttttcaaagtggattttgaaaaagcttatgataaggttgattggacctttgtgtatagaatgctaattgcaaaaggtttccccacattatggtgtgattggattatgaaagtggtgagagggggcaaagttgcagtgagagttaatgatgagttgggtccttattttaacacacatgaggggcttagacaaggggacccactttctcctctgcttttcaacctggcagcagaagctttgactgttttgatacaaagagctgaagataataagttgattgaaggtctgaatgtgagcaataacaacaaagtgactatccttcaatatgcagatgacaccatctttctgctgtcagatgacttagaacaagccaaacatctgaaattcattctctgcttgtttgaacaactatctggactcaaaataaatttcaacaagagtgaggtgttttgtctaggtgaggcaagagagaaacagggcctctacagtcaaattttcacttgtaaaataggtgctttgcctatgagatatttgggggttcctattgataaaaaaagattgcataatagtgattggaaggctgctgaaaacaagatggaacataaactgagatgttggcaaggtagattacaatcaattggagggagactgattctcatcaactcaagtctcagtattgtccctttgtacatgatctctttttatagattattaccatagggtgttaaggaaaaaatggatttctttcgaagaagacttttgtggtaggaagaacaggggaaaaaagatatcacttggttcagtggcccatactttgttctccaaaagatcatggaggtttaggcattctagatttagatacaatgaacattgctcttctttgcaaatggatatggaaaattgaaaatgaatcaggttggtggcaagatatactaagagataagtatctcaaaaacaaaaatcttgctggtatctctgtcaaagctggtgattcacacttctggcaagggctcatggaagttaaaaacatcttctacaagttctgttcgaagaaagttggtgatggggaaaatacatgcttttgggaagacaattggattggtggtagaccattaaacattcaattcccttctctgtatgacataacttttacaaagtaagtttctcttgctaaggtcaaaaaagagggctgggggattttcaaatttagaagaactctacatggtgacaaaatggactggaacactttaaaaaactcttgtggggaggttcacttgattgaggggtgtcctgataaaatctggtggaatttaaccaagaatggaatctttactgtcaagtcactatatagtgctttgaaaactcaacattatgctttccctcataaaaaagtttggaagttcaagattcctctcaaaatcgaagtctttctttggttatttctaaaaaacaagattctcaccaaagataacttatataagagaggttggaagaaaaaagacaaattgtgccaattttgcagcaataccgaatcacttcaacacctgttttttgaatgtcctttagctcattttttatggaatgtgattgggtgtgctctaaacctgaaaccaattctcaataaagaacaactttttgggagttggttgtcaaattttaacaaacacatgaaatatttggtgatggttggagtagctgctgtcatctgggctttatggagaacacgaaacagagcttgttttgaacatgttttgccatatgatcctatagaaactgtgttcctggcttgcaattggactgaaaactgggttgtcttgcagaagttggaagcaaatcgaagaagattggtactgggagccagactcataaagcaggtggcaagtgaggtctttagttcaagacacagctggagaccaggtgccagaagactgaagatgtgaagaaggaggagttgttgatgtccctgcttcaaagactaaagttgatctagcagtacctttctaccgtagtgatttgtttatcaatctgtcagcagttcttctgtttcttttaaaaactgttacttccggtaggaggtggtttccctaggctattctgaatagcttctgtctcaatctagttccatccttttttttcttttgctgtaatggcttcctgtagagaccttttatcatttctcttaatggaaatgggggcttcaagccctagttctaaaaagaaaaagctagttgtataagaattatgtcaaaaccaaaagaagaaaaaaagagagtgttatctcaatctaccttgattaacaaaactgaatttcatgatcgtggatcaaacataattgaagcaaaaagtgtaagacgcattggaatgattaacctagctataaggctcaaggttcctataaacctcacaaattaaaaggcaaaagaggataagggaaatactccgtattcaaaccttgggataggaggaacaaagaaatacgtgccagaatgcatattacaaaagaaactcctgcatgcggtgtgatcagaatggaattggtggggaaccaactagtggcaatcgcaacagctcatgaaagaaaaataattcaaggtaacacctgaaaagttctcaaaaaaaaaagttacacctgaaaaggggcatgatatatataattgcattgaataaacttacaattcagtacaacgttataagatttttctttctttgacatatatatatatacgcaaagagcaaattaaagaaatcttcccagtcttaagtaaatgaatttgtataataactgctatatactgtacgttgcttaactcgtggtgctgctcgatcaattttaatttaaacctcaagaaacagggaggcaagaaactgtacctgtccatatagaagtattatcgatcctccctaaagaacgtactgatccacccgtggcggtggactgcacgccagctaattgtccacaacgtaccagtaccaataccataattaagcagctagcggtcgaggaggacacgacgaagccgccagcttagcagccggagggagcatccatcgtggtggcccgggcgtccttccagttccagcgaggatcctcatctcgatcgcgcgatccacagccacacgtacacctactatatacgcacgcactctgcaaagtactagctagctaggagtagatcgatcgatatagtatgtcgttccttaattttctgcacccacacccagctggccatgccatattgccatgcaactattgaaggaagctaggatccacctacactgcacgcgcaccttgagcgaacaacctcgtatgtgcgtatgttaattattgtcctccatatatgcatggatgccactgccacccgcaccagcatctatcgcactcacggaccacaatcgtctcctctcctagctagcttgctaccacaatcatgcatataccagtttgcctcattttttttctggggaaataaattagttgtccttgaattatcatcttatctgtcttgcttgctttccaacaaatagattcatgttcttgcgtggcttgtctctcgtcggatgacggtcggagcgcacgtgatgcccggagtacagagcgagaatggagagatttttgctccatctgataaccgacccgttttctgttttttctgagaggaccaaccaggacctagaaccaacctgatggacagtagagacgcgacaaacacattgaacctgaaaccgatcgcatccacaagaagacggacgatagaaaccttacagtacaggtattttaagtaggttaagattaaaattaaaataagataaagataaaggagcaaagtatacttttagttaattaaatttagtagttgccatgtcaacggttagcaaaatatgatattgactaccaagagctgccgccggatccacgctggagggaggcggtggagcctgactgccaaggttgcccagccagccgccgccacctttgctcgcccggccgcctaccgccgacctagaggacgataagagaggagaggagagtaggggtgaaaataatagagtggataggagatgtgaataatgtgaggagagagagagaggagaggaggtgaaaatttgaagtgccttaaagagaaaagagagaggagaggtccctgtctacttcatcgcaaggcatctccagtctcacccacggcttggttaggtctttccattcattccacaacaatcgcaaccgcaaggtcctcatgaacttatccaagtttagaacccccaggcctccctgactggtcggcaagcacgtctttgtccaattgaccttgcattttcctccaataatatctcccgtgctagcccagaggaagcggcgtcgctgtttgtctagctgctccaaggattccttcgtgatttccagggcggccaggaggtagattggttgtgctgaaagtacagatttgacgagtgtggttctcccagctgaccccatgtttttttccctccagcctactaccctccccgagattttgtcgaaaacaggctgcaagtctgtcttccacaacctcccaagtactaggggaagccctaggtattttagagggaaatttgccctcaccgctggaacaccatcaaggacacctgccaagtcaatgctatcacatctaatggccgccacttgggatttctgaaggttggtgacgaagcagtccagaatgtccacgaaagcttttacattgcctcgggtgggattaatgaagatgatggcatcgtctgcatacatcgagatccgtagttgagtcgttctacaccgtagtttcgaaattgcgcccagctctattgccttggaaaggattcgttggaggaagctaaatatttatagctttgactagaaaaaatgtccgtgccttgcaataggtaaagatgttttctcgatgatacaacaactattagaagttgggcaataaattgaaacattacgatcgctatacattataattgaaaaaattgatgaaaatcctaacattaggatcgctatacattatgattaaaaaagttaatgaaaattctttcttagatttgggccagaagctcattccttcattcctctttagtcctacgctaatccgctacctccctctactcggcctgcctccttctgcccatctcgaatagctgcctaccatcttcaacctcccgaagatagtcccataaccatacgatgctggagctgatcttccccgtcaaatccggccgaatgtttctcgatatccaaaattaattgagggcttttgatccaccgatcatttctttcccttttccaaaaaatagagcgtaaaactcggaagaccgggaagatcatggagattaaatccgacgaattaaagccgaatcgaaagggaaaatcatgtagaaaatgatggaaaatcatgtagaaaatgatgagcgagtaatgagaaatcgatttttgtaatcaactggaggaggaaacgcacgattgatacaaccgcggcgggaaggcgcgtggtgcaacagatcggttgatcgggaaaaaacagatagaagtaaaaaaagttgcaacagatcggttaggatcggaaaaaaccagtggcaaaaaaaaaccaagctgcgtatttttttaggttcggcccgggcggcggcggggagacgcgaggtgcatcaatttggatcgggaaaaaccaaggacataaaaacagatagaaacaaaaaaaagtgcaacagattcagtttggaaaaaaaccagctagcaaaaaggaccaaaattaacccgaggcgcctaccaagtagatcggaattgtttcactaagtagataaaaaatgtttcaatcgtttaaaaagctgaaacgcaaccaaatcacctcatgaaacattttgctaaaacgtatgaaacaatggtttttgaagctctttcaacatatataaaacaatgtttcagcaaatagcgaaaggacctttcactacaacatttaatctatatatatagtgaaatatcatgagtatacttgctgaaacattgttggtggaaaaaaaatgaaacggatttccttaataaagcgttatcgtaatatgtgggtgatttgttgcaacgacgcatgtggtggcactacgccagatcctcacagctctgacgggatacctgtgacgggcaaatgatttggtcactgatgaccatcacctttgacgggtcatacgggatgccgtcatcagtgaggcatccggccgcggcccgtcacgggtatcccctcacctgtgacgggctgaaaggcaaagccgtcacaggtgagacagtgatgggttttccaacccgtcactggtatcccctcacctgtgacgggccgcggcattataagccgtcacaggtgatgggccgccacctgtgacggatttgttttccggcccatcacaggtaggtcgataccttcgacgggaaactcaattgaagcccgtcaaagttatgaccaacacctttgacgggtttttttacctaacctgtttgaggtgtgttgggtctataaataccccctaaaccgtcaactgctttccatcccgacaagttcactgttcacaaatcgttgggagggcagggggcgaatttttgctaaaattgaaggtaaaacccacattattctccattcattctcgatcgatcatcatatatttttcttcctatgttgttgatttcagatggattgtagttggatgtaccatgttcatcgttcgtctacagagtatagagagggggtcactgaatttgtcacatttgcagagaatgacagaaaaagtaggatgagcatgtacatattgtgtccatgtagggactataagaatgaaaagatgaaccttgatagttcagaagcgcattctcatttgataacgaatggattcatgaagaaatatacatgctggaccaagcatggagagcaagaggcgcctgatgccgcaactgaagaagtgttggatcaggatgtagagaacaccgccgcagctcgagaaggcatgttcgtatcttctccgttaggtggagagaccatagatttggacactcaatgtctatctacaatgttgcatgacattggagacacagaggacaacgacagagattttgagaagtttagtaagttgatggaagattgttagatgcccttgtatgatggatgcaagtcgaagcacaacaagttgtcatgcgtgttggaactcatgaagcttaaggctagtaatggctggtccgacaagagttttacataacttcttgagttgttaaaggacctgttgccagaggggaataaattaccgcatacgacatatgaagcgaagcaagtattatgtccgttgggcctggaggtcagaagaattcatgcttgtccaaacgactgcattttgtattacaagcaatacgcagacttggatgtctaccctgtctgtgggggcatctagatacaaacgagtaaagattgaaggtgaaggaagtaattcaaagaggggaggccccgttaaggtggtatggtatctcccaattgcggagcgcatgaagagaatgtttgcgaataaggaacaagctaagctagtgcgctggcatgccgaagaacggaaagtcgatagtgagctgaggcacccagcagattcagtacagtggaggacaatcgataggatttaccaggaattctcaaaggacctaagaaacatgcgtttcgccatgtgtacggacgtcattaatccatttggtgatttgagcagtcgtcatagtacatggccagttctgcttgttaactataaccttcctccctggttgggcttcaaaagaaagtatattatgcttgccatgctcattcaatgactgagacaacctggcaacgatatcgatgtgttccttgaacgaggtcaatttacgctagagcttcactgatgtggttgactatgtcaatcggtgtttatgggcccactaagacaaggagtacatcatgtgcgcacacaaccaggagtaagaggacaatacccttcgtgtatattgtttttgaagttaaggttcttattactaacgctacataaccaccgcgtaagcaacattggattctcttagccattgtacctaagtggagtagggttacctaccttaaatccaataagacgaaatattatgatttcattgaaatcaccaaggtcttaaatatggcttggggcccatatgtggaaaagggtggtaggcacaaggagggcaaggacgaactttatcataaccccaagtttgcatgcgcacaacatatcggagaccagtgtggtttccacgtgtgccacaacatgttaacacttctaagagaggtgaaagattttgaccctgaggttgttgttaatggcaaataaactcatttcaataccaacattactattctatacgtgctaacctctgatttattaaacagaaaggtagagatggcttgaagatttcacccatcaatccccttgctatcagaggtgaagtgtacgccttcattcttgcagaaataatgaacaagaaaggacgttttcacgtcaaatagactcgtgaactgggctagatgtgatgtcgtgaacaatacagttatataatttcttgtgatgtaaaaaaagttgttttttatgattctacattatgagtgcaatgtaatttacttttatatgtgcaatatttatggtagtttgctaaattgtcatcaaatttgatcaactacgatttacgttgtactattcatttgttttctcctttttttttctaaatgacaggtcgtggaggtcgaggatattatggctttaatccatttggtaagtatatatgcggttctatgagcaatgaccgaaattgtggcattcaagggtatgaatttgctgtgcaaaattgtggcatttgaactgcatatgtgaatgatgtcaaatcttgagatggacctgtgatgttggggtctgtgatgtttgagatggatctgtgatgttatattaggggggtgactggaatttacctgtgatgtttctatgtttcagagggcatggctagcaaatcctgaggctagctaatatttagcatttatttttttctagaattaacacatcagtgacgggtcgtaaaaaaaatccatcaaaagtaacctcacctctgacgtctgacggactcgcaaacataggcccgtcagaggtgacccacctgtgacgggcctttacttttgggcccatcacaggtgtgccacctgtcacagcttctatctaccggagaccatcacctgtgacggcctttatttggaggtccgtcagagatgtgtcacctgtgacgggtcctaattggtcctaggctagcggagaccaatacgtctgacggccttctagtaacttgtccgtcaaaggtaggtgtcatctctgacggccagccacccgtcaaaggtgactggacacaccagtgaccactgatcactgaccaagcccaaagccgtcaaaggtgagggtttgggcccgtcacaggtgaccttgtccagtgtagtgtggggcgcgtggtgggaacagcgcaggaggcatgggaagcagcgggcgcccgatttttctgtcgctgatcgggcgcccaatcgctggcattttccaaattaactggaagatttgccaaatttttttttattattaggtaggtatagatatagattaattggattggatcataccattaaacttgaggcagcaagtctctactattataaaaattaaagatgtttttgccagtattttgatacgtcagtaggtttttaagtttgttcgcttttagaaatacaaatccgtgtttgagttgtattttaagctcgttcgcttttggaaatacaaaaggagtcgtataaaaaatatcattaaaaaaacccgcacgctaacttgagatgaaatacagactcttgcagttatgattttcgaaaaaaaatatctaagtgaattcccacagtgaattttaccctagctaaaccgtataacaacaataaaattaaaataatatatacccattgcaatgcacggatattgtttttatagtaacacatacgtttttggacctagtccgatcgaggtagccagtaccgttctcacgagttaattattgtcttcatgggccaaccatagaaaaaacatggcaacacaggggatctagtctcgatcgatcatcgtacgtgtttcttaattcgtacttatatgaggagcagaattcagagggcaaggacgccacatgctgattgtgtgaatgcaatgcaatagtacatgcatcaacacgagcaaaatttggtatatgtggtgcactattgttgtgaacaattagtttcatgtgcctgaaagcaccagcatatactacgacgtacacctaattaatttactagcttgactttatatatccttggtatatatagaggctggattattaaaaatccattatctaaaaaaataatttactagcagacgtgaaaagggaaactcttttctttccttaacaagatatatcccttatttttatatgacattctcagataattataatttttcttaaaaaaaactagcatgatagatcaatatgagatatgttacttcacaaacacatgtaaatttaaattcaatctacacatatagaaacaaaataacaaatttcagtatgaatagtacacacttcacagttaattttttttctacttatacaagttaaatttgcatgtatatagagtgatatatcacatattgatctatattgttattttttgttttttttgatgattttataggtgatatctactacaaatatatatgcttggtaggggcatgcccaagtgtccattttatgatgggaatactccgaattcttgatttaaacatcgctcatcatacggctctcaaacttaattaacggaggacacaaagaaaaatccatggagataggtacatagagggagctatttgctagaagtagacaccacccgccctatgaagaaaaagtgacatattcaatcctacgtttttgttttttttttcaacggatgaagtactgtactggtctgtatcgtatctgctcacaaaagttgggacaggggaatgaaaaagccatcggtggaatcggagaaattaattcaataagttaatatgcacatctatagaaaatttaagaaatgttatctatgaacgtttaatttcaagaaatgccatcgtgcaattgatatattttgtcaccgaaatgccactgccgttaggattccgtcctctcgcgccgttaaatactctattcatcataagtattttaagttattaattaattaagacgacacttgcgcacactcacccctatgaacgcacacacgcacaccctacccctatgagcacctccagaagactgggccggtatatcttgagattgacgaagtcaccacagacgcctcgctgtcgatgggtacgtcacctaccattgaaagaataattagccgtaaatgcgagcacccgtgtcaaatctaggatttgaacctgggtaggctggttccaccacaagaaacctaaccagttgagctatgctcacttcgcattgttcaaactataattaagaccccaaactgacgcatgttatatatatatatatattatttatttattaaaataataagaacaatagtccagtttacacctacagtggcgaagccaccgggggtgccggggtgggcctggcaccccccatccccatgcgctgcaaattaaccccccgatgattagccatctaatccatacaattaactcattagctagttgcaagttgagcctatacataactgaccaatagattttagctttatgtgattacctgagttaattaatgtaactaagcgatgtggttgcaagtctccaaaactaaaacggataaatagaaatgatgtcttgtcactcatgtattcagtaaatttggtgctatttagttgcctaattttaaaaaatgattcttttatgttatattaatgtgcattcggacatacaccttccatcctaaaataagttgttttagttttttacatgaatctagaagaatgtgttgaaatatatccaaagtcatatcaacaatcaatttatttacatattagtgcaaattaaccacaaaattcaaattattattatacgagggacgactacgtatattagagcgaacaagaggtgaggtgaggccaacatgccactcagcatgaactgagccatcaagatccacaccgttgtctatcgaagcgctggcgagttcttacatttcgtggctagcacccctattactaaattctggcttcgccaatgtacacctatatatatcttcgatacccaattaaagttaatttagttaagtggaagctaattaattaagtatgtactatgtaatttaacagtgaaataattaagtgtgataccggccatcaaagataaacagtaaactaattaatgctctagaaaaaatggtgtgattattatttaggccttgtttagttgggaaaaatttttgggtttggtcacatgggcggacacatatttgaagtattaaacgtagtctaataacaaaacaaaaactacagattccaccagaaaactgcgagacgaatttattaagcttaattaatacgttattagcaaatgtttactgtaacaccatattatcaaatcatggtgcaattaggcttaaaagatccgtcttgtaaattgctggcgcgtacgcgtgtgctaggatccccataatcctttactttgatttaggaagaacaaggtatacaggcagtcattattcctcaagagatttaaaatccattccagtcacaacagatttatatatgttaattacaacacaaacacaataaaaacgtatttataataagataggaggatcacatctagaagagaaattgtggcccgggccggcgtccttccacttccagttccagcgaggatcggccactcgcagctcgcgcgatccacagccacactacgcctacgcgcgccgagcaagcaccttgagcgaacaacctcgtatgtaccactgccacccgcaccagcatgcatcgcactcacggaccacaatcgtctcctcttctagctagcttgctaccacaatcatgcatataccagtttgcctctttttttttctggggaaataaattaattagttggccttgaattatcatcttatctgtcatgcttgctttccaacaaatagattcggacttggcgatgcatcttcttgcgtggcttgtctcccgtcggatgatggtcggagcgcacgtgatggccggagtacagagtgagaagggagagatttttgctccactgataaccgacccgttttctatttttttctgagaggaccaaccaggacctagaaccaacctgatggacggtagagacacggcaaacacgttgaacctgaaaccgatggcatccacgagatgacggacgatagaaaccttgcagtactgatattttaagtaggttaagattaagattaagataaagataaaagagcaaagtatacttttagttaattaaatttattagttgccatgtcaatggttagcaacacttgataatgactacaagagccgccaccggatccacgctagagggaggcggtgaaggaggtggagcctgactgccgaggttgcccagctagccgctgccaccgttgcccgctagaggagaggagagtaggggtgaaaataatagactggataggagaggtgtgagaagagcgggagagagagagaggagatgaggtgaaaaattcgaagtgccttagagggaaaagagataggagaggagaaaaaaaaaatctatagaggaggtattttcgcttgcggaccacttaagaagtctgcatgcaaaaatctatttttgcattcagttctttaagataattgcatgtgtaaataggcttatttttacatgcatccacttaataggtctgcatgcgaaaatcgatttttgcatgcatacctcttaaggagccacatgtgaaaatggaggtcgatttttgcatgtgaaaatggaggtagattggttgtgtcgaaagcacaaatttgacgagcgtggttctcccagctgacccaggttttttcccctcctgctaccctccctgagattttgtcgaaaacaggctgcaagttcatcttccgcaacctcccacgtactaggggaagccctaggtattttagagggaaatttgccctcatcgctggaacaccatcaaggacacccgtcaagtcaatgctatcacatctgatggccgctactgaggatttctgaaggttggttacaaagcggtccaaaatgtccgcgaaagcttttacatcgccttgggtgggattaatgaagatgacgacattgtccgcatacgtcaagatccgtagtcgagtcgttctaccccgtagcttcgaaattgcgcctagctctgtttccttggaaaggattctttggaggaagctaaatatttatagctttgactagaaaaaatgtccgtgcgttgcaatgagtaaagattacgatattagaactgagcaataaattgaaacattacgatcgctatacattataattgaaaaagttaatgaaaatcctatcttcctatatagttggtacccaccaaggagaatttactgctataaaacaaggcatgcaagaagccacatcatcaataactctaagccatcggatcgcattagtacatagttatcagtcgttggatcaagaagctactcatccatctaattaatcattgattactcatcctgtcacctccctttagatcataatcacgcgtgacattgttatccattctgcacataatactatgttttctcctcccaagtcttccaagataatgcaaacttatctcctttatttagtacaactcaaattattgtataagatgtgagttttgttttgttacaaacaattgaataacatagagtaattatgcatcattaacccaaaccaatttttgaaacaagcttgagataaagcaaagatgtgcaaactaccctaattatgacgatatccgaattgtgcatgataataactttcgtatatcataacaatataaaatgtcgttttttttaaaaaaataaaacatgaattgtattgtaatagcaaaggctatatatgaagccacattatcatttattttatatatatatacagattaacatctaattattcaaaacattaattttatttgacgataaaactagcaaatcccgcggcaaggcgcggggtgccaactagttctttcttagttttaggccagaagctcattctttcattcctttttaatcatacgctagttcgctactcctttttagtcctacgctagtccgctacctccctctgcttgaccttcctccttctgcccatctcgaatagccgactaccgccttcaacctcccgaagatagtcccgtacccatacgatgctggagctgatcttctccgtcaaatccggccgaatgtttcttgatatccaaaattagttgagagcttttgatccaccgatcgtttctttccctttttcaaaaaattagagcgtaaaacccgggataaaaaagactaggaagatcgtggagattaaatccgacgaattaaagccgaatcgaaagggaaaatcatgtagaaaatgataagcgagtaatgaggaattgattttttaatcaactgaaagaagaaacacgcgattgatatggtggcgaaggggaggcgcgctgtggaacagatcggttgatcggaaaaaaaacgggggggcgccagcagcgagcactccccctctccccttaagtcttaactactatactagttaatatagttaacactaatgatagtaactaggaaagattctggagatattttggagatttttttactaacagattgaaaatattttaagttagatttgaaaactttcgatttaagttttaaattttatagtcaaattttaaaaacttttagctcagatttaaaaactttcaacttgatatttgaaaactttcaactcgagaatcgagattcaaaaacattcaagtccagatttgaaaaatttgaaaactttcaaatcgaaatttgaaaattttcaaatcgagattcgaaaacttccaaatcgagatttgaaaattttgaaaactttcgactcgagatttgaaaactttcaagtcaagatttaaaaactttcaagttcagatttgaaaattttcaactcaaaatttataaactttcaaactcaaaacatgctaaagattaaaaaaagttagaaaaaagtgggaaagaaaaggaaaaaaaggttaaaaaagaaaaaaaaagtgcggagaaggcgcacgcgccggcgcagggtcttctgggcctgaaacgcgtgccgccggcgcgctcgctaactagcattctcgaaaaaacagattgacacaaaaaaaattgcaacaaatcggtttgaatcggaaaaaccagcggcaaaaaaaaccaggctgcgtttttttattaggttcggcccgagcggcggggagccggggaggcgcgcggtgcatcggtttggatcaggaaaaaccacggacataaaaaccggacagaaacaacaacggatcggttcgattggaaaaaaaaccagcgaaaaaaaggacggtaaaaaggacccagattaagaggaagctttgcagaaagtttttattatttttatttggtaggtatagatatagattaattgtattggaccataccattaaacctgaggcagcaagtatatatacgtttgtggactagtccgagctagccggccagtaccgttctcacgagttaattattttcttcatggataccatagaaaaaacttggtgacacaggggatatcgatcgatcatcgtacgtgtttgttactcctagtttctaaatgtttaacaccgttgacttttttaaatatatttgaccgttcattttatttaaaaacttttatgaaatgtgtaaaactatatgtatacatgaaagtatatttaacaataaatcaaatgatacgaaaagaattaataattacttaaattttttgaataagacgaacggtcaaacatttttaaaaaagtcaacggcgtcaaatattttgagatggagagaataattcgtatcaaattatatgtggagcagaattcagagggcaaggacgccacatgctgattgtgtgaataatgcaatgcaatagtacatgcatcaacacgagctcaatttggtatatgtggtgcactattgttgtgaacaattagtttcatgtgcctgaaagcaccagcacttccgttcaaaaaaaagaaagcaccagcacatactacgacgtacgtacacctaattaatttactagcttgactctatatatataataaaaattcattataaaaaaaataatccctccagtttttttatatgacattggctacttcaaatttatactagccaacgttatacatatatgcatggaagtagtaatttagaaatgtgaaactcttttctttcttaacaagatatatcccttatttttatatgccattcagataattataatttttttttgaaaaaactaacatgatagatcaatatgagatatgtcgttatttcataaccacatgcaaattcaaattcaacctacacaaataggaaaaaacaacaaatttcagtacgaatagtatacacttcagagttaattttttttatacttatacaagttgaatttgcatgtatgtagagtgataaatcacatattgatctatgttgttgattttttttccaaattttttgatgattttataggtggtatgcataaaacgagaagatatcccctcgaaatgaaaatccacctcccatgtgaatatctactacaaatatatatatatatatatatatatatatatatatatatatatatatatatatatatatatatatatatatatatatatatatatgcttggttggggcatgcccaagtgtccattttatgatgggaatactccgaattgctgtttctttcttgatttaaacatcgcccaatcatatcgctctcaaacttaattaacggaggaaacaaagagaggtccatcgagataggtacatagaggaagctgtttgctagaagtagacaccatccgtcctatgaagaaaatttgatatatcataatacaatgaatttgaatatgtttttatccagattcattgtattaggtttaatcacattcaatcctacattgtttttttacttgaatttgaatatgtttttattccgattcattgtattaggtttaatcacattcaatcctacattgtttttttacttgaatttgaatatgtttttattcagattaattgtattaggtttaatcacattcaatcctacattgtttttttactacggatgaattactagtctatatcatatcctcctcacaaaagttgggacagggaagtaaaaaagctgtcagtggaatcagagaaattaattcattaaattaatatgcacatctatatatttagagaaaatccaaagaaatgtcattggaagcgttcaatttcaagaaatgccatcaacaagtacatacatgttccatgaaatgttattgtacaagcgattttgtcctagaaatgtcaccgccgttaggttcccatgcatcccgcactattcatcctatatcatttaacggagggttgctaatagaaccctaacagcgatggcattttatggaactcacactggttgatggtatttttttggaattgggagcttgtcagtggtatttcttggattttcacatccatttaaattcaatttcaagaagagcacgtagtacgtttcgctaattattgaattcaaatttttggaattgataacttaagtattttaggttattaattaattataagacgacactccaatacatttaattacaactagggtgctatcctatatatctataaagttcatccccactaaatatagtagtgctaattttctcttctctcataaagccacatcacataaattgtttttagcctttggataattcatcaagggtgtaaattgcatctcttccctaaaaggcacaccatacaactcaaccgtttataacctatggataattgataaaaattaaaaaaaataaacatatgaaaaataattgtatattaagtaagaaagaaaaatttggaactcatatctactatgttctcacacaattctcctacagcaacgagcgaggtacccatctagttcattctaattttttgaattgttaaatatattgcgcaaaatataattaagactccaaattgacgcagtcttatatatattatttatttattaaaataataagaaaaatagtccagtttacacatatatatatatatagtaaatttgtttggtgctccatggtgcccggacaccattgttgaaattgagtatatacccaattcaaatgagtataaaactttttcaattacttaggtattaacattaactactttactaactagtttaaagcaagtttgaattgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaatatttgaaaaatttgagtgattttgtgcattagataccatggtgccatatatatatatatatatatatgttcgatacccaattaaagttaatttagttaagtggaagctaattaattaagtatctatgtaatttaacagtgaaataattaattgtgataccgccaatcaaagataaacagtaaattaattaatgctctagaaaaaaatcgtgtgattattatttacaaatgaagcagtcgtcacatttgttgtttgcaggtgacgtaacgtggatgtctctataagaattgacttgtcaaatttgtaagaaccacctgacacctgtctagcaacctgcatatcgtcgtggtcgtagtctaactacgcttgggcctagtgtatacatgtagggagatggattttcatcctcgggaggtgatatcatctcgttttcttatatgctatttataggttatgaaaaattattaacataattaatataaaatatatcatttcacaaaaatacaagacaaatacatttttttacaagttaaaaggaataaaataaattgaaaatagttaacacatatttataattatttttcttacaatatatgtatattatatccgtattaatagactattatttatatccgtattaataaactgaaaatagttaaatacatttagtggttaaatgtatttatttattaattaattgaaatattattgattaaaaattaatattaaaaattttggggaaaaaatatattttagcgcgaatatttttccaggtagctagactagcattttcgtaggcggcacatcatgctctcgttcacctaggaaaattgatcttcccaatcggatcggccggctgctgattgttttcgcatgtctttgcctacaggtggactggccgtccgcctaggaagaccgttttcatcagtgtagaaaaatggtgtcaaattttttgaaagaaaaatattgataaatgcatacgcagtccctatatggctatatatatggtggtaaactggcatgtacacatgctgttgtgagtagtgattagctaggcggctattagcagcagcaaccagttctttttgcgtatgatagatgatgcagagtgcagctggagcaatggagctgctggtggcgtcgcaagaagcaggcggcgttgtggtggtgggcatgaacagtggcgacgccggagagctgagctacgccaacaactcggacatgcagcggacgatcgctgcggcgacgaggaaggagcggcaggagatggcggcggccgttcggcgcggtcggcggcaggcgagagccatagccatcgccgacctcgggtgcgccacagggccgaacgcgctgctgatggccggcgacgccgttgaggccatgctgggcgacgcggagcggcagcaggaggcggcgcctgcagagttccacgtcttcctcaacgatctccccagcaacgacttcaacagcgtgttccggcagaagcagaagctggtggtgccgagcaataatgccaatagcagccggtgcctggtgtcggcgtggccggggtccttctacgggcgcgtgttcccggcggatagcctggactacgtggtgtcgtcgtcgagcctccacttcctgtctagggcacccgcagatgcggcgcccaacgaggggaggatgtacgtgtcggcgtcgtcgagctcgagctccagctccagggtgctgcacgcctacagggctcagttccaggccgacttccgcctcttcctctcctgccgcgccgaggaggtccgccgcggaggcgtcctcctcctcaccttcgtggccaggcgggaggcggtgccctcgccgcacgactgccacctctgggacctgctcgccgaggccgccgccgacgacaggaggctcgtcgactccttcgacgcgcccttctatgggccctgcccggaggagctgagggaggccatccgcgaggaggggtccttccaggtgacgaggatggagctcttcgaggtgagccgctcccgctcatgccaatcccaagcagatctagatcagctggcggctcagacaagcagcaccatcagggcggtggttgagcctatgcttggaccacacttcgggtgggacgccatggacgccctcttccggaggtacacccacctgctccacaattactaccgccacaacaacgaccagctcaccaacgtcttcctcgccttgcacaagatttgacttcattcatcccatccttccttccttcaaccatatatatataccacattccctacagtatcagtatgtattactgtatttccaaaacgtacctacaatatataccacgtgtcagttctacgatatatatatactacccggataaaatgatagtatcgtttctaaaatcgggataccaactgtttcatgtactagacaatatttaaattcaaaactatttaagtgtatttgtgtttatgtatcttcaaaatcaatcttaaataaaattattagaactagtgagtggctttctcttgacaaatgtctcttttcatgtactattctatttatttagaatggctatatatatttaatataaatattaaattaaacttaaaaaaataaaatattatatatcccgatactacgatgcgattaaacaatccgatactactcaccttctacatgttcaaagtgtatagtacaacttccattctagcagtatattatatactagtatatatctgttcaaagtgtatagtacaacttctcttctagatgtgatcctcctatcttattataaatatgtttttattgtgtttgtgttgtaattaacatatataaatctgttgtgactggaatggattttaaacctcttgagggataatgactgcttgtataccttgttcttcctaaatcaaagtaaaggattatgggggatcctagcacgcgcgtacgcaccagctggaccccgtccccgcatccctcttttttcgcacttttttgacgcgttttcttctctttttttcgcttcttcctttttttaatctttcgcatacctctttataaatgtagaattgaaaatttttaattttgacttgaaagtttttaaattttagttgaaagttttcaaatttgagttgaaagtttttcaaatttgaaataaaaagttgaaagtttttcaaatttgacttcaaaaaattcaaaattttgagttgaaagttttcaaatcactagttgaaagttttcaaatctgagtagaaagttttcaaatctcgagttgaaagttttcaaaactcgagttgaaagttttcaaattttatcttgcaaatttaaatttcaagttgaaaattttcaaagtttgagttgaaagatttcaaaatttgacttgaaagtttaaatcttaagttgaaagttttcaaatctgacttgaattttttcaatctattagtaaaaaaatcttcaaaaaaaggacaatcttatcttaattagtgtcattatctaaaactaacttagttagttaggcttaactactcccgtctctcgtgaaaacgctcgcgacttgctgatctcgcgcgtgcgcgcgaattagccatctcgacgtttgttactcctacttggttcctatactgatttgtatttcgaaaaggtttttttttggaaggacaaaacctagatattactgcggagagaattaagcagtttgtattagaggagaaaatcgttgtggctgatttggccacgtcttgcgatgcccacaaaaataggaacaaattgtggttcacatggatggtccgctagtagtatttctgcttgctttttgctcatggaaattattaaaggactaagcaactggacatttaaggggtggtaactagcaagcatgaagcatgggctaactcgaaggggcgcagctaattcgcgcataagcgcctctatgttaactcgcgcgcactaccacgtggcacatacagcgaatcctcccatcgcgcgattagcataacggtgattatagatctaattacggtgctacagtaatttctcaataaaaataattcatttaaaaaattcgagttgaaagttttcaaatattgactttaaatttttcaaaatacaatttgaaagttttcaaatctgagttgagagtatttcaattttgagttgaaagttttgaattttgagatgaaaattttgacttttgagtaaaagatcttaaaatttgagttgaaagttttgaattttgatatcaaagtttttatttttgagatgaaaattttgaattttgatttggaagttttcaaattttgagttgaatgtttcaacagtgagttgaaagctttaaattttgagatgaaatttttgaattttgagttggaagttttcaaatttttagtttaatgtttttcaaccgcaagttcaaagtttttaattttgagatgaaaattttgaattttgagttggaagttttcaaaatttaagttgaatatttttcaaccgaagttgaaagtttttaatttttgagttaaatgtttttaaatttcaggttaacaattttattttttttgggtatgacttctttttctagagagttttaaattttatgtatagatttttcaaatttgtagttgaaaaggaaataacctttatgtgaaaaagaaaaaagaatgattcagatcgtgattatcaaaatctaattacgctagacatgatcttatctgatatcatgcgtacgtgcgcgtgtttctaccttcccggtgttgcgtggtaggccgggccgaaacagctgtgtgaggtcgtaggccacaaaacgcgcgtgacttagcttgctaacgcgtttgcacgacacagcgacatctattgcggcaaaaaatcaagttcgaaatcaaacaacactttgagaaaaaaaagagaaactaacatttatttaaaaaaaatcataattatttgggtggtatttcaataaattaacgaggatcagaatagttccccttcctatcagttgttgtttttccttttaccttttgtcaaagtgtatactttatccgttataaatattacttatatttaaaaaaacatatataggaataatgaaatattactatgaaatccgtcattaaataacaggttcgtataattaaaggaggctctatccccgatatggaataagttcatctgaggtcccttaacttgttaacgaatctgattttcgtccttcaaccaataaaccagatacaacgggtccctcaactgtcaaaaccagtgcagattaggtctctcggcggttttggctgacatgacgtttatgtggataatttgactcagtcttcatctgacgtggcattaacgtggcgcttacgcgccaatttgatattgaaaaataataaaccccgtgggacccacatgtcagtttcacacataaattaattaaaaatgatggggcccacgtgggccccacatgtcattcccactcctcttcttcttcctcctctctccccatcccctctcctcgcatgacggagagtcagctactggggtgaatcggcaccaccaccaccacgcggctgcgagaaagcggcggcggcggcggcgctggtattcccgtgcggcggcgtcggcgacgagcccaacgtgtcgcggcgaggcccaccaagcgtcgcaccacgggaataccagccgacgcgcccctcgcgcccgcgcccccgggacggcagcctccgagcgcgcgccacctcgatatataccccactacccatgccgccaccgtttcaccgctctctctctctctctctctctctctctctctctctctctctctctctctctctctctctctctctctctctctctctccaccttggttaacctgagccgccgggtgcttctgcatcgcttgccgtactcaatcattcctgcgatggcatctcgaggcgccgtgttgctcgccttggtcgcggcggtggccctgatgtccgcgtcggtggcgtcggcgcaggtggacggaggcgtgccgccggcgccggcacggatcacgagcgcggccgcggggggcgcggcgtcggcggcgctggccgtggcgtgctatgaataaagatggatcatgtgtctcgtctcattcgtcactaatttctgtgtttcagatcttagctattaacgtcgacacaattccctttttgtgtttcaaatcaggctctcgatttcgaacacaattcgatttcacgtcagtgatgcactgatgcctcgtaacgcggcggatgagttcccattccgtctgtcccgaaggcgctgcgagcgccgagcggtgggtcctgggacgctgcggcgctgccgttcgggtcgtacctcacgccggcgacgacgagaacgacagcggcgggttgtaccgcacaccgggtccggctactcgtcgggatcgccgccgacgccgccgcaccggaataccagcgccgcctccgcctccgccgccgccgccttctcgccgtcgtgtggtggtggtggtgccgattcccccgggccgatgactctccgtcgggcctgcaaagaggaaaggggagatggggagagaggaggaaaaacaagagtgggaatgacatatggggtccacgtgggccccatcattttttattaatttgggtgtgaaactgacatgtgggtcgcatggagtttattagggcgttcccaacccaataactaggatagtgtccatagcattaaataagttgccacctatgacaaaaaattgatgtggcaagtgaataaatgagaaaagaaaagaaaaccatgtcttgcatgagacatggtttctatacaacatccaagacatcatgtgagataagtagcattaaattgaagtatggaatagtggtgtttacattggaagagtagtgtctagtactagtttcttgatgatatggagtttatggaaaccatgtctagtgttatgggttgggactgcccttatttttccggatcgacttgccacgtaagcgccatgtcagataaagaccgcgtccaattaaccacgtaagtgccacgttagacaaaaccgccgaggaacctaatctgtactggttttgatagctgagggacctattgtatctggttttttcggttgaaggacgaaaatcggattcgttgataagttaagggacctccgatgaacttattcccccacattgtggtgggatacaaaataaacattttccatgaattttgaccgtgttaatatctattgggccaaacggagaccccaagccttagcccatttctacgtccgccgcccgtatgtggacgcatcacgtctgatctactctctgttgttccattttaaatatagggtccgtttagattggtaccaaaataaacctttgataaattggtaacattgtcaaaattttaataggattatcttaataatgttgtcaaaattctatacatattgccaatatttggtaacaaactaaacgtagccatataattatcaattttaccaaataatggtatgattgaaaatgtcatcaatctgaacaggcccatagttgtatgtttatgtgtctaatatttcatcattcgtcttatttgaagaatttatataaaaatagaaaaagtcacgcataaaacactattcaggttttatatgctaataacaataaaaatattcatcatataaaaataaatgatatggacgatcaagtattagatataaaaagttataagcaccgcacaaaatgagatgaagagatgaggtagcacgaggcatcttcttgacatccgtcaatcctctttttcctccgacaggttgaggtggaagcctgcctgcctaccatcgacattggccatgcatggctgctgcggcaagctcaagtctatgtaaaaacattttagcacaaaataaatatatttaaaaaatacatcacgcacgtggcctacggggggcagagttaggcgcttggaatattgggagttcatctaattgtaaatttaatgaaactaattactttttttattgcagatattgttacgttctgtaaacttggtaaagtttaaaaagttggacttaaaaatataaaacaccgtacaatatgaagctaactaggagtagtaattagccataactcaatttatgcctccttttagaagtttaaaggatttgtggagggattgcaatatttctatatgaaaattttctatgtagtcttttgaaacatattctcaattcatatgacatttcataggaagggctcaacgagggtagattttttaggaaaaaaaacgagagttttgacctgttgaaaaaaattctctaaatctatctctggatggttatttatgtatttttgttgtatttttaattatctattttgcgtatacattagatataaaaactttgtgattttcctatttttaattaattgtcgcgtgcgaagggaccttagtggtaggatgatgatacatacccctccatttctaaatacttaacaccgttgattttttaaaatatgtttgactgttcgtcttattaaaaaaaattaagtaattattaatgtttttcctatcatttgatttattgttaaatatacttatatgtatacatatagttttacgtatgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgattttgcgtgtgctgcgtgaagacggcaggtcggtttatatagagaagggtcgcttgatcagggcgcccgcacgatctttactgcgcgtaaccgaaccggataagtcgcgcgtaacttatccggactccatgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccaggccaggccaggcgaggcgaggcgaggcgaggcgagcgagcgcgcgcatgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaattccaagctacacttactcacaacttgaacaatggactacgccttgaattacaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagtcaacagaactcattaaggcatagccaacctgccttgcagctcacgagagtacatgcatcttcacttggagagggtatatatattgatactctcctctagtttactaatggtttgttcttctcaggatctaattcacgggatctccgatcacatagactgggttaccaccatagtataactcatatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccacaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagcgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacttacaagcacaaaataactccctcacccccaccatggcgatagtacacacatttatttgccttattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctaggaaagtagcacacgaattgtggtcaatctagcaacaggtgagtaagtgtcaaagaaatattcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagatggttggttcgaaccactatgtgtatccttcattgggaaaaagctctcaaagaagatagcatcacgagactccataattgtaccaacatgcatgtccgatacctcggatttaactactaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcatctcatgtatgatgccatgttcctcacagaataagtcaaactcgttcgagaaaaactctccaccatgatcagacctaagcctttttatctttctgtcaagttgattttcaacttctgccttataaattttaaaatagtctagagcctcgtctttcgttttcaacaagtacacatagcaaaatctagtagcatcatcaatgaatgtcatgaaatatcgttttccacccttcgtcaacaccccattcatttcacaaagatctgaatgtaggagttctagtggtgccaagtttctctcctcggcagccttgtgaggcttgcgaggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccctagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacattaagagacgcaatcaacccctcaacggagtattcctgtctcttgtgtttgagtgcagtaccgaaactcctccaagatggaggtagttttgcaataatgcacccggccacaaagttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcgacaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgattttgcgtgtgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggccaggccaggcgagcgagtgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaagacccattcattaattccaataacatatttcataaaattttttgaataagacgagcagtcaaatatgttctactatagtagctaaatatttagaaacggtgggagtactactatagtagctatagtagctagagtagatgtgttgacaagggattgagtgagtgcgttgtaacggtgggcatggagtggccttgtagctaggcttatcatgatgattgatgatatcggagtagaatttatcatcaaggcccaattaaggggcagggctcgatcagctgtttgtgtagttggagcgcgcggtggaagatgaacaagctcagcaacctagctagctagtcgtataccgatcgatcgatcgatgaatatggagtccctggcagcaggagcatggtgggtggttgtgcttcttctactcgtccttacaattgtggcctcctggtaccggtcatggtggaagacgaccgaagcgggggggccgctgcttcctcctccggcagctggtgcaggtccatggtgggtgtgggtgtggcagtggcgggagacggcggccttcctggcctcccatggcagcgggcggggattctaccacttcgtgcaggagcgctacaagttgtacaagggggagggggagggggaggcaacctgctgcttccgcaccgcgctcatggggcgcgtccacgtgttcgtgtccgcctcccaccccgccgcctcccaactcctcaccgccgaacctccccacttgcccaagcgctacgcccgcaccgccgccgacctgctcggcccccacagcatcctctgctccacctcccacgcccaccaccgccacgcccgccgcgccctcgccaccaccctcttcgccaccccttccaccgccgctttcgccgccgccttcgaccgcctcgtcatccgccactggactacgcttcttccgcctcataatcaaaaccaagtcgtcgtggtgctggacgccgctctccacataagctaccgcgccatctgcgagatgctgctgggcgccggcggcggaaagctgaggccgctgcagagcgacgtgttcgccgtcacgcaggccatgctggcgctgccgctgcgctggctgcccggcacgcgcttccgcaggggcctgcacgccaggaagcgcatcatggcggcgctcagggaggagatggcggccagaaatcaccatcaccatcaccatcaccatcaccacgacttgctcagcgtgctcatgcagaggcggcagcttggccatcccgacgccctcactgaggaccagattctggacaacatgctcaccctcatcatcgccggccaggttaccacggccaccgccatcacctggatggtcaagtatctcagcgacaaccgcctaatccaggacaagctacgggtcaactatcttcttctttctttctttctttctttctttcttcaaattttcaattcaatcaatacacttacataacatataggagtacctcacatacatgggcataattaattaattaattgtactgtgcaggcagaagcatttcggctggagcttaagggtgattattctcttactatgcaacacctaaacgccatggactatgcgtacaaggtaggtactccttctcccctgcatccccttgctaattggagtagtactagcaagcttcttaattaattattcctacttcttactgtaaagcttaacttcagctgtgagtacataatatttcatcaggcagtgaaagagtcgctgaggatggccactatagtttcctggtttccaagggtggcgctcaaggactgccaggttgcaggtgactggagtagtatcttacagtatactattattaatgtcttgctcaatacgaattcaaggaaattaattaagcttatactactactctctccgtttcacaatgtaagttattctagcatttctcacattcatattgatattaatgtatctagacatatatatttatttagattcattaatattaatattaatattaatgtaggaaatactagaatgacttatattgtgaaacggagaaagtagtacacttgacatgctgagtaattttgacattgcatgtatgtatatacagggtttcacataaagaaggactggattgtaaatattgacgccaggtctctccactacgacccggatgttttcgacaacccaacggtgtttgatccttctaggttcgacgtacgtacgaatttctttacttgcttggttgcctctacatttttctactatctgaatctgaattaagcaactgttgtagtgtctgcaggaagagggagagggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8783 - DNA, 382 bp, Oryza sativa
ctgcgtgcccttcgacaggctcagggtgcgggatgtcgtgctcgctcactcgggtcttcctgtcaggggtttgccggtctcgctcatccgcatcaggtcgcacgccagctgttcgccgccgctcgggctccgggtgatgagcaggatggtgtcgtcgccggcgatggtgccgagcaccgactcccagccgacccggtcgatggcggacgcgaagtactgggccgcgccgggcggggtgcgcaggaccacgaggttggccgacgactcggcagagaccagcacctcctggcagagccgcgccagccgggtctcgaaggtcgcgaactcccccaccagcggcgtgcggtctcccccgtctccggggacggcgtagacgaggtga

SEQ ID NO: 8784 - DNA, 1887 bp, Oryza sativa
ttcccggtctacaccacgatgccgatctcgactggcctagcaattaccgggagcgagaacggcgtggttacgaccctggtcgactctatgtcgaaagatcctcccgcagaagcggagaacggaacatcgataacatctgagcctgagaaggatcctagtgcggtcaaatcttgtccttccgacaaaaagcacgagccgacaaggacaacttccgaggacgacacagaagctgagaagataacccgacaagccaagatctattgtatgatcggcaatgatctgtacaaaaaggcgccaaacggagtacttctcaaatgcatctcgtccaatgacggcaaacatctcctcctgaacatacacgaagagatctgtgggtcacacgccggcggatggacgctggtaggaaaagcttttcgacaagggtttttctggccgacaacactcaaagatgcctgcgatatggtgcagcggtgtgaagcctatcaatttcacagcaaacacacaaaattccagcgcaagcgctccagactatccctctcacttggccgttctcgtgctgagggctcgatatactcggaccattcccacgaggacagggtggctacaagttcctattcgtggcgatcgacaagttcactaagtggattgaagcgacgcccacaggggaaattaaggccgacaatgccatcaagtttatcaaagggatgttctgcagatatagattgcctcacctcatcataacaaacaacagctcccagttcatcagtgccgaattccaggattactgcattggattgggagtcaagatttgctttgcctcggtttctcaccctcagagcaatggataggtcgaaagggcaaacggaagagtactacacaggatcaagacccgtgtctacgacagactcatgtcacacgacaagaagtgggtcgaagaactcccctctgttctatgggccgtgcgtaccacaccgacaacatccaataaggagacacccttcttcctcgtgtatggcttagaggccatgctccccacggagctacaacatcagagcacacgagtacataagtactccgacgaggaacaggagcagcgaagcgacgatgtgaatctactcgaggaacatcgagaaagagttgccgttagagcagccagctaccatcaggcccttcgccgataccacgagaagcacatcagagcacgcacactttcgatctgcgattacgtcctccgacgggttcaaagtcaagtagggcgcaacaagctctcacccaagtgggaaggaccatacacaatcacgcaagtcttgcagccaggtgcattcaagattgcagacggcgatggtcgcgagttagtaaattcctggaacattgatcaattacgtaaattttatttacaaatcaatagtctcaaaatttgtaagtcatattacgatttcaataaagttgatttcaggttaagaatattgtcagagtgttccttcccgacgatcccttaccacgacgacacctagagttgaaacctatcctcatgtccctttacgccgtcctggcaaggcctctgaggaacctaagggaacttcagctagggacgcccagagcggataaggccttgtcggatcatgtagagacaaacgaccatgtatgacctggtcatgtaagagttctcgccatgcgtattaaccaagccgtgtaatcggaaattgagttttccaacttcacggctgggggctagggtcagtgcttttttcaaccaaggcaggtcaagggtctaaaagccttgtcctccgagaacgattctccgacaaggctaggggctagggagagtgtatagctcaagtgactgatcgaaatcacaaagtgagaaaacactcatacacaacatgc

SEQ ID NO: 8785 - DNA, 1791 bp, Oryza sativa
caagtatttcttacaagtcataaatacttcaaagtatattacatgcttccttgagatatttttctacataatacaaaaactaccagacggccaacgccaatccatggagcggatctccgcaggaccgtcgatctccgcaggtgtcctccgagaacgcgagaacccttcgcgaaggaactcgagatgcagctgcgaacgatgatctcggatgcaggctagcacatgtcctctggcatagcggctcgctcgacgacactcctgcttcagggcatcgtcgatgcgctggccaatcccttcgagctgtgcgcaagcctcattcaaccacgagatataaccagccgccgactcctcgggatcttcgcggggaactcagagctccatgcaaaccctcgccatcgacgtgcaacagctcctgaggtacgagttgaaccacacctcgtgacccccggagagcttccatggcctggtccttcttcacctgcaccatgatttttttgagttccaccacctcgagtttcgtcttccaatatcggattcgacgagctcggtcagccaacatgttcttgaaatctgcccgacacggaaaagactaagtcaagctattcttctcttccgagaacacagctaattaagtcaatccgaacacaaggagtgaaggagagcaagatacaaacctagcaacgtcatcgccatgtttgcctccgcggacgggccctgactaatttcctcccacagcacgaacggctcgagtgtgagcgccggaacgatcaccggcatatcgggctgcccgtgctgctggacatcctcgacatcaatatatctacaacgacaacaaagtactcagaatcacatgctaaggaaacaagggagacagtgttgacggtcgttatcaaacagtttcgaccgtcaatattatcaaaataggagagaactagtgatgcttgcaatgcatatgtttgttagaataataatattccactagtattaggtatactaacctttttgtagagaatgacactaaagtggaggagaatcgacatcaacatagacgataaatcaatcggacgatgtcgagaaccagacttatgtatgaatgggccaagaactcagaattgacacgatgaattgggccaaaattcacaagtctacaaagtgaagcaatagaggaagtcgccaaccgaagatgggctggtttgggccagcccatggttcagccaaaccagggggttcggtgtcacgtcctgataaattcatcccgaaataaaaattattttctaaaaggaataatagaattaattaaaattcgaaaagaatttggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgattttataaaaagaaaagccctaaaaaagttccctttccctccccctctccctcttgggccggtccggcccagctccctccctctccctctcctctccccgcggcccattcggcctcctctccgcgcgcgcgccgctgacgggcgggcccgcccgccaccctcgctgacgggtggggcccacctgtcatccctgtcctcccgccgctcccgccgcctcgtccgcgccctagcgccgccgccgccgccgaatccgccgcatcccgtcgtccccgcgtgcaatcaataggggggaattattccccgtgatttcctctctctttccccc

SEQ ID NO: 8786 - DNA, 3795 bp, Oryza sativa
gtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcactttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgagctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtgggattgggtcggtactcttgtctatggctaggatgggttgggaactatgtcacgtcttccgtccgtataccgtggtggtatgtggcacgtggttacacatgaggaagatgtgtcttgtgggtaaagatgtacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggatccagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagatgtcttaggtggagtcttggcttacaccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacattcggccaaacccccatctccaccgttgaggccacagtttggcatggatgtccaagattgcaccccaatgacgtttggagggtacttcggacaatccccctttcacaactgtcataaccacctctatataaaggcttcactctcttcacttcaacacacaccttaagcaatggctctagtagcttttctcttctcttttgtaagatttgtacttttattagaatactcttctatatacatttatggtattaaaatactctccgagtatataagtacctactttacattatgttcttgttatactgaatatacggctagcttatctgggagatgctttggtacgggtacagtgtttgcttatgcaattactctatgtcatgacgatgatattatagtagtatctggtagtttagacgtggtgtctagattacgggatatcattatttggggttatatattgcggatgagaggtgggccgctgatggtgacagctcagtacaggtattcctccgcgcctatatataatcctaagttaatttcctggggagggtattcctctgtatttagccctagttgtatggtcatgacgggctgtcgtaaggaactcggcagtcaggggtggcttcttaaagtaccaggagagcatcggatagagggtattagctagtatatcagttaactagaatgtatgtatactatgtatattagaagtataggagtagatttcctttctcttttctttccacacagcttagatgatatattatgagaatgagtagttaatgcttgtgtgtcactctacccttggattatcttaacccctatttagaatatgattatcacaagtaatatataaattattagttgagttctctctacatgatcttcccacgggataaaataaatacgatacccttggaatactctagagtgaaatgctacaatggtatatccgtgcgcttgcggatgaactctgtaaccataatataccagaagtatttctacgccattgctgggaattatatttctagtaatgtcgttaagaaataccatcagacagttgttcagataagaatagttcggatccatagacaagttttacagcatgaaggttaaggggtacaagggaaaacaaatgtcctactcttcaaaaagggggaggacggactcccccaagtcaccgacttcttccatcgtatccttgcgtgcgtcatcagcggcccccagatccaaagccttcttaaggtccagatcgggatatgccagcctcatgcacgcaaggacatggcacgccccggtgtagatgccgttggacgtctcctccccgatcctagccgcgtgcttggatgtgatctcctccatcgccgtagccagctccacaagcgatgacgtcagcgagaactcatcgggatgcgccgggatggtagtcgtgacactacactccccggcgagttggtgcaggctggtgaatgacgttcgcagcgaaccgcagatgtcgatcatgtggccctcgagctcggacatccggtgctcgagtccgcgccgctgcatctcgttgccggccactagctccctcatctttaggaggtcctcgtgggcctccggccaggtcgctcgctagctagtcggcacgttggtttgccgatgacgccgccgccctggcctcctcgatctcgtgacctacgccgcgagcaccggcctagaggatgcgctccatctccgcttggagctcctcccaggtgagggcatcggtggacgggcctcgggtaggcatgaggctgacagcagggccactccgtgccgcctcctggtccttagtagcgaggtcgccgcaggggacacgctgaaagcggcatcagtcccaccttgtgccgtctttgcccgcgccgccctgt

SEQ ID NO: 8787 - DNA, 3459 bp, Oryza sativa
tttacttacttctcaccgatcgtcaccaacctttgccttcgctaaggtggaggagacgcgtccgagtcctgagtaagatgaaatggtatgagatcaagttgttccgactacgtgttagggaaccacaaagaagcttaccgtagagtttttcgctttccgacgggtccctcgtacggaggagaatttccttcccctctttgggacgttgctaccactcgtggtggcagcaacagcgtcagaggcctccttggcgatgctctccttcaacgacgctgccgcctggtggtccatgagtggcccgattacgtccgtcagagggagagcctgcacaacgtgaagtcacgacacgatctcgaggagaaagatgtaaaggaatcatcgagtacactgacattgatcgcagcggcgcgttcggccgttcccttctcgcaaagggggatcgagatctcgcccgtcgctgagggggcgctgatgatcacctgactgacgcggcgccccccggtgtcactgtctagacctgtgaatcgaaaacgagaactcgataagttaggagaaacagatggactcggaacaagattagaaatgcgagcaaaaatacaccgaggagagatccgggtcgtgtcctctggcccagagtaatcaaaggccggatgggcacgggcctgcagcggttgaatccgcctacctacgaagtcggcagcgacttcgtaccccgacaacccccaatttcggagatcatcgatgatctcgataaaagattggagggagggagtcagggcgggtttggcggtccactcagggattttgtttggttgttctttagggacaacaaggacgggatccgagttttctatctgaagatagaaccatctcgcccgccacttgctgtgagaagaggggcattggaaggggatgtaacgcgacttcagccgatcccgaagttggaatgcaacgcatccagataccctgttgggttccatccatcgcagctcatagtaaaagcggaatagatcaaggaagggctctaccccaatgtaggcctcgcaaagatgagaaaagatgctaaggaatgcgatggagttggggttcaagtgaagcaaagaaaggccatagaaattcaagacaagaagaagaaattgagaaggcggaggaagaaaaccgcaagaaatgtaatcttcaacgacaaccatgcggcctaagatgggtttaggttatataccacctgcctccctttgcatggtcccgcgacaagggagggcaccgtcgtcttgcagcttcctcaaggacgcggtggttgaggtagacttctcaagatccatcgccgtcggaggatcgccggagaacaagagggaagaagcaagctagggttttctttgcggagagcggagaagacgaagggcgctagaaggcaggagagttttctggcaaatggacttcaaatggactcccaaaatccctttaaataagcgcactaccgacgacgcgtattccaaggaaaggagagagattgctgccggaaaattctgggtccgttgcgcgcggtagttttcagacttcaatttaaattcactcatgaccgttgaacttcatgcggtttttgtcgatagctctttgtctctatggtttttgcactgagatcgactagatgagaacgacaattccgacatcagaagtcgcgatcaatgacatgagttcatttaagcagaagtcaggggctactgtcagggttacggataaggtataccatctacccttggatgtacgttgtatactgatacggtatacccgcgcgtgtacggatagtttccgtatacataaaggaaatctaacccgtgatagaaatagaatctatggacggaaagagttctactcggacaatactgggtctttactatatcgtgaggggtccgatatctccgagtcctacttggagatcaactgacccgcggtatataagggaccccctaggcaggacctaaggcatcgaatattactgccaacacatccccacagcctacggagctggagcctacaggagccaagtcgccaggccgggagatctagtcgtgccaactcgactgcgttctcgtcggtatcaccgagttctgttattccctttgtaatctgtggtttccatcatataatcccataccaactggattagggctattacctgctaagggacctgaaccagtataatccttatcttttgtttgcttgatgtcgtactacatagatcctcgtaccaacggatcccaatactctctatatccggtctatgggtatcccccgtcgacacttctaagctttattcctaactttcagtcatatcagataatatcttgagatatgactggtttttctccaactattttttatgattgcccaaaaatattaatgagcactccttttcctgtatttctcattttctttcttctcttaatgattgagaatattttctaccttccatgtcctttctttctttctttttttagccatattttattgcaagctactaatatgagagacattttaaggacatgatggaatatttatttggtggatggaaatgttgctcacacctagggtagaggtaaaacaaccatgataggtggaaggcatattttgttaatctccagtatatggtgggtgcacgtaagtgggtatcttggtcaagacagcataaaaagaagcaacatatgattatagggttattcaattaagatcatcatattattgaggaacttataaattttattcttttttaaaaaaacatatgctccggaattccagtatcacttagagaaagaccatagcaactctatttcacaaattcatatccaacaacaatctagatttagatcatgctttatgcaatccacaagtttcaaattcaaggcaaagattttttttgccaacaaactcaaaaactatagtgaaggttaggcagtaaagcactagatagaaataagaatagagcatctattcatcatttcaactgggaaaaattaaaacattcattgatgatggcagcagtgcacgttgccaagaaaccgttgctactgccaagtgattcaaggggcagtggctttggaggaggttactgcaaccagcagcgtgcagagactgcgactggttttcagttttaggattcctctgaaccagtagcagctgctgaacaatcatctgcagatgcagtagtaggtgtctagatcagtttaccgatcgatctgaagagaggtgaattaattacaacgaatgaaactacagattcagagaggaagatgagggaggaagatactgattgttccatttggatttattttgaggagttgcattgcagatagacaaacagaattcttgatgtaaccggtgcaaggaaagattcagatttcttcctatgtcattaatttataagtttttttgttttgattttcatgtacaagaatgtaaattata

SEQ ID NO: 8788 - DNA, 588 bp, Oryza sativa
atcgtggccagaaggatgaggcaatcaggaagaatcaatggtgtccttttggtattttcacaaagaatcagaaaaggacggtccagagattgaggagccgggagcgttttcaggaggttgaagaagaaatcaaccatcggctgaggaaaccaaagccaagacgggagtggcgtgtcaagaatcaggttcctgtagccgatgatgctgcagccgatgaggtaaagaggttggcaaaagggaagagtgttatagcggcaccaattaacatggtccttacattgccagctgaattcgggattgatcaggccgatgtcgatgaagtggaagagggattggctaagttggttctgtcaacagaacaggcagtattcgagaaacccgaggggacagagaatcgacatcttaaaccattgtatataaatggctacgtcaatgggaagccgatgtctgagatgatggtcgatggtggggccgcggtaaatttgatgccttatgctacgttcaggaaattgggtaggaacgccgaggatctcatcaagacaaatatggtgctcaaagactttggtggtaatccatcggaaaccaaag

SEQ ID NO: 8789 - DNA, 2182 bp, Oryza sativa
  unsure (1)..(2182): unsure at all n locations
ccggcgtcggctatgaatcctattattaaggcatggccgttcagaggttggggaattgatatgatcggcatgataaacccaccatcgagtaaaggacataaatttatattggtggtaactgattatttcaccaagtggtagaggcgattcctttgaagaaagttgattctggggatgnctattcaatttgttcgaagagcattataatctatcgatttggtcttcctcaaactattactacggatcaaggttcaatcttcgtgtccgatgagtttgttcagtttgccgatagcgtgggtatcaagttgttgaattcttcaccttattatgcgcaagctaatgggcaagccgaggcgtctaataaaagtttgatcaagttgattaagcggaaaatttctgattatcctcggcaatggcatacttggttggacgaaacattgtggtcttattggatggcttgtcatggatcgattcaggttcctccttacaaacttgtttatggaaatgaggctgttttgccgtgggaggttagaatcagctctcgacgaacggagttgcaaaacgatttaacagccgatgagtattacaatcttatggctgatgagagggaggattttgttcagtcacgattgcgagcccttgcgtaggttactaagggtaaaggaacgtgttgcccgacattataataagaaagtggtatctaaagattttttggaaggggaacttgtatggaagttgattttgccgattggtacccgtgatagtaaattcggcaagtggtcgccgaattgggaaggaccgttccaaattcataaggctgtgtctaagggggcatatatgttgcaagggcttgatggtgaagtttatgggcgagcgctcaatggcaaatatttgaagaaatattacccaagtgtttgggttaatgcatgatcggctcatattgccgatgcatgatagccgatgtgcttacatcgccttgagatggccgatatggttatatcgcccttatttgtttttcatggtgtaatcggttgtggtttgccgatgtacaatggccgatattgttatatcgcccttagttgttttataattttatcgatgctcttgacattgtaaaactaggggggcatatatatatcaaaatgcgaaatgcaatgcaaaaaatgcgaaatgcaatgcaaaatttttgagcaaatttcaaagtcatattaatcgccacaaaggattgttaagacagtaaagtatcagatgtctcagccgattacaaaaattctaaagtcctattacataaagattattgagataagtatcgctggatggccgatataaccttttgcctaatttgctctacttcttctatggcttgggcatcctgagcatcggttccagggataactttcagaaacttgtcagaacagtaacatgcttgatacccgattggagtctactttcttgtcttcaatagactttggagatcggctagctttttgtgctctatatccagttcagcgttacattcttcaagttgtgctaagagttcaattttgcgagcctcaagccgatcaatgttagacttgattaggccttcagataattgatcaagcttggatttctcttcatgcacaagctgtcggttagcttggatagtggcctcaatatccttgcgctctcgctgttcggccagtcttaacttggctttctccagtttaaattggtgttgctcaaggtaaacggctggagtaaggatgttggctaactcatctgggattagagcctgaatctcatgtagccgagccctgattgagccacaatcaactactaagctatctagtgatgatgcttctagccgatccaagatactttccaaagttttcttcacatcatcagatagaggggctaaggctttgcttgtggtatcttcttctccttcatcaagatagtctctgatgtcaaaagagaaaagatcggctaatacctgcagtgacaatttagaagcagtttgaggttaaacgattatagccgatctgaatgcttttaagacgaaagaaacttactgggatagcaggagcagctggttgttcttcttcctcgacgtgatgactccccacagctgaaggggtctggtcacttgctgattgttgtacaggaggagaaggaggaggtgaaggctggggctgcagga

SEQ ID NO: 8790 - DNA, 868 bp, Oryza sativa
agagcttgttcaacggatggatctagggtaagcagatcatcggttggcttggttttctttgtcttcttcttcttagttggggctacgaagcttacagccgacgatctggttttcctctttttgccggcatcggctggttctctgacgagcccttgaagaagagctgaggtcttgggggcatcatagccgataaccggaggagatagcccacctccatttggaattaaacctagggtatattggatgtctttgccattgttgctttgatgaggaggggaggattctgttgtctgcaagtcaaaaggaggattagttgagattaattggccaaacagttatttaaatgaaattgagcaaagttgaagacttacttgagggacaacatctggaaagaggtctgtcatatacattgaaactggttggtggaataaatgcagtttccattcaccccaccacctgtcaaagcttttgcttctgaacgttgccagttctatgttgtcaatactacccagagggggtccttgaaggctaagcagccgatccatcatcagggtcgatgaaattcctcctcggcattggatcttgtcggcaaagaataagccgattgggagttggcccattccaagttgtctacctgagctcattggatgatagaattcataagaagcttcgatgtttcttccttgatgaatgccaacaggaaggatgcatgggctaattgcagttgagaaaatttccctggatgattggtatagttcatggttgatgtcttcaaatctgaagtccactgggtgttcaagttcagcagagttctcacaaagaaaccaaactcaagcatctttttgaaagccttcatagaagttgcaaa

SEQ ID NO: 8791 - DNA, 33042 bp, Oryza sativa
gcatcggcaccctttttgctttagttttgtttcgacgagttcttgcttttgggttgagctgcatcgatttcgatcttcaacaagaggtaaaattcgttatgacggattgcgttcttaggattagtgcttccatctttatgatactctaatcccgtttatgtaattcgtcgagttatcatatgtcttacataatgtctagcaatatcatcatctaacctgccatcggttaacatctgttaatagagggtagcagattgggttaaatattgatgttgatctagattatatgagatatctaccattctatgaaacttctagcggcttgattgtctagatatcgttcttcttttcatacttaatgctgcatcagttgagtttgatctattaagtcgtgcttagaatatcgatctctagcctgccttctagttgccgattagaatagcatcggagtttcagccgatcgtatctgatttaactatatttattctatatgcctcattgttatgttaaatctgccctttatatcaagatattgctgtatctaaatatgttaggcctttgtttgatacattattcttgctttaatatcctagtatagtgtagtatcggagtattagccgatacatgctagatttatctgatcggctatgctataaacatatatagccctattattaatatatatttcgatataagtgatttatactgtctcggcatgatgaccgatctatcccaatcacttgatttaagtatacatcgatataaggagtatatatcgttaatatcaacagccgatcgagtagatttagttcttttttacttattcatgaccgtcgatcgatacacagatgacatcagctcaaagataaatgatatgtcatcggcatctagccgattggctattatttatagatttaaccacggcttctttgcttctatttcttgttgattacaggatcgaatcaactggcacgctaacacatccgaaggcgagctttggacctgcactggagttaagcagatctcccaggccacgtgttttctgtcaacaatgtcaccacaaagcaaatcaaggaaccagtccctttcctcatcgttttcctttgcaacaactacccaagctagaggatacatctgattgttggcatctcggcctatagcacacagtagctctccattggttgcccccttgaaaaaacatccatccagccccaccactctcctacacccagctgtgaaacctttcttgcatgcatccaaacagatgtacatcctcttaactactggtggatccatgccaatctccctattcacaactacagtgttgccagggttgcttctgagaagttcaagttggtaattaaacaacttttggtattgccccttagctgagtcaaacttcttcttcatcacaagccactttgctctcttcagcttagagatagatgcatctacaaacattttttcttgtacagttgatttcatatgagctattggcttggaaggattagcagctatgaaattgccaaacttttctgctatcctaacagatgtaaccagcctactatccctcctaggtggacaagcatgcaggttgtcaaaggttactatttgccagctgtctgacctagaattcttagaaagcagacatacccagggacaactttcccaatcacagtttgccctaaccctttgcccatcatccttaccaaagttgatcactttcctctctgcaatagcatatgttgtaataaccttcttgaattgcttcttacaactgaacttcatccccaattcaaatttagggacaccttgactcttcttataccttgcttgatggctacctttagtcctcatctccctatcactgccaagttcatcaaatgattcctcctcatcactatctgcataaggggttttattccttgcctcatcaccacctgtttgcattcttggtttagccctctggaaaaaaatgtcatctaggttctctagttgtcctgccttaaccttcctcttgacctccttgtaatgtttctctatctcaacagcctcttcatcatcatctgattgagcatcatcccctggagtataatcactgtcagaaggtgggtggctagctatgggtgtactgtcatatgttggatagtcaggaatgggtgcattggcagaaggttgatggctaccacagggtgcactttgacaatgttgatgcctagcaataggtgctgaatcagagtggtaaataactatcctcctatcagtttcttcctctgccagttctttacccttacatccactaccaccaacctcatcaacccctttccctttggatacatctatatcaacctccattttcccaccctcctcttcactttcaacttctaactccatttctacctcccaatcactgtcatcatcagacccattacacaaatcaacaatctctggctctttaacatatacatctgctacatccaattctccagtacagtcacacatcagtttgcaagccttatcattagaaagagcacgaagacctgtttgcaaatctttaccaggaaacaaccagtggagcaaagtcccagacatcacattgcaatggtcctttaggtgtccaaatagctcgggcaaagaaaccttgtctctttctacatatgatagagcctcagatccaccacaatatttcttctcactcccatctaaaacaaatacgcccttcagatgaaacctaaccacaagagtgtccaacacgtccatccccttcatgcagaacaagatataaaattgacttagagcattttaaatttgtcctacactcggtccaaaaaaaaatggtcctacacatgcatacctagtaccaaatcctaacttctgcaataaactaagcctaaacataccctaatcaagtacaaacctaaataaataactcgcagcttacaccaaatcccaacatcgaaaaacattaaaaattattccttcccacatcccactgataccatgcaacaacacaaactcagagaggaaatggaatacctgccggattcggatgtcggattgcggggggaatactcgccgatgaaacccccgccggccgccgcacctagctccgactccctaccgaggtcgccccaaggtggttgccggcagccacgcctaggccaccaccagatccaggtcgagctcgatgttgtcggcggccgcgccaaaccagtcaccacctcggcgcgacactctgccatcccttccgccgccccttccgccgccgcctgctgcaaatcgacctcgtcaccagcagcgtcgccctggccgtcctgatctagggttttcacacaagtgaggagtgacaaatccgctgtgcgccacgagcctaactgcgagcctaactaccgccctgctgactcagcgttgaaccccgtcgcccctgttgactcagcgctgaagaccgtggtcaatgtgccacatatgacaaaccaggcacaatactgccctgggaccaacaatgacccggttttgaaagttaggggacccccgatgtctggttttgcggtttgaggacgttttggtaactcgatgacaagttcagggagcttcggtgtacttttcccaacaagaaacgacaaaaaccatcgtgcacttccgtaaaagtctagcagcccagtttaaaataaaaagcctaattgacttcctgttttctttgttgatgtaggccagcccacgatgatttcccctattcatgttacttgcaagtccaagccacgtgaagtttttcctttttttgcttcgaaggcccaatgtaacgatttttagcctaaagagttatgcatttctattttccctttaaatttctgaaatgtggtaggtaggggtgggaaaaaattatacctagaaactttatacgaatacaactttatacatagaaagtctacgcatagaaaactttatacgtagaaacattcaaagtatatacacatggactttatacacataaaagttatatgtagatattttatacacataaactttatacatagatactttatacacataaactttatatagataaaatctatgcatagaaactaaaattcattagggaatagaaagttttgcaaatgagtttaaaacaaatttgtatcctacataagcacaaaatatccggatgggccatgagcccgtgaggcccatgtagttggatcagtgcgccccaacaaatttccgagtcacgcgtccgaaactcccgcgacccagccacgtgttttcccacattcgcgcaatgagcaacgcgcgaacgtttgcgtattaacgttctcgcatctgaggtccccctaacctgacaacgaatccaatttttcgtcctaactgtcaaaaccagtgcaatataggtcccatggcggtttggatagtgattttcgctgatatggcgtctacgtggctaatttgactcggtcttcatatgacattgtagtgacgtggcgcttacgtgacaatttgatttgaaaaataataaaaatttttggcccacatattagttacacaaaaaaataaaataaaaatggtgaggctcacgtgggccccacatgtcattctcacccctcctcttcttccttctctctctcctcaactcccctctattcatctctctcccccctctctgtcctctctcccacgacaagctcgacgcccggggcgagcagatagtgtcctggatgtcaccctcggagttgtagctccggctgcggagcgcgtcggcgcggttcatactctcgctccggtggatgggctcattgatgcagtcgttgtcgttgacggacgacacgtatgaccctcgccggggtgaaccggtgcgaggggacctcctcgtcggcgacgacctctgtgccatattgttggaattaatagatgggccttagcccattcgaagattaattctttggaaaatcataaaagcccacctcatgggatggcatacatggggagtttaataccaccttacttattctagaagagggggatcacattaaaagggaggatgccctcctacccacttgaagcatgtgaggtggagagaagtgggggaccacgcgctcgctcgcctcgcctcgcaggcggcgcgtaggcgcgcgtgcacgacttacgtcacccttgcgcagatgcaaactccttttgcagttttgttttgctgcgggaaatttttgcagttttgttttgctgcgggaaattcggatttgttttgttttggaaacattccgaaaaatccggtgcatgaaaacggtgtggagtccagataagttacgcgcgacttattcggttcggttacgtggagtggagatcgtacgggcgccctgatcaagcaacctatctctatataaatcgagccgcctccttcacgcaacacacgcaaaatcaatctagggtttgcctcctactctgtgctgcgctatcgctcgtagactactccatcccgttcgctggcgtgcaccggcgatcatgagagtaggtctccggaacctctgccttcgacgtcctgcacaagggaaaggcggcaataaagtttttgggaagcgctttgcacgactgcaccctgttcgcctgcgacggctcgtcttcctctccgttcgcgtgctacgcaccttcgtcgacgcccgcaaccgcgagtagttcctgccgagcaaccggtctttccgcaatctcggtacatgttcaatatattgcgcatatttaatctgttcatgttatactatgtaatttacatgtgtagatctaatgatgcgttgatgctagtttacatctgcaatgtcatgatttatttatagaataaattaaatcattatgtaattataatttcaactcatgcgcgacgccgccctcgagctggtcacgctcggcggagaggtacctccagaagtagaggatgcacgtgttggcgaggatgccgacgatcatcaccgggaagacgccgaggaggaactcgccgaacgtgatgccgctctcgacggcgatgatgaggttctacgggttgccgatgggcgtggcagccgagccgatgttggagctggaggcgagcgcgaggaggaaaggctgcgacgggaggttgttctggcgcgccaccttgaggatgaactcggtgaggacgacgcagctggtgtcgttggtgaagagcgcgctggcgacggcggagacgacgcagacgcggaagaagaggtccttgctgccgcggctcttccaggagagcatgttgccgaggtacttgaacatgtcggcgcgctccaggaagatggagacgaccatggtgccgaagaggaggccgaggatggggaggtcgatcgatcgatagatgttttctccgatcaaattggttccccaagaaccctagtactgatcctgcaaaactggagcagcgtgtgttagtgcagaaaccaaccaagaactggacaaaaaaaaagcacagaactgatcaatgcgcagaatcttcggtgagatcagacgaattaactgaagaaataatcatacaagaatcggtcacaagagattggccgccgtcgaaggcatgcgaagtacgttgcacatcatgcagcgtttgagggtcagtcacacactcacacatggctaagaatagctagctaggcagcatcgatcacccacaaattttgacaatttgaccctttgaaaaaattaattttacaaataaactgtcgccaaaacttatttcaaaatgatcctttttttcaacgccaaatcatttggcgttgaacttagacacctcagcgccacgtcaactggcgctgaatgctgagccaccgcggatgggaggctaagtcagcgtgccaacgtacattcagtgccacgctatttggcgctgaggtgtgtaagttcagcgctacatgatttggcgctgaacaaatggatcatttttgaaataagttttgacagcggttcatttgtaaaaatagtttttacaaagagttaaattgtcaaaatttgtgatcgatcacctgtcgatttttatccatggagtcgctcacctcaatcacggctcgatcgagcagcacgtccggccgctgaggacgaaggggtgatagctaaagccaacacaaatacacaacacaacgacgacgatgacgatgatagcatacacaagtccaagatcgccggagtgggagttgcgtttgctcgctgtcgtcttcgtcgacgtcggcggcggtgcgtggttgtgatctcctcctcgcggttgtgatctgaggccttggcgatgctggaggcgaggtcgagcagtagcgcgatgccgaccgtgggtggggcagggggatctctctctctcgacgacgcggggtagcggcggcggtgtggagtctggactcactggcgtggagcaaaagccggaaggcgaggcagaaggtggaagaggtggcgggggctgggatgacgacgacaacggcgaaagcgacggctgtgaggtggcgccacggcgcgaggagaagcacctgaagtaggcgcgacgaggaagaagagggagagccgagaagggatagggaatgatatgtggggcccacgtggagcccaccatatttacttttttctagctggcatttgggtccacgtgggccccactgcttttatattttttgtgtgtagctaacctgtgggcccatggtttttattatttttccgagatattattgccacgtaaatgcatgcgtgggacagagacctagtcaaaccagccacattagccagaaccgtcttccaaaccgcaagagatctcatttgcatctggttttgacagttcagggactaaaatcggatttggtgtaaaataagggacctcaaatgaacttattccctgtagctttaatggactgtttccacaaatctagctaacggcccaatagaggtctatttcatttcgaaataagttcacatgtcctttaatttgtctctacggttgaaataagtccctaaccaaaatgatataacaatttacaaaaccgaatcatctgagaatttcctagacagtatgaaacctgattttagctgatgtgacaagctgagtcatcgtgacactactggggaaagggacattagctagaaattgaaaaaacttcttttagcccacatataaaaaattgattcattaattctgaacgggtgtcggtttcattgatataaattagagttttccatgttctactcatactcctatggtcttagtattatgtgagtggtccaggagtatgattgggctagaccaagaacgaataatgcccaacagacactgtttattgtctttcctagctcaaggcgagaaacaaaagagaaggaagatgggcgtcggtgctccgacgaccaaacgacggtgatgaaagtggtaagacgtgtcccacgatataactcgtccatagatggtggagcttagcaataaagaaaaccagaacaagagggacgctgggggcaacaatgaggtcctgatacatagataaatgacaaagacgagatctagtggtgacacaaccggatgagtgcatcaaaacacgttcccgaacgagaggattccattttccttgtaagcgcgggaaaaaccgattaatactattcattgtcttccctagccaacacaagaaacacaagaggagggaagatgggcgacagtgctccagtaaccaaacaacggtgagtaaggtggccggatgtgtcccacaatgtgacatccatatatggtggcggttggcaacgaagaaaaccagaacaatgggaacgtagcaggcaacaacatggtcccaatagagagaaatgacaattgtgagctcttgtggtgaacatggccgagtgagtacgtcaaagcgtgttcccgaacgaggaggttctatttttcttaaatgtgcgagagggagggaacacaggagagaagagggtgtcagggttacagataaggtataccttctacccttggatatatgctatacggaaatacgttatagcagtgcataatcggacgttatttgaacacgctaaggaaatcaatcacgaagtctgccaatggaaaggttcctacccgtataggactggatcgttactatatcgtgcagggtccgatgtctccgagtcctacttggagaccacccgacctgcgatataaaaggggcccccccggggggacctaaggcattttatctcagagcctacacatcggccacagcttacgaagtcgaagactacaggagccaagtcgccaggtgatctagtcgaatcaacttgactacgatctcgtcggtaccgctgagttctattgctccctttgtaatctgtggttcttttcatataatctcatatcaactggattagggctattacctgctaaggggcctgaaccagtataatcttcgtctcttgtttccttgatgtcgtattacgtagatcctcgtaccagcgcacctcaataccctctatatccggtctacgggtacccaccgtctacagtggcgcaccaggtagggggccttggtgctcaaggttctagtgctatgacatcgagcttcgtcgacaacagagtcaacatcggccccatccaaggaatccctgcttcaacaatgctggtgtggactcaagtcggcgaaatcgtcttcccggtctacaccacggtgccaatctcggctggtccatcaataactagagacgagaatgccgtgattataaactcggacgatccaaagtcgaagaatcctcccgccgtggcagagaacggaacatcgacgtcgtacaagctcgagaagattcctagtgcggccgagccttgtccttctgacaaggactgcgagccgacgaggacaacttccgagctaaccaagtcctggtgtcctatccacaagtccaggaagcacaacttgcaagcttactgggtttttctcaacgtacaagctaaaatccgtgcttgtaaagagcgtggaatccagcgtacttctccaactcgtgatgtctattgtcctattcacaagacgaagaatcatgatttctcaagctgcaaggtctttctctgcgccatgaagacgacacttcccaaggtccagcagtcaggaacctgtctcgaggatacagacaaggaacaaggagcgacgttgacttcggatcgtttcgttggagtaatcgacatcgatccccgcaaaccatcagtccttcacttgctagaagactatggcttgtcatcttctagtacaccacgcgacgtgtttgccatcggtgggactagcacgtctgcacaggctaacgcagaggcagagaaccagacggccacaccagcccaacatctcggcaccgtcaacacaatattgagagaagctccctatgaccccgtgcttaacgatgatctcgcacgatggacggaacgactatgggaatcagtagccaatctcagtaacacattcgaggaagctgctaccagagcacaactggaacgatcgacagctgacggtgccgacggtgaaccaccggaggagcggacgtcgcctgcacgagctacccctccacctcgcggcaccagcgatctccgtgaccatctgaatggccgccaagaagcatgacgtgcacgagacaacgagaatcgttcccgacatcgtgtttcttcacgacaacgcgggaacgagtagcgaggaggccactcgaacgagggccaacagcaccgtgatcgtcacaaccgccacggtcgcgataaccgtgaacagcggacaccagacgatgatggtcgggggcgttagcatgaaggtgatgataacggtgaccggcgccaggacaacaatggtggacggcgacataattctcgagaacccgaacatcgccctcggaatcgcacgccagagccaagtgagccatcgtcgtcatcgtcatcatcatcttggtcttcgtcatccaataaacgtccacggaggacacacgatcgccgacaacccactgcccctagcgctgtgtgtagagctttcaaccgttctctacatgatgttcgatggcccgagagattccgacccggagcaatagagaaatacgatggaagtactgaccctgaagaattcctccaggtctactccacggtactatacgctgctagggcagacgacaatgtgttagcatacaatttaccaacgacgttgaaaggttctgcgcattcgtggctgatgcacctcccaccttactcgatctcttcatgggcagatttgtggcaacaattcgtcacgaacttccagggaacttacaagcgccacgcgatcgaagacgatttacacgcattaacacagaatcagggtgaatctttgagggactatgttcggcgctttaatgagtgcagaaatacgatccccgatatcaccgatgcttctgtgatccgcgctttcaaaacagatgtcagagatcgctatactatctaggagttggcaacaaggcgaatcactaccactcaaaggttgttcgaggttgtcgatcgatgtgcccacgcagacgacgcgctaagacgcaaaaacgacaaaccaaaggcgggaggagagaagaagccagccaaggacgcacccaaatcaagcaagaagaaaagcagcaagagtaggaagaggaaagctcaagcagaagtccttgcatctgaatacgagcgcctgcccaaacacccagacccacaaggcagtgatacaaagagaatatggtaccctatacacaagtcagacagacattctctggaggagtgcctcatcttcaaaaaatcgttggaaaggtagttggctttggagaagggcaagcaagtacgtgtagtcgagaaggcaactgaggcaaccactcaggactcggactccgcgtacccagattccgatcttcatgtctcgcacatcttcggaggttccatagcgtactcttcaaagtgagaatacaaaaaagtggagcgtgaggtttattcgacatggcagggggctgcacccaagatgaagtggtctgaacagaagatcgagttctcagatgaagaccaccccaaggctactgttataccaggacgatatccgatcatggtcgaactcactattcggaatatcaaagtagcgcgattcctcgttgatggcggcagctccatcaatcttctcttcgccagcactttggacgcaatgggaattccacgaagcgagttgacacctaccgatcaacccttctatggaatcacccctcaatcttcgtccaagccattgggcaagatcacgctcccggtgactttcggccaagcgagtaacttccgaacggagcagataacatttgatgttgctgagttcgacacagcatacaacgccatcatcagaagaacgacactcgcgaagttcatggccacatctcactacgcgtattaggtactcaagatgcccgggccgaagggaacaatcactatccaagggaacgcaaagctggcggtccaatgcgacaagcggagcctcgacatggtcgagcacactcctagccaacccgccacagccgagccacccaagaaagtgatcaaaacgactaagacgccgaaaccagacggcgcaatcaaaatcgtcccactctccagtgccaaccccgacaagacgatcaagatcggggcatcaatgaacgagaaataggaactcgcgctcatcaccttcctccgcgacaatgcggacctattcgcttggcagccgtccaacatgccgggggtcccagggaggtgattgtgcacaaacttatggtgcgacccgatgccaagccagtaaagcaaaaactgcagagatttgcaccaaatcaaaaacaggccatacgagaagagctcgataaactacttaaggctggttttattagagaggtactccatccagagtggctagccaacccagtcatggtgcggaaggccaacgggaagtggaggatgtgcgtcgatttcaccgacctcaacaaggcgtgtcccaaggatcacttccatcttccttgaatagaccaactggtggactcaacagctggttgtgagctgttaaacttccttgatgcttactccggctaccaccaaatcagcatggcagaagaggacgaggagaagacagcattcatcacaccgttcggtgtattctgctacgtcaaaatgccgtttggactcataaccgcagggaacactttccagcgcacggtccaaggggcacttagcgatcagctgggtaacaatgttgaggcctatgtcgatgacatcgttgtcaaaaccaagacatgcgactcattgattgacgatctacgggaaaccttcgacaaccttagacgatattgcctcatgctcaatcctgagaagtgcatgttcggggtaccgtcaggcaaactgctcggattcctcgtctctggcagaggaatagaagcaaatcccgagaagatcaaggaaatcgagaacatgaagtcgcccactagactcaaggaagtacagaagctaaccggatgcatggtggcgctaagtaggttcgtcgttaggatgggagaacgaggataacccttctttgcactgctaaaaaagcaagacaaatttgtatggacacaggaagccgaagaggcgttcatcgcactcaaccgctacttgtcaaatccgcatgtacttgttgctccccaacctaatgaagagttgtttctctatattgccgccacgccctactctgtgagtaccgtcattattgtcgaaagagaaaaggtgtagagactagtctattacgtcagcaaagctctacacgacgcaaagacaaggtacccacagatccaaaaactgctctacgcagtaatcatgacgtcgagaaagctacgccactacttccaagcccacagggtcatagttgtctccgccttccctcttggtgaagtcgtgagaaacaaagacgttgtcggccgcattgcaaaatgggtagtcgagctaagtcagtttgacgtccactttgtaccacgaacagccatcaagtcccaggttctcgccgatttcgtagccgattggactatgcctgaaaacaggttagacagccagactgacaacgaaacatggacaatggcgttcgatggtgcacttaacagccaaggagcaggtgcggggttcatcttgacatcaccttcaggagatcagttcaagcatgcaattcaccttaacttcagggcgaccaacaacatagctgaatatgaaggactactcgcggggataagagctgcagctgcacttggagtcaagcgacaaatcgtgaaaggggattccgaactagtcgcaaaccaggtgcacaaagattacaaatgctctagctctgagctgtccaagtatctcgcagaggtcaggaagctggaaaaaaatttgatgggatcgaggtccgacacgtatatcgcaaggacaacatcgagccagacgatctagcacggcgtgcgtcgagacaagaaccacttgaacccggcacctttctggacatcctaacaaaaccatcagtgaaagaggcaaacgacgaagatagcccagtaaccccccgacatcagcccgggggctacagaggcagaacgcgccgttgccgacatcgagaccacggacgactggcggaccccactcattaaattcataaatagcgacgagttgcctgaggacgacgcagaagccaagaaaataacccgtcaaggaaaaatctattgtatgatcggcaacgatttatacaagaaggcaccaaacggggtacttctaaaatgcgtcttgtccggcgacggtaagcacctcctcctcgacatacatgaaggggtctgcgggtcacatgccgccggtcgtacattggtcggaaaagcctttcgacaaggatttttctggccaaccgccctcaaagacgcttgcgacatggtacaacggtgtgaagcttgccaatttcacagcaaacacacaaagctaccagcgcaagcactacaaaccatccctctcacttggccattctcgtgctaggggctcgacatactcggtccattctcacgaggacagggcggctacagattcctgttcgtggcgatcgacaaattcaccaaatggatcgaggcaacacccacaggagaaatcaaggccgacaacgccatcaagttcattaaggggatattttgccgatatggattgcctcaccgtatcataacggataacggctcccaattcatcagcgccgattttcaagattattgcatcggactaggagtcaagaaatgcttcgcctcggtttctcaccctcagagtaacggacaggtcgaatgggcaaacagcatagtactacaagggatcaagacccgtgtctatgacaggctcatgtcacatgataagaagtgggtcgaagaactcccctcggtactatgggtcgtgcgcaccacaccgacatcgtccaacaaggagacacccttcttcctcgtgtacggctcagaggccatgctccctaccgagttacgacatcagagtatatgattacagaagtactccgacgagaatcaggaggaacagcgaaacgacgacgtgaacctactcgaggaatatcgagaacgggtcaccgtcagagcagttagctaccaataggccctccgccgatatcacgagaagctcatccgagcacgcatactttcgatcggcgactacatcctccgacgagttcaaagctaggcagggcgaaacaaactctcgcccaaatgggaaggaccgtacacgatcacacaagtcttgcggccaggcgcattcaagattgcagatggcgatggtcgcgagttagcaaattcttggaacattgaccagttgcgtaaattctatgtataagtcaatagtttccgtacttgtaagaagtcttacaacttcaataaagtctgttttaaggaacagatttcaatcacagtgccccttcccgatgatcccttacccggacgacacatagcgttgaaacctatcctcatgtccctttacgccgtcttgacaaggcctccaaggaacctaagggaacttcggctggggacacccagagctgataaggccttgtcggatccttcagagacgaaagaccatgtaagatatggtcgtgtaagagttctcgccgtgcatattaaccaagccgtgtaatcggaaatggatttttccaacttcacgactaggggctaggattagtgcttattcaactaaggcaagtcgagagtccaagagccttatctcccgagaagaattctccgatgacaaggctgggggctagggagagtgtataactcaagtgactgatcgaagtcgcgaagtgagaagacactcgtgcacaccgcatccagcgtaagaaagcttagttagatagatttcctttctgtttcacaagcatttcttatagatcgtaaagaatcctaaaatatattacaattttcttaagatgtgtgtcacagatatacaagcaataccaggaaggccaacgccaatccattgactagaagattttctccgccagcggagccatcgactttgctaggttgtctatctccgcaggattcctccgagaacaggaaaaacccttgtgaaggaactcgagatgcaactgcggacgatgatctcgtacacacgccagcacgtgccctccggcgtatcggctcgattgacgacattcctacttcagggcctcgtcgatacgcccaccgatgccatcaagctgagcacaagccccgttcaaccatgagatgaagccagccgctgactcctcgggatccccgcgaggtactcagagctctctgcagacaacgaccatggttgtgcaacaactcctgaggtacgagttgaaccatacctcgcgacctcggagcgcctccacggcccggtccctcttctcttccaatatagtcctctcaagttcggcgacctcgaacttcgtcctccagtactagatgcgacggtcgcgatcagcaagcatgctctcaaggtctgctcagcatgcaaacacctaagtcaagctaatcaagacagacgaggtaaaggaaagggaaacgacaagaaccaacctaaaggagtcgacgccacatccatctcctcgggcagatcctggtccatgccgtcccgcggcacatacggctcgagctcaagtgccggaacgactacaggcaattcgggatacccgtgctgttggacatcctcgacatcggcatctctacaaacaacaggcaaagtacccggaatcaaaacgccaaagaaaactaaggtaacgattgcacacacaaaagaagttggaaccaacgaaaagtattacaaagcgcgattggttaaggggtacagacaagcggtggccctactcttcaaaaagcgggaggacggattcccccaaatcaccgacttcttccatcacatccttgcgcgcgtcgctagccgccccctgatccaagatcttctgaagatcgagttcagggtgcgccagcttcacacacgcaaggacatggcatgccccggtataaatcccgttagacgtctcctctccgatcctggccgcgtgcttggagaggatcgcctccatcactgtcgcaagttccgcaagtgaagtcgtcagccataactcatcgggattcgccgggatggtggtcttgacaccgtactccccggcaagctggtgcagactagtgtaggtgacccgcagcgagccacggatttccgacaagttgttctcgagctccgacatacggtgctcgagcccctgccgttgtcgctcgttgccggccaccagttccctcatcttctgtaggttctcgcgaacctccgccagatcatgcatcagccggtcggcgcgctcattcgccgatgacgccgccgccgccctcgcctccgtgatcttgcggctaatgccgcgagcaccaacctcaaggaggcgccccatctcgacctagagctcctcccatgtgaggacggcagccggcgcaccccgaccagccgcgagattgctggctgggccgctgggcctcacatcgcggctcctgggcacgaccacaacatctgtcgaggccacggtaggagacgcgctagaagtccctccagatccgtcttgcgccgctttcgcccgcgccgccctgtgaaaggctacaattgagacgtgctgcatgagttcgacgaagtgacaaaacctcaaattcatccacttctcgcccagcgtcacaagccgctgctgtcgcggaggcgggggagacgcatccgaggcctggagtataacgggcgtgatgtgaggtgcaagttttccgactacgtgatgatggaccaggagagcttaccgagggggtgggcgtcttccgacgatttccgatcatggaggagaatttcctcccccttttcagaacgttgccgccacttgttgtggcagcagcggcagcaacatcaaatgcctccttggcgacgccctccttcagctacgccaccgcctgatggtccacgagcggtccgatgatatcagtcagagggagagcctacacttcgtgaagtcacaatgcgatcccggaagaaaaatgcaaaagggtcgccgagtacactcacattgatggcagcttcgcgttcggctgcccccttctcgcaaagagcaacagggacgttgctcaccgtggtggggccgctgatcatcacttgaccgatgcgatgctctacggtttcactgttcaaacctgtagatcaagaaccaaaatcgataagtcaggaggaaaccccgaggagaaacccgggtcgcgtcctccgaccctgagtagtcaaaggctggatgggctcaagcctggagcggctggatccgtctaccgatgaagtcggcagcgacttaatactccgacaaccctcgcactcggaggtcatcgatgacatcgatgaaagactgaagggaggggtcaaggcgggcttggcaggccaagacgaaatcttgtctggttgctcctcgggaacaacaaagaccggatccgagttttctatctgaagatagaaccacctcgcccgccatttactacgagaagaggggcactggaaggggatatagcgcgacttcaggccatcccgaagtcggaaaccaacgcatcctgataccctattggattccatccaacgcaactcatagtagaagcgaaagaggtcacgaaatagttctaccccaatgtaggcctcacaaagatgagaaaagatactgaggaaggtgatagagttggggttcaaatggagcagagaaagaccgtagaaattcaagaccaaaagaagaaactcagagggaggaggaaggaaaccacagagaatatagtcctcaaccgcaaccatgcggcccaggacaggttcaggttcaatacctcctggttccctctccatggtcccgcgatcggggagagcgccttcctcctacagcttcttcagcgacgcgcttgtagaagtggacttgtcgaggtccattcccgtcgaagatcgtcggagaaggggctgagatgaacaagctagggtttgtgtggaagcggagaagacgaagagttcttgaaggcttgaaagtttctcgcaacagccggactccaaaatggactcccaaaactcccttaaataggtgcactaccgacgatgcgaattccaaggaaaggagagagatgaccgccagaaatttctgggaccgttgcgcaaggcggtttcttggacttcaatttaaattcactcataaccgttggacttcgcatggtattgtcgatcactctttgtctctacggtccccacactgagatcgaccagtcgagaacgacaacaactccgacatcagaagtcatgattggttacacgagttcatttaagtagaagtcgggggctactgtcagggttacggataaggtataccctctacccttggatgtatgctatacggaaatacggtatagcagtacataatcagacgttctttgaacacactaaggaaatcaatcacgaagtctgccaatggaaaagttcctacccgtataggaatggatcgttactatatcgtacagggtccgatgtctccgagtcctacttcgagaccacctgacctgcgatataaaagggacccctcggggggacctaaggcatcgaatctcagagcctatacaacggccacagcttacgaagtcagagactacaggagcaagtcgccaggtgatctagtcgaataaccttgactacgatctcgtcggtaccgccgagttctattgctccctttgtaatatgtggttcttttcatataatcccatatcaactgattagggctattacctgctaaggagcttgaaccagtataatcgtcgtctcttgtttcattgatatcgtattacgtagatcctcgtaccagcgtaccccaataccctctatatccggtctacgggtacccaccttcgacagaggggcgctagtgagaagagatgccgagggagagagggagtgtgtgcagcgagggagagatgggtgtggggtgccgggagggaaggagggaggcaggagaggacatacgccagggaaaagagaggctgcgggggagggggagaaatgggggtgctaggagggagggaggtagaagcagaggtacgcgggagggagaggggccggacggacgaaaggaaggcaaaagccttacgtatttttttaattattaggtatatagatatagacttgtgctataatctatctatctattatatattccatccgtttcacaatgtatgtcattctagtattttccacattcatattgatactaatgaatctagacatatatacctatctagattcattagcatcaatatgaatgtgggaaatgctagaatgacttacattgtgaaatggaggaagtactaaaagtccattaaacttcctacaaacgctcctatgtctccacgtggcactctacaaacgctccgaagctgccacgtgccaaagaaacatccaacccttgatttttatttaaattagtgggccgatccttttcgaccattagagtagatgtcaaaaaaaaataagtaatccacccatactaatctacctccaaattgagcaccactctattcgtgcaaatgcatgtatacgtacgtactctgtacgctcctattcccattcttctcttttcattctattatctatatttaactctcctattttccttctcctaatagaaagcataaatttatgtaaaaacatttaggcaactatagcatttaaatcataaaggtattctaatatgcttatgttgttagattatttataaagtaactaaatcatatatatatgttttgatcacactactaaaaaaaggcacatagagatcggtgttataggtgctagaagtgataaaaccgacacctatataccatttctcacctctacgggttgaaaatacaaaaaactagcaactttaataaactataggtgccggttttctgtaatataggttttctgtaatataggtgctggtttttttaataaaaactgacaccttcaatttataagtgtcagttaattaaaaaacgacacttggtttttaaaaaactgacactaaaaatatgagctgagccgaccggtggtctcgagcggacaaggctgagagggctcagtgccactctctcgcgcgcgtataagaccgagagtttctcgctcgttctctctcgcgctcctctctatctttctctatctctcgctctctctcgtgcacgctgttgacggtcgttagcgatcagcttcgaccgtcaattttaccaaaatagaggagaacgagttatgcttgcaatgcatattcatgttagaataataatattccactagtatttggttcactaaccttttgtaaagaataaccctaaagtggtggagaatcgacatcaactcagacgataaatcaatcggacgatgtcgagaatcagacttatgcatgactgggccaagaactcagaattggcatgatgaactgggccaaaattcacaagtctgcgtatgagagcaacggaggaggccaccggccgattttgggccaggacggcccgacccatggttcggccgaaccccccgcagcgccattcgatccaggtttctcctggacggctgagatggctccccaatgacggttggtgagtattaccgacctttccaaccgtcacaaccgtcattctcaagatataaaaggagctctcatcctcacttcactcacacacctcaagcaagagttctctcatattctctcaagttagtttagtgttctcaagctagtggaataggaatagagtataaatcggagtctggaagccttcggaagagttcgggtatggctctagtagctcttctcttattttttgtatttagaatactcttctatatacatttatggtattgaaatactttccgagtatatgaataccaactttactttatgttcatgttatactgattatgttgctagcttatctgggagatgctttggtacgggtataatgtttgcttatgcaattactctatgtcatgacgatgatattagagtagtatctggtagtttaggcgttgtgtcaagattactggatatcattatttgggtttatatgctgtggatgagaagtgggccgctgatggtgacagctcagtacgggtattcctccgcgcgtgtatattgtcctaagttaattccctggggagggtactgtcgcgtcccaaaacgaccctaaaatacatcctctaaattatgcctagaataattaaaatccgtgtgaaagcctccaacaattaaaatgtgcaaagttaaaagtcaaataaggcttgcaggatttttgtatatttcctaaaagcctaaaatgcgtaaataaattttagtggaattttcagagcacaaataataattaagaagaaataaacaaagttaaaaaggttttataaaaagaaaaaccctaaaaagtctttttccccccctccacctcttgggccggctcggcccacctccctccctctctctcctctcccccgcggcccatccggcctcctccccgcgcgcgtgctgctgacgggcgggctcgcccgccaccctcgctgacgggtggggcccacccgtcatcccctacctcccgccgctcccgccgcctcgcccgtgccctagcgccgccgccgccgcaaatcccgccgctcccgtccgccccgcgtgcaatcaagaggggggaaatattccccgtgattccctccctctttccccccacttttccctctctctctccatcggattcgttcgggatcttttcccctaaacctcgccggcgcatcaatggcggccggatcttccgcggccgtttccccctcatccggccgctctctccccctcccaaccctatataaacactccccgtgcctccctccgccgtttccgccactcgccgctctctatccccgccggaatcgagctcgcgccgtcgccctctctctccgtcgtcgccgccgagctccggtccgccgccgttgtcgtcccagaccacctctcccctcggcgccgcctccttcggcttcgccgcatccccggcgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcgtttcccccttccctcccctctctcggccgccgctccgccgtacctatggccgccgccggcgaccatagggacgcgggcgcgccgcctcccgtcggctgtgccggcgtggccgccttcgggcgcgccgtgcggctgccgcgtggggcccggctgtcagccgctcgcgccctcgggtgcggctgacgcgtgggacccacggcgccggccggtgtgagcccgggtgcgcccggtccaccgtggaccgtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatctttgaacatattgaatcccagtttataaaattatgctgatttaaattattgcattatcgctttatttaaattcccgcgttatcattgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattcttaggtttggcaggatactaccggaggtttatcgagaacttctccaaaatcgctcgacccatgacacagttgttgaagaaagaagagaaatttgtgtggagcccgcaatgcaagaaggcgttccaaactctcaaagaaaagctggtttcctcgccagtgttaatcttgccggatactcgcaaggacttcatggtgtattgtgatgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcggcagaggagatggttagaactcatcaaggattacgatgtgggaattcactatcatcctggtaaggccaacgtggtcgctgacgctctaagtcgaaagagccattgcaacactcttaacgtccgtggctttccacccgaacttaaccaacagatggaagccctgaatctgagcatagtgggtcgtggattcttggctgcgttggaagccaagcccaccttgctcgatcaaatccgcgaggctcagaagaatgacccggacatgcgtggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtaccagattaaatttcagcaccgcgtatcacccgcagatagatggacagaccaagcgtctaaatcagatcctagaagatatgcttcgcgcatgtgtcctagatttcgggaagacctgggataagagtctcccctatgctgagttctcctacaataacagctaccaagccagtatacaaatggctccttatgaagcgttgtatgggcgcaaatgccggacaccgctattgtgggaccaagttggggaaagtcaagtgttcgggactgatatcctgagagaagctgaagcgaaggtcagaaccattcgggataatctaaaggtggcacagtcccggcagaaaagttatgcagataaccgtcgccgtaacctggaattcgcagtggacgattttgtgtaccttcgggtcacgccattgcgaggtgtgcacaggtttcagacaaaagggaagctcgcacctcggttcgtgggtcctttccgtatcattgctcgacgcggagaagtcgcttaccagttggagctgcccgcctccttgggcaacgtgcatgatgtgttccatgtgtcgcaactcaagaaatgtcttcgggtaccgtccgagcagactgacccagagcaaattgaagttcgcgaagacttgacctacgtggagaggccagtgaaaatcctggacaccatggagcgcaggaccaggaaccgggtaatccgtttttgcaaggtctaatggagcaaccatgccgaggaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtcttttccccccctccccctcttgggccggctcggcccacctccctccctctctctcctctcccccgcggcccatccggcctcctccccgcgcgcgtgccgctgacaggcgggcccgcccgccaccctcgctcacgggtggggcccacccgtcatcccctacctcccgccgctcccgccgcctcgcccgtgccctagcgccgccgccgccgcaaatcccgccgctcccgtccgccccgcgtgcaatcaagattccctccctctttccccccacttttccctctctctctccatcggattcattcgggatcttttcccctaaacctcgctggcgcatcaatggcggccggatcttccacggccgtttccccctcatccggccgctctctccccctcccaaccctatataaacactccccgtgcctccctccgccgtttccgaccctcgccgctctctctctctgccggaatcgagctcgcgccgtcgctctctctctccgccatcgccgccgagctccagtccgccgccgtcgtcgctccggaccttctcccgcttcggcgtcgccttcttcgggttcgccgcaacctcgccgacctcgtccacctctccgtttcgttcgccgaccgccggaacgccgccgtccccgtcgacccgtgccgcgccgccgccttcctccgctccggtcgccgttcccgtcgtcgccgtcgacccggggtgagccgtggaccgccgattcgcttcccccttccctcccctctttcgggcgccgctccgccgcgccggtggtcgccggcggcgaccataggggcgcgggtgcaccgcctcccgtcggctgtgccggcgtggccgccttcgggcgcgcccctcggctgccatgtggggcccggccgtcagccgcccgcgccctcgggtgcggctgacgcatgggacccacggcgccggccggtgtgagccgggtgcgcccggtccaccgtggaccgtgaggctgccgcgtgggccccactcccgtggacccggtccgcccgcccgctcccctcggctgacggaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttaatattgttattgttattatttccttgttcaccctagaataaacaaaacctcaactagtggacactctactcatggtaccactagtatgattttaggtagatgcttccctgtttaattaggtaacattaggtgattttacaactctagactttgggatgttcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctatgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacatggttacacgtgaggaagatgtgtcttgtgggtaaagatgtacacctctgatcagagtaaaatctattcgaatagccgtgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttactaaatagttttgagcaactaaatatctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaggtacacctccatatttagccccggttgtatggtcatgacgggctgtcgtaaggaactcgacagtcatgggtggcttctcgaagtaccaggagggcatcggatagaggtttttatctagtatatcagatacctaggatgtatgtatactatgtatactagaagtattggaatagattctatctcttttctttccttttaacttagatattttagtacacatgatttatcttaacccctgcttagactatggttattacaagtaacatataaataattagtcagttctctctactatgatctacccacgggattaaataaatacgatacccttggaatactctcgagtgaaatgctacaatgatatatccgtgtgcttacggattgattctgtaaccataatataccagagtaatgtcgttaagaaataccaacaagcatttcaggcgccgttgccggggaagatttataatagagattaccagaactaatactttttatttacctctgtataatcactttcctttgcaggctaaccttggttgttttcacttttgttttggaaacagggtagtgcatgactggtttcaacttaccggaaaactttaaggaaaatccagaagctttcttccggagcatcaaaccgcgagtcgttgctccgcagaaaactctcccgacaaagaaaccagccatactagcgccaccgaccttcaagactatggctgacaagactctccgtgaattcgctgctccctctgttggcaatgtagccattgggccgcagctcaacctgggagatgtggattttgatttgaagtccagcctcatcacgatggcgtaggctagcctgttctgcggcaagcctaacgaggatgccaacgcttacttacaacagttcctggagatctgtagcacgtacaccatgaagggtgtctatcacatcctgattttcgtttcaggatttataaattatttaataaattaataatataatttatattaaatgatctttaatttacaagtgaagttaaatgtgggaaataaaatttcctaaatataaagcatggatgggtttaatttttattaaattctccatggttaattacactctcttaaattttctcggatttttcggagctcaattcctaaatgatacaaagaacagttcagtaattatttgattattaatgatctaattataattgttaagagcttttcttgtttaaaaatccttaaattataaattgttgtttaaaaggaattattagaaatgattttaaaagcctagaagagaagatctaattttaatttgttaaatctcaatataaaattgggccagataagatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaaccctctctctctctttccctcggcccagtccggcccaatccgccgagccgccgctctcctctctctcagccgctgacaggtagggcccgcttgtcggatccatcgtcttcgtcaagccgccgccgcccgaaaccctagcgcaagccgccgccgtctccttccaaattcggccgatcctttccttctccggccgaatcttttgaggggaaataatcttctcgatctcctcttccttttctcttttggaatcaacggctaactcggtttggaaatccgtggattcgagttcgattcggatcgatctctctcctccgaaccctagctttccttcgccgttccttcgccgtctccgtcgccgtgggccttcgccgccgcctccttgcccctttaaaagcacccccggtgtctccgctacccgtcgccaccttcgccttcgcctctcgtcgtccgtagcgccctagcgccgtgccgcttcgtgccgccgtcgccgccgtcgctccagtcgtccttcgccgttgctccagtcgtcgccgtcgctcgggaagaccgccgtcgtggtcgccaagtcgccgccgtcctcgtccaccgcttcgccgtcgccgaagaccgccggagcaccgttgtcaccgttgacccgatctccgccgccgcttcttcctcgtcgccggcgccgtccgttgcccttccgccgttgttttggtcaccggtgagttcgccgcgtcgccctctacccgttggtgccttccgttcgcgccgccgtgccgtcgttcgccggcgagcatgcaagcccgagccgccgagccgccgccgccggtggtgacgtcatcgccgacgtcatcggggccgttcgctgtgagccggtcgtggaccgttcgatctcggccgtccgttttggatcaagtcgatctcggccgtccgttcgcatgagccgtcgcccgtgcgcccggtccaccgcgaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcctgtaaaattcataataaattcatttgaagtcagaatgaggccgttcaagtctcataattcatctaaaattatgatctacatgtttgtttactttttatgtattgtttatttggtttttattagtctttttttcgttttgcgtgttagcttgtcgtttccgtcgttgcgaaagttcgcgagtgcgccggaagtattcaagaagattatttgaagaccgattattgcaaggcaagtcacacagatcctaaacacaatcctttgagcatgttgatcctatatttaaattctctatttatttcaactgtgcatttattttcgaatgtcactgggtgttgttaacctattctttgttatggcccttttgttcttgattactttattccttgataccttgggtgattataattggactagttgagctttaaatatattggttcaactagatattagatataattgcttagccatgcttagaaacattagcacactattgggataacttatgattcactattatttaataatggcttaatgatagttcacgatggt

SEQ ID NO: 8792 - DNA, 2450 bp, Oryza sativa
aaggatattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaatatttatagatgttatacctggtaataatttgcttagctcctggtttggagattagatctgtacagccgggtatggttgcttcagaatggttgggcctgagcagcatgggcgtgttgttcagtgttgattaaaatttctgattaattactcctctgttttacttctcttaaatgttttgctaaatgctgcttacgcaaatgagcctatattatgccatcctttggtatccttgtgcacttgcatatttgctgtgtggcttgctgagtatgtcatatgctcaccttgcaataatcaatcaacctcacttgaagaaaaagaatccagaaggagaagacgtttggcttataccccagttgagctgcctgtgggagtggagccggagcttcgctagattttatttttccgctgcagttttcttcatggtgaggactaagtgcctcataagtaagtatttatcgttttagtcaatttgatgaatctgtatattaaattgtcagtttgtgtacctcggctgatttctggacgaggattttatgcacaaataagttcgaaaattactagtgaatttccgggcgtgacagtgtcagtccggacgttgtcaggctccggttgttcccgttttccctcctcgggaaagcaaagtagtggttttatgccaaccgtgctacaatcaatacctgggacaaatgctctatagcatttctctcgaagttctttccgatcggcaaaaccaatccccttcatgggagaatttcaagtttccagcagacaagggacaagtctattcctgagacgtgggaacgacttcagaaatatgtggctgccagtcctcatgatgggatggacgactggttgatcctgtagaacttctataatggactcactcccatgtcctgtgaccacctggacacgctagctggagtagccttcttctctaagacggttctattgacgcttttttagtcaacacaagatcacctaacgatttgcggtgtaaacaatagaatcgtcgaaatcgataggtcaaaatcggctagtgaaaccgatttcgagattgattcactttcgcggaaacacacgactaacttacaagcaaattagcaaagaggataaatatcgtacttacgtgacgacgaacgactagtttccgagcaaactagcaaaggataacctcctcgctttcgtggagaagcacgaccatttttcagcgcaaaacgacaaagattaaccaaattctaggttactaaaactcagccatgaaaacgaaatagaaaagaacagaaaagtaaataacaagaaaatagtagattgataatttgttcggggtttttccagcgaagatggaaagagtaatttataggaggcacggcctcatctagcgggagtttgtttcctttgtgggccttctcttccagcgttccgggtcgatcatggaaattccatgtacagcatatcaatgccttcggtgatctgcactactccctgaaaaatactccgtacctgacatgcatgcatcaaatcgatgatcttctataaaggcaaccattatgtgcatgaaaactaaccttaaggaataaagtagtaatttttgttgtacctttgtacattgggagatgagctagggagagaatatagggagagaatagtgctatgtgcaaccttaagcttaaggctagccataagaattaaaaatatatatcatggctttgcaacatgcatgcacactttcaatcttgagtaaatatgtgtctttttactcaatgggtcccaccttaaggtcaagaagctaccatatacattgtagcatgtactatagataaacaatataagaatgtgggtctcaccttatggctcaattgatctaaaacattgaggatgctcttaatccatgacaccttgtggcctcctgaagccttttccttcacaaaggatccggatgcctccctgcacatgtacgctgcacacactgaccctatatactacttgcgacacacatctgcaagcactaattataaatccctaatgattaaccaaacaatgggtaaaatgaccccataaacctaactaattaggagtaacagctaacatccgaacttaacccactcaactaattaaccacctgattacaagtcaacgaaccaggttaattgctgcagccacccaacagcttgcacacatgatctctcagtgtatcacaaattcctacacacaataaacttaatctatgtttcaagctaaccactcaacacttaggatcta

SEQ ID NO: 8793 - DNA, 8215 bp, Oryza sativa
ccagcactccttgaaggatcttgtctttgcgcaagctaagaccactgatgctttaagcaaaaagctaactgccaatgacaagatcctagagaacattaatgtcaagctagatgtcctcgtttctgctttccaaaaccagttgagctttaataagatgatagaaacccagctagctcaattggctttattagtccctgcaaatgaatatgggaggattccgaggcagcccgactcctccattgaaaatgtcaaggcaatcacaacgaagggaggtaagtccactcatgaaccgccgtatcctaaccctgcaggaactaacgggatcgccaaggaagcaccatctagtgattcagttgacaaaaaggttcagccagagaaggttgtgccgcaggagtactgcgccacacaattgctgccgtttcctcaacgaagtaggaaaccgtcagtggacgagcagttcgctcgttttgttgaagtaatccagaacattcacatcaacgtgctattgttggatgctatgcaagtgccaacatatgcccgttatctcaaggatatcctcaacaacaagagatcgctcccaacaacggaggtggtcaagctgacgaagcaatgcagcaatgtcatactccacaagctcccggaaaagaagaaggatctggggtgtcccacgatcacttgctcgattgcggcacagcaattcgaccaagctctatgtgatcttggagcaagtgtcagcgtcatgcccaaagacatcttcgacaagctcaacttcacggtgctggcaccaataccgatgcacctacaattggctgactcttcaatccgttacccggcaggaatagtggaagatgtgctagtcaagatacgggatttcttcatcccggttgacttcgtggtgctggtggaagtggagccacccaagacagacagcctggtgaaattcatgcagaatttcctggaaaaggaaacaacgatgcccaggaaccgttattggaagacaccggtaaaatcaagcataccggccaagaagctagagcagccggctcagaggaagccgtcttccacaccgaaatcaaaaagggcgtggaaggaaaagccaaagacacctgctccatcacctccggagacgagtgagaaatctggaaactaaactggaaggaggtacggtcttgcacgtcgaacccaaaatgacgcgaccttcgccaaccgaaaaattggtatgtatccatatatttgttttcaacgatttaaatttttgcatcaatcgcttgtttgaatttcaaaattgcatttagaatttttgaatttcgaggaaattcttcaaatgaatttttcagagcaatccaaaataaaattttcaacaaaaatttattgtgccacgaccacactgaccgttgaaacccaaccggccaggcaacggttacctgccacttttggcagggttacggctagtgggtcccacatgtcatttctgaccgttgtgggtaccctataaaagccagccggccgagagagagaactccaccccatttcaacacattttttattctctctccaaagtttgctctcaagttcatccaagctttgatagtttccctcaaattcaaacacttagttgcatatatacaagttgctttggtgaaactcttgctattctaacccccgtcgagttagtccattcttactccattgtgtagaatgaggaggcgattgtctcgcctgttcaaggggtctggctcttcatcaagtcatcatgacgagtctagtgctcattcatcagctgatgtctcgatggaggatgccgacgctccgcgacatctcctgaacgacgccgacctcgaccttgtcgatgatcgggaaatgcaagcctactatctgctgagtgaccggaaatatgctcacacgcgagaatactctccggagctgctgaaaaagataggtatggatgttgacttccgtgctatttggaaagctgttggttggcaaagatttgctgtaatagattagcctggttctcatttgctcactttgcaatttctgtgcactttgaaagaaatagaagatggaatttcttttcgctttttccataaggaatacacacctacatggaaaggattaagtacacttcttggttttcacgattcctgtaaaatcgatctcctgaaaggaatatctgggttcgagaaaaataggttttgggaagatatttctggtgctccaatttgcaagaaacctaggacgaatgatatccataatcctacacttatgctcatgcacaaatggattgctatgactttgtttactagaggtgatcttagacccattagggggatgaattaattatcatgtttgccatggttaggaaaatcaaaattgctcctgtgaaatgtatgataaggcaatggttagagagtataagattttctgctcctgttgagtgcacttttttgattactcggatagcaaatgggctgggggtcgtgagtgaccaaattgttttcatctcagccgctcgtccctatattgatgagaattatctagtgtaagggcacattcttaaacagatggatctttgatatacttcttccccagttgtacaaatgaaatccctttgccaaatgcggggtatcatttgtacaactaccatgaactaaccattcccctatagaccatagtagaatctcgtgcaggtggagcatacagggaaacacacaacatgacaaggaatgaatgagaaggttcatcatcctcaacacccgtacagatgtatgaggcaggttgggaaccaactggggatgtacccggatggaccccaagctccatgccacagcatcggagtctcaagctgggtgtcatgtcctgataaattcatcccgaattaaaaatcattctctaaaaggaataatagaattaattaaaattcaaaaagaaattggcaaacactaaaatacgtacaagaaaaattcgaatgaggctcggagaatttttgttaaattctccatggcctaataggagccctcaaattttacttgaattttcagagcaccggaaatatttattaagcaacaacaacaattatcaaagtttattaaaaagaaaaactaaaaataatcctccttcctcctttgggcccagtctagcccaaagtcttccgctctctcttcctcggcccgcagccgaagtctctcctccgtccctctcttttccggggattgctatctggcgcgcgcgcgccagcaacggaagtttcgcgcgtgtgtcacgcccagaaattcccgaataggattccaagcagaatatgcattaaaacccccgtccaggaccgcccggggtacacaaacaataaagttgacatacagatccacgtcttacaaatatcataaagtcttacataaatgcagtggaaaattaaaacataactggagctaagccttgacttggaccacagcgggatcaccactccacaggcatcctcgacggcacggatgaagcctactcctcggagaagccaccatctgacgcatactcaaactctggggtttggggaaaaatagagcaagactaagtattacccactgtactcagcaagtcaaactggaataggggtatgatgcagggaattatcaagggatagctatagaggttcgtttgcataaagcgagcatttataaacagtagatggaagcagtaaaaaaattataataattaatcaatattaatcatccactgtccaacgctacaccacgttgcaacaggcccaaccatccacctagactactcaaattcaatagactagactagggtgaaactaatcatggtgaatctggttgaccgcccatatccgcgggtacggctattcgaatagttttactctgatcagagatgtacaactgtacccacaagacacagcccaacgacacgtttccgtgcgccgacatgccaccatgacataccggatagaggccgtgacaagactcttcgcataaccccctctaaccaaacacaccacacctcaggtttcacccccactcctcgcaaggcagcgggtagtcccctctcgtgcctaggttaatccggaagccgcataggccgtcgcagggcccatccaaactccatcacgcccacccttgcctggatgcgtcagctagaggaaggctacactacaagcccagccgttgcccacgctggcttgtggtaagtacgagaaattcttccaaggtttcccgcgaatcggtccttaagtgccatgggcgcgactagcaaaaccatgtacccacagcccaccatttaacatgttttaatgaagcgacaccaggacggtggctctaatccaacatcaacactagaacctgaagtctatacattaatatgatttcccccattgtgtgctagttgaactaagcatggctaagcaatccctagtccaatatctagtcatgttatatcccaagctaacaaaggaacatggtacaaaatagcatggctataacagtaggtaaacatcccatggtaacagtataaaacaatacagtatttgaaggaaaacaatggagcatttgtaatataggatcaacatgttcaagtgacaagcatgacttgccttgctctgctgctggaggaacctcggcgactatttcaaagtacaccggagcatcgggagagccagaatctaagcgacagacaaagcaaacaatacaaacaagctataagactactaaaacagagaacaaaacaatttttaatggattctatgtatttttcttgatttactgagacttgaatggcattaaacggagctcggatgaattagatatgaattttagaagattcactgtgtttttactgtaatagaaaaaatccttaattgatttattgcgtaataaataaatcccgggagaaagaggggcggcgtcgacatgcgggccccacatggcagtggctgcagccgctggtccatggtggatcgggtccatggaccggggaaaaagggcagcgcaccacgtggtgcaaacgtggcgccgacgtggcacgcacgtgacggcctcgtggcagccacgcgggcggcgggatcggatggccccgatctaccgcccggtagatcggacggcggatgcggctcgcggccggcgcgcacgggcacggctcaagccggcccagcggccatggcgcgcggcggcgcgaggcggcgatcggccggctaagcggctaggcggcggcgcgtcggctaagcagcgtgggagagagggagaaaggggaggaggggccgcaccgacgacgatcgacgacgatgagagacgaatggtgatggcgacggcgagacgagctccgggaccacctaagggatcgaaagggatgagttagagagggagagggaagccatggatggctagagcggcgaccgaaggcgctggccatggcgaagctcaccggcgcgtggcacgggcggggttccggcgcgcggcacgggcggtgttccggcggcggattactacggaggaggggtggacgggacggcccgcacgatggcgaatgcgacaaagtcaacggcgcggctcggcacggcggctagcggtgaccggagcagcggcggcggcggcggaagggaggacgacggcgctagggtggtggagtgcacgggagcgggcgattgcaaaacgaaaaagagagaggagggaacgaggatgcattatatagacccacgaggttcgatcgtggccgggagaccgcgatttcgccggcggagtggggagaggtggggaggagagagaggcgggattcaaaaattgaatcccggccatctcgagcgcgggcgcgggcgagagataggggagtgggcgcgggggacgcgggcgcgagggcgacgtgggtgacgtggcccggaagacgcagggcgcggcggcggttgcggttacggggcgtggcggcgccggctggaggtgggagacgggcctgacaggtgggccccatctattggcgacccggggagagaagagcgggggctcgggcggctggctgggccgtggccttcggccagcacagcggggagggggagagaagacagaatgggccggcggcccattcgaaagagaaaaatggaaaaagaaaaagaaaaggaaggaaatgaattttcttgggattaaatattgcttgtgctcaattttaattggttaaaattatttctagagctctggaaattccactaaaaatcttgttagcgtatttcgacatgtagaactcaagaaaaaaaattccacatgccaattccgattattatttgtattgatttattagggtttactcttgcttttacaccggtattttcttgagaccatttataacttcaatttaggcttgggaaagaacttcagggtgtgacagcgcgccagctgtcatctgccaccgtttctttccctttttccgactttctctttttttttctagcatttatttcacgcgagttagctaatcgatctgtattttgttgccatctgtttcctattttagcgcacctctcacgctatttccttttttgtgttttcttttccttttttttagttgctagcacacgtgtttcttaaaatctttgaattgaaagttttcaaatcttgacttgaaagttttaaattttgagttgaaagttttcaattgagggttgaaagtttcaaattttcagttgaaagttttcaatttttgagttaaaagttttctattgtgagttaaaagtattcaaatatgggttgaaagttttcaatttttgggttgaaagttttcaatttttgggttaaaagtttttaaatttgagttgaaagttttcaaatatgggttgaaagtttcaaatttgagttaaaagtttttaaaatttgagatgaaaaattaaaagttttcaaaattcaacttcaaaaatacaaattttaagttaaaactttacaaatctgggttaaaagttttcaaaatttgacaccacatatagatttctttttaatctattatttttaaaaaaatcttatcttaattatcgttattagtatctaaaactaacagattagttatcatcattacgttaatacatgatttcgaaaaaatcaaaaaaaaggtcaaacctcctccacctacgcgccggaaaaaagaaataaaaaaaagtgaaacccttcgcgtgcgcgttaccagcacgtacgcgcgaggtagcttttccgctcttttcctcgggggcggctagctagcgcgcactccccttgagtccctcctctgttagttattactcccttaactcccccctctattagttattagttatagtattaggaaaaattctaaatatttttcttttggagattttttttactaacaaaatgaaaatttttaagctagatttaaaaactttcgatttaagatttaaattttaaagtcaaattttgaaaaaactttcaactcagattcgaaaactttcaactcttagattcgaaaacttacaagtccagattcaaaaatttgaaaactttcaactggagatttgaaaattttcaacttcagattcgaaaacttttaaatccagatttgaaaattttcaactcgagatttgaaaactttcaactcgagattttaaaaatttcaagtccaaaattgaaaatttttaagttaaaatttgaaaactaccagtaaaccaatcactagtaaaaacaggaaactaatcactagtaaactaattacggttgtttctcctattcgtgcgatagcaaactgcagaaaaagaaaaaaaaagagagaagaaaacaacggtagcaaaaaactgcgaaaaaaaagaaacagaagagaagaaacgcgcgcgcgtgccatgggccttgtggaccggaagtgagttccggcacagcgcgcgcgagctagcattcctgcttttcctcccggaataagttcatctgaggtcccttaacttatcaacgaatccgattttcgtccctcaaccgaaaaaccagacacaacgggtccctcaactatcaaaaccggtgcagattagatcccttagcggttttgagggtggttttggctgatgtggcgcctacgtggcaaatttgacttggtcttcatctgacgtggcattgacgtggcgcttacgtggtaattcgatccagaaaaataataaaaaaccgtgggacccacatgtcagtcttacatagaaaataaaaaaatagtgggacccacgtgggccccacaagtcagt

SEQ ID NO: 8794 - DNA, 20687 bp, Oryza sativa
tgttgcatcgcggcatctagatagcagtacaaatggtatctacacgcataacaatttataaattgcaccgaccatcattgttccagcctcccagatcgctcgtcgatttctttcagtttttcgtctactccgatgtcgttcgacggggtctcccggctggagacgtcgccgccgccggcgttggaggaggagatggcgactgtgactcaggcgccggggctgtcgacgccgtccatgctcggcaatccagatggtggagctccggcggcaaccatgatccagagcgcgccgtgcgccaccggcggcgaggcgttggtgggcgagggccggctgcgaaaggggaagatggtcgccgaggaccagagcccgccgagcgtcagcggcggcgcaccggctgacctgcctcccggcggcgacaagctcactgagaacggcggtgacactgacaccctcctcctgggtgcccgttgttcgtggatagagaggatggtaggacccattgacatgtgggtcccactattttgtccttttgtatgactgacatgtgggccccatgtttttgtttttattttttatttttatattttgcttccagtgccacatcgtcgccacgtaggacgaggaccaagtcaaactggccacgtaggcgccacatcggctaaaaccaccatcgaaaccgctaagggacctgctttgcaccggttttgatagttgagggacccgttgtatctggttttctggttgaaggacgaaaatcggatacctcaacaagttaagggacctcaagtgaacttattcctttcctccccttttccctcctctctcgtgccttccctcccctcggcccgactccctcctcccgtccttctccttgggccggcccactcccacctctcctcctcccgcctgggcctgccccggcccaagccgagccgcagccctcccgcggacgtgcgctgcacacgctgccacgcgctggcaggcggggcccacgcgccggtcgtcgtctccttcctcctcccatccggtctcctctctccctcccgtgaaaaccctagcttcttgctccctcgaatctgccccattcaaaccttggattccaaaattcattaggggaattaattcccttcccttcctcttcaattccccctaatttcccccttgattcgtgctctcaactgcccggaacggccgcgctaatcttggccaccttctatggccaccggccgagttttctgccgccgttccccgctcctcccgtggccggctcgttcccttccgctataaaatggaatcccctcgctccattctctcgttttagccttctcccatgtctccccgtggccgcaccacctctccccgtcgccctcgtctctcccgtgccgccggccacctccagccgcctctgccgcctcgcccgtgcgccgtccggctgttccgtcgccatcgtcgacgtcacagctgcctccccttcatcggcatcgcctccgtttcacgggaaaatcaccggagccgcatcctagccggcaaacagtggtgttgccgccactgcaccacctccagccgcctgtgccgcctcgcctgtgcaccggccgacgtctccaccacctccctcagctctgcgacgccaccaccttccccgaccttaccgtcccctcgcccgaagctcgccggaacggtgtcctcgtcgacgtccagtggcgttgccgccactgtaccaccccagccgcctgtgccgcctcgccggtgcgtcggctctcgtcgtcgccgcctctcccggcacagcaacgccatcctccacctcgggcactcctcggttttgcccggaagccaccacccgtcattgccacgccggcttctccatcctcctcgccggagtccctccggcagccccttccaccgtgcccgtgcgccggccgtcgtcgccatcaccttcggcatcgcagcggcaagatcgccctcggcctcgcctcccttccacccgaaccccgcaggtgttgttcgtcgtcgtccctgtccgtcctcgccaacgactccttcagttggccgttcatcctcaccggctcgtcgtcccgtagcgccacctccgtcatcgtcattgcagcgccgtcctcgcatccgtgcagctgctgccggctgccctcgtcgcctcctcgccggccccggtcgtcgtcgtcctctcgtcgttcccgcttgtcgtcagccctcccttcatcaagccgtgctcgttcgtcgcccgcgtttcatcaagagtgcgtcgcagccccgtcgtcgtcttcgtcctcagctccgtgtcatcaagcgttgcgccggccgcgtctcgccttcgtccaaggatcgcagctgaagtcgtcctcgagccgccttcgccgtgcccgttcgtcatcgtcgttccgcgcctcgtcgcgtggtggtaaggaccctctccctcttctcgctgcctctgtcctcgtcctttcggtgttgcccgtgcccattgtgcggttgtcgaccccggtacccgtgtaccggtttcggtagttgttcgtgtgtgcatgtggtgaccatgtttgtgtgcccgctcggtagccgcgtggtttccatgtgtgcagcccgcgcggtgtctagtagggtccgtttgtcggccacttgcctcgattgacacaaggggtccgcttctgtcgacccgtggatcgtctctatgtacctggtctatcgtggtcccttaggttgacatgtggggtccgtatgtcaacagcgcagccttcctatcttttccaggctagcactttcacacgttttatagttgcaaaacctaattataataatccgtaaatctacatgtaacaacattaaacttcggatgaccatgccttggacatacgaactctgaatcgacccgttcaagtctcttaatgtttgttataacctaaagaatcctatcctttctttttatctattgttattgcttctttataggcttgtagcttcgcttgtatgcttcacgtagctttcgtcgttccgaaggttcccgaagcatggtttgcggtcgtcgccgaaggttcggaaagccattctctctgagcaaggcaagtcgcatcatccttgagcatattgaatcccagtttataaaattattttgatttaaattattgcattaccgctttttttaaattcccgcattatcactgttttatttagcacttcctattaatccttgttatagccttaccattgctattgtttattatcaccttgcttaccctaggaaaagaaaaccccaactagtgggtaatctactcatggttccactagtatgaatttaggtagatacttcgctgattaattaggcaacactagtggttttataactttagactttgagagttctcatatcatttggacactgtggaatggttggcttgtgatggaattgaacacacatctccccccccccctctattcaaaactccaaaaatggttttaggctgggctcgaggtgcatggttttgctaggagcacctcggccaccataaggaccagtcttcgggactctgttgcaaagcactaccgtactaaccacatgtctaattggtaaggcttaactcggtgctcaatctagtcctggcaagaggacacggatagagatggacgaagtcagggctcgatggacatctctaggataaatgaaggctacacgggctgcggctcggtagtcgagatgtcatggcacaggaacggtgttctgctgctaggggctcaatcctggcctacctgtcccgggattacggccgtaggcgaggttgggtcggtgcttttgtcacggctgggatgggtaaaggggttatgtcacattctttatgacgggttccacggccgtggtatgcggcgtaaagatgtgttttgtaggtaaagatgtacacctctgatcagagtataatctattcgaatagccacgccctcggttatgggcaagcctagcaatgtacccaagttagtggtttaattcttaaaacttgcttatcaactaaaatgtggaatggttggcctgggttggcttgggacgagctgggacccaggtcaggttgccagttcggtctgaatcatcgtaggccttgggttaagtcaggttcatgtggattcacggccttgattaataatattgtgtagctcaaggatagtgcttgtaaaatagctttgagcaactaagtgacttttaaatgttgtttactgcaaaacctaaccctatattattaccccttgtacccccttgcattaatcctgcatctcccggtgtgacttgctgagtactgtggttgtactcattcttgctctatcttttccccccttcagtcagagaagctttggagaagaagtcctaggtggagtcctggcttataccccagttgagctcctgtgaagatggagccgtaggcccgctagtccgctactgtttatttttgattgtcaggcctgaagtgcctttgtaataatgtaaatattatcaatataataaagatgtaccttttgtatcatgtttgtgtggtgtaccccggcttttcctaggacggggattaatacactagcgttcgggaaaaggtatttttccaggtgtgacactgggcaagtgccagtgaggactggtggcgtgcacctcatgacatacagtggggggacaaccaacccccacagatcaagtggtatgcctccatctccaagtgaatggcgttcaaattcctctcgttgggacttgggtgaaatcaccaggaaaatggacacccttgatgtgcatacgggagagatccaatataacctcatggaacacatagcccagacgcaagaatggcaacaaactgctgatactcagttcgccaacatcaacaatatgatgcagtcacagcacgatgaccttcaagcgtacttctgctttcaggggttcaatccttaccaaggaccctaagcgaaagctaagcttggggggagacatctctccccccactgaggtaacttctatcacattgcatatttcccttgccaattgcatatttgctttccaattgcatcttataaacttgaaaacaacataaaaatttgtaaaatagaaaataccaaaaagatagtttaggtttgagtcatgctaggtaagacgaactagttttatttgttgaaatgatgaatagttgctctgttttatatctcttatatatgggttcataggtaagtgctctctcaaaggttaaatataagtagccaataattatctgggaacctgaggtaaatgtgatgcacttgcttatctgagtctaagccattgcaagatatgagatagtaaataagagttgctatgatcctagtcctagtttgacttgaatttcggacttgaagttcctcatttgatataaattcctaccagagctaaaaatgtgccatcataattgaactatatacattttggttacttgccattccattgaactttgttatattcttgtgacttgtgtagttacttctcatgctttatgatcaacatcatacaccgacatatatgcacatgctaaactcctacattgcgagctaagcaattatccattccatttccatactaccaccaaaataaattctccatgctttcatgtgttttcttctcctaaaaaaagaggagggaaaggcatggttatgaaaaaaaaagagagaaaatataataaagttatgctctcaccagcatgagcatgatattgaaaatgtagccatgccctctcctaattaataaaagaaggatttttgggagaagaaagtaagcacaaaggagaagcatttcctttattttcctcatataccatttccaccatatatcacacacactttgcacgatcttgatcttgagtatgtttagtcatcagctttagtctaagtttttgacttagtaataaatgtgaatgcaagtatgccatgtttgatccctaccgagctccacacattaaaccttagagtaggaatcaaaaaggcaatttggcgaggatttcatattgatacacttggagagactgagtgaatcattcgaggaacttggatttcttttgcaaaatcatttgaaaaactttcggaatgaaagttgaataaaagattgggtgattagtgctctaattactgttatgtctttcaaccgcccaaggcaaggagaagcagtgtctcgtgggaatcaggggtaagggtaagccaccgtgccaaagattatttaatctgagagagagtacatataccttgcacttgtacctttgagatatacagcatagtagcaactcctgatcaacaaccaagtttttgtttcctttcatccttcactcgggacgagcaaaggttcaagcttgggaggttttgttgacggtcattagctatcagtttcgaccgtcaatattaccaaaatagaggagaactagttatgcttgcaatgcatatacatgttagaataataatattccactagtattaggttcactaaccttttgcagagaataatcattaaatggaggagaatcgacatcaaatcaaatgatcgatcaatcggactatgtcgagaatcagacttatgtatgaatgggccaagaactcaaaattgacacgatgaactgggccaaaattcacaagtctgcgcatgggagtaatagaggaggccacctgccgaatttaggccaggttgggccggcccctggttcggccgaacccacctggccgccgctggatccaggttttggctggacggctgagatgaagcccctatatggttggagggtaattccgaccattccaaccgtcataaccgtcatagttcagctataaaagggcttcacctcctcacttcctccacacacctcaagcaaagctctctcatattctctcaagtttagtttagtgttatctagctagtggaataggaatagagtagaaatcggagtctggaagccttcggaagagttcaggtatggctctagtagctcttctcttctcttttgtaagttttgtactattattagaatactcttctttatacatttatggtattggaatattttccgagtatatgaatgccccggttgtatggtcatggcgggctgtcgtaaggaactcagcaatcaggggtagcttctcgaagtaccaggagagcatcggatagagggtattagctagtatatcaggtaactaggatgtttgtatactatgtatactagaagtataggaatatattctctttctcttttctttccacttagcttagatattttatatgaaaatgagtagctccctgcttgtgtgtcactctacccttggattatattaacccctgtttagactatgattattacaagtaatatataaattattagtcaggttctctctaccatgatcttcccacgggaataaataaatacgatatccttggaatactctcgagtgaaatgctacaatggtatatccgtgcgcttgcggatgaactctgtaaccataatataccaggagtatttctgcaccattgctgggaattatatgtctagtaatgtcgttaagaaataccaacaacggcggtggcggccgtcccacgcccgaccccgcccggatctagcgggtcggcagcaggtggcttggtagcggtcgacggcagtagcgcgcagctcagcggggctcctcccggccggatccgacggcagaggccatctctcgcccgaccccgagctatccggcgaaaggcgacagcggctcggcggtgggcggcgggcagctcggcagcggtcgacgacagcagcgggtagctcagcggggctcctctcgcccgaatctggcggcggcagctgtcccgaccttgcccagccctgcacgaatccagcgagtagcggcaggagtccggccctgcgcggactcggtaggactggtggtgggcggcggaggacggatccaccttccccgacggtgggagcggcgagggcagcgggagcggacaacgcgacgcaaatgagcggccggcgacagggatggcggcaatgttgatggttgttatagaccaatttcgaccgtcaatatgagaactagctacacttataatgcatatttgttttagaataatatagttctacttgtacttagagaataatgtgttgcaggaatttagcaaataaaataaagagaaagtgaagaaacctaactcctaaacaagctagaggataaggagggcccacatgtcaagtgaaatcgtcccggaaaccgccttaactgccataaccgtcatagggacccacctgtcagtgtcgtgcccgaagctagaggcctactgggccggcccagagttcagctgaaccctgatggcgctagctccggctggccctccacgtggacgctccagattactcctcaatggcggttaaggggcagaatggtcttcacttttctacaaccgtcataactaccctataaaaggaggagctcattcactctctcaacacactcaagcaatctcaagattcctttttatactttagtttagtattttagtgctaagtggagtagaatagaatagttctcggattcctcggagctctcgaaagaatttcagtatggctctagcaacttttctattttcttctataagactcctggaattaatgaaatattcttcttcatatatttttgatattttgcttagtatgagtactactcttgctttatatttgtatcattaaattgtatgggtagcctaccaaagaggtgactacgacgaaaccatacgctggattgtcataattagcgacctcaatctcatatccagttactattagtacatccaaaagtgcatgcattatttcccttcttatagaattttctcttaaattactctttcgatttacgatctgattataccattgggttcgtaataattaaatctttaaaaaagatctcacataattatattttataaaaaaatacaaattacttttataatatatctaaattacttttatattttattaaattacttcttagttataaaagtaaattcaataaagtctgaaagttagaagtaacttgaaacaaaagtaaagtaacttgttacagcattaaaagtaaatatattgtgggagtaaaaacataagtctatctagaaagatttagtcaacaatcatagttacccccacaactgatttacttctgatgtcgtgacaagttattttctttttgttttaagttacttctataatatatgcaaattacttttaggctttattgaatttacttttatatgtctaagatgtaatttaataaatctgaaagtaatttagatataatttaaaagtaatttgtattttttatcaaaatataatcatgtgagatcttgttataaagatttgattatagttcggatcgtagatcggatgactaagttaagagaaaaatttatttgaaccataggtggtaggaacatattttatacttacttgatagacaagtattatagattaacaatattcggacaacatctgatggcatcgctggttagtactaaaacgagatgcctctccatttagattttgcgctcacatatatagtacggaactttgagctaacgggagtcatagtaaggcttctctcgccttttgataatcccaccgtgcgtcaacaaagcccagaggtgcgtgatgagctcgccgccggtggccagcttcttgacgtggcccgtcacgttctccgacggcgcaaccgccagcagcagctccacccacatctcggccagtaagttccacagcgccgcctcgtcagccatggccgagagcagctggtaccccagctgtgcgccgtcggctaggacggcttctccggtaaagttggcctcgtcggccggcatgaactctcgcaagctggcgaacatggcgtctttggagcggcggcaacctatgtttcggaggtagttctggatcgcctcctgcacggcctccatcagcagccgctcgtcgtggacctcatccgtcaccagctccggcgcctggagcagcaggtaggcgcaatagttggagagcacggtggccacctcgcggctgtcggcggcgacggcgttgtgggcggcgcgtggccgtgccttgccaccggcggcgccaaacagcttggagagctcgtcgtcgcagatggcggtggcgatgtgccagatgaggatgctgcccatggtgccgaacttgtacctggaggtggaccagtcgaacacctgcagcatgtcgttcctctgcagcgtccggtcgccgtacttgacgttggacagccactccgaccggagcagccggtggatctggcgcttcaccgccaccggcaggctccgccgcgtcactgccctcgtcgtggccagctgatccttgacccacctgtggagcggcacgcgcgtgaggaggcaggagctctggttctcgaggcaggagtggagcagcgagtactgcccaaccgagttgctccagtagcttcgtgtcagcgtggcgcggcacgtcagccataggaacttctccaggatcgggtggccttgccaccatggccggtggcgcacgtagcggcacagcatcttcaccctgtgccagtccgacaagacgagggacaggtactgggagagctcgaggaccaggaagagggagatcaccagcctagccagccagatgtcgacgctggtcgtggtgtagtcgacggcgccgccgcccgggggcggagagtggtggtggtggtgatgcagcaacgccggggagaagagggtggagaggctcagcgcggcggccgccatgaacgtggccgtctccgggacgagagtctgcttcggcgaggggtacctcgcgtagtagaagtcgaagaggaaacccagctccacctcgatgacacggtacatcctgtcgtggtcttcgcaggagtcgccgccggcgagccccctccggacgaacacgagcgtcctgatgtccttgggctcgtggaacggcttcccgttgaggttgaggcgttgccggaggagcttgaacagcgagaaggagaggcacagatccttgagcttgtcgtcgtcgctcagtaggctccgtcgtgctgctcccacgctttctcgcggtgacgagctcgtcgttcaccttgtactcggcggcgccatactggtactgcacgttcttcttgtcgtcgccggtgaccacgtacctgtagcccctcatggtggccgggtcgaaatcccagatgctgctgaccttctcgtgagccatgtacttggagatgagccagttgtcggcggtgaggacgcggtcacggccggcggcgaggaggccccgtaggcgcaacacgagcttggcgacgttgagcaaccagagcagcgacaggagcaccttcagctgcagctgcagagaaccgaggtaggagatgaggaggagcatgacgtagaacacctgcgtggcctggctgatcatggtgcgggcctgctggtcggcgccgtcgaggctgcaggcggcgatgccgtcggcgcagccgagcaggaagcatgcccacaccaccaccatgtcgttgcggaaggagcccgactgcatcagcccgatcgtgtaggacaccgccgggtagctcagcatcagcgccagccagaccacgaaacggaaggcggcgctgcggctggtgcggcggccagagccgaggaagacgagcgtggcgaggagcgcgcagctggccgtcaccagcgcctccacgcggaccaggagacccaccgggctggccgcccacgccgtggcggcgcgggtcacgttctgtgctacggacaggtgctgctgctccatctttcgctgatttcgagctagcttcttcctctctctccggttccaatccaaggttcgagtttggactttggacgaagagagcagcacatgtctcgtactttcatgtctagacaacaaggtttaatttctttattacttgaccaagaccatatgccaatatcacatgtctatgttcccggtagtggattctaaactgtcgatgggatatcccctcattatttgtacgtcatcctaatggttatgtaatttttttaaaaattcaacaagatagattaatatgtgataaatcatttaacaaacatactccctccgtactcaaaagaaagtcgtttaggacaatgtttaagtcaaaccttggaaatataaatcattaataactctcaagttgttgagtttgaaaatataaaaaatatataaatagatttgtcttgaaaattactttcataaaagtatacatatatcacttttcaataaatatttttatagaaaccagaagtcaaagttgtgttttggagaccgtgtcgctgtccagagcgacttcctttacgattacgagtacggagggagtacaagttaaaatgtagagcaattttacagtccttaagaatgtctcaaaaatttaatgcgaaatttgatatctcctaccaagaggtgctaaatttacaatagagaaagtggtacctcacggtacctcctaaagaactataaaattgttctagaatttaacttctagaagttgcaaaaaaaaacaaattaaactacgggtagttaacgtatattcgcactcaaatttgttttttcgttgcaacttataaaagttaaatttcaccttgcatgtttttgaagtgatttatcacatattaatatatctttttgattttttttatttttttcatgatcatttggatgacatgcaaacaatgagggatgtccccttgagagtttagaatacattccactttgttcccttcaaaatatgtcacatgttagtggaaacaatcaagagattataaagtccaaccaatgagactgtcatggttatggataccacatacctaatagtagttgactaaacactacagggcccaccacataccatgacttatacggaaacaaacctcgtatatagaaggagttccggataaggaaggataagaagagttctacatagaaacgatagggactactcagatcgtatccatatttatctccctagatttacttggacaagggggcacctatgggtataaatacgatcccccctaggaggagaggggagagacccaccacaatctacgaagccacaagacacaacatacacacaagccaatacgccactagatctcgacaacaaagattagcctaggtataccccatccggtgcttgtgaaggccggcaagagggatctagcgccatctctgatctcgacaagttcatatttgaggaggaagaatgccctgtcgttgactacgagttggttatatagccgctaagtcgacgacagctagataggttatcccaaatattgtatctgtatgatccagatgaataaagagcaacactggcttcggccaacaggatgtagggctattacctgtcagataaggggcccgaacctgtataaaaatccctgtctccatctcctttacctcaatctcgcatataccctggtaccaacgatccccataccatacaaataccctagtcgcgatctcaaacgtcgacagagacgatcacctaacttagccggtaataattaggggaggcatctgtcaaattttggaccgttagatttgctctaagattaatgccggcctctttttctcctctggctccggcgacacagcgatgaccctaaccagttagggtttggcgatggacggtcaacacaaacaagcggcaaggcggtgacaatagtgccaaaaccatggggatggaggacggtggtttggtgtcggaggcggggctaggcaagtgaggcgggggaggacgatggtcgggtggtcctagctgacgccattcgcgcctttaggcacttgcgaggtggggacaacgccggcgagctcgctcctcttgttctatcaagcgatgcgggagagaagatgaaaatgggagaggataggttactattcatgtacaaatgttgatgcaatcctagccatccaaaagtgactgaaatctaatggggtttctagtttcacatcaatgttccttatttttttgaaaagtaattcgcatgttacaatttggatcaatgacgacccacatgtcggcgatgctagggtataaaggggaaactacctcggtggggtggacacggatgacctcctcttctgccatgtcgatgagttctcctctctttatctcaagacaacatggtgaaggtcaaggtctagcctcaaggtagcacggcagggggagatggtgaagcgaacaatgacttcatcgaggcatggcaaggtcctagcagccaacaagaagcaaagcagcggtggtggcgcatggaacgaacgcgacgtgacgatgatagaagagcaaggcattaagtgcagggtgacatggtgaggggaggatgattgggtcttccgccataccgacggtaatggtcataagaggtttgtcgttcagcgttaatagcaccggtaggttaaagcttatgttcaaagtgaattagtgtgaaatcaagcaaggttttaaaggaaaaatgaagagggtttagtgcagtttatttgccctatcaattttgcattgagatggaagaatgaggcgatagaagaggagaaactactagggtttcgagcgacgcgggtggagctcgtgatgagaggcctaggccggttaggctatacggctatgtgcaggaaaaggagccgatcgtaagcctctatgccgatgtagacctagttctcgcgccattgctcccacttatgcttcaacaatgtgggaggaagtccatgacgtggcggccgtggaagtagacgcatcccgcgcgtgccacacggtgaagtaccagtagaatagttccattgatgacgagatgctgacgaacatgtcgtagaaatgcacaaagtcgaggtgcatcatctgtagctggtacacctctagaatctgcataaagaattccaaaaaggggggaccagtccatccgctgcatagtcggtgaagtgcaccacttccatcggctcattcggatggggtctaaaccctccgcacatcaccgagaccgccagccttcaccgatttgaggtcggcatataaggagatacgtcttctctatccacccgttgtcgtttaggcgggatggtggaagggcactcccatataggggcctcgcaagtcgattggtgcaaggcatcactgctggctaaggagaggcagaggcggcagggttgtcaaaggagggatcggaggtggtgcgctgcatgagaagaagcaataaggcggcgaactgaagaagagtggggcagcagcattacaaatgagatgaagtacgtgctgaagtttggcggggggttttatgccttgaaaaccctccgtgacgcttcgcccactccaccatggcgatacgattatcggagactgggagaaaaattagggtcgtgggtaattatgacctgaagcctcggaaactgaagacggccaataatgggaaaggttaaccagtgccccgtcacatcctcctgcaaccacatggggcccatgttatcctgtgcttcggtaacttcgagtagaagccccatccccaacctcaatggctctcagcccagcaatggggctactgtaggagaaacaggaataggaattccctttccccctaggagatcgaggcgttgtaggacccattgagccttccttcctgagggctcgggcactatgggccccgccaagctttcaaggtttcaagaaaagtccgggggtgacccgaggacacagagtgacccgaacatgatggccggccattgaaaagcacttattacaccctggggccccgagggtgccccgagcagtccttaagggggatttcactccattaaggaggggtactcaggactggtcatcacccttaaaacgaccactttgcattaattgtgatgtggttcaagcatggcgtacaactcatgccttacgtgggagacgtggtagtgcatgcaaccccttgcatgcttacgttgcccaaagagcacgagccacacggcgtggcgtgtcctcatcaaccatcactagggccaacctctattggcttcggccactaactgatgggcccggggacaattcgaacgaggacttttgactttccattccacttgttggtcggtaggtgtgcttgtcttatctagtcgattggctaggagggacagcgataatactaagcatatgaagtttagaggagttggccccactcttgcatgcatgcgatggcaatgtggactctccttcacatataaaaggaggatccataccaccgaaaaaagggttcgcactctcgttgaagctacgttagccaaacactaagtgagcaaggaacttctctcctccacacttagtctttcttcccacaaaaccttgtaatccttccacccatccaaagtccaccacacaggagtagggtattacgccgcatccatatgatctgaacctgtatacttgatcatgtttgttgtttcttcttgcacgtgaagcgggacccacacttaaaacttgcacccaggccaaactcacaaaaggggagtacttagcttccctgctagaggagtaccggactctgacataacatattcatgcaaattggaaagaaaaaaaaacatatattttgaaagaaaaaaaacctatgtctagctgcctaactggcgcacattatacaaggacattcagatcgagaaggtcaaattaaatatccatgacagataacgcctaagggcacccacaatggttatctataggctctctacaagagatccatgtcagcatattttcctacttggaagatattaaatgaagagagagagcaaagctatctactaacttagagatagtctatagagaaaaacgaggcaaggcatgagagagctatagatacccatgtagacatactattaatctagtctattgctgaaatgtacatgttttatagaaagcacattactttaccattgcgggtgctctaatagtcacacattatacgaggacgttcggagagagtcaagttaaatatccgtgataatgtttggtcagataggcatcccatgtaccaatgggagatcggagtactaacaacagtacagcgcaataaagaactcaagcaatcagggccatctgtattaattaattttgatccgatggtccagattcactgctccaagacatataaaccacagggtagcgcaaggcagcagcagagggactaaaaaccatggaagggggacagccaataaggatatactgcaagggagatacaaccttgaatgtggccgtccgtgggaacgagctgcgtctcgtccgggacgaccccaacgacgaatcccaggtaccaaaagctagcaatcccagctaggatcctatttaatttgcatattctaatttggtctttggttgcttgattttgcctcaaatcatcagtatttacgacctgtagtgtagaagaaagtatgtcgaagctgttaatttttgcaattacatgtataaaccgttgtgtgatattatactaccgtttttaatttgcgtggattcggcaatgtacgtacgtctggtctgcacacgatcgaacatagcactggttccaggtgtgcgacggcgtggggaaactgacggacgacgaggagcggccagcgttcgcgctggtgaacaggacgacggggcacgccctggtgaacggcggcgacctcgagctgggtctggctccctacagcggccatgtcgccgtggagctctcggtactgtggtcactggggcacccgcgcgccgacgggttcatggagatcaggacgctgagggacgtcaggtacaccctcgacggcgtccacgggttcgtcgacggggggtacaggctcaacggcatccacgggatccccgagcatgggacgctcgtcgccatctatcactcgcagcccacggctgattatgccgtctggaagattgctcccgtcggccaccaagagccgcacagccacagcgagtctgatgatgctctggagtcttaggttggacacggccatttccaatgcaataatggttactgttggagtcgtacgtacaaatgaattaaattattactagtactatattgcatatctagctagtgtgcgctacgcgattgggtatcagtacttggagatctcgagttgtagtccttgcttgcttaattaaataaaagtagcagctggtggccggagcattcttgtcaggagtctctctctagcatttatttgttttttagataatggattaaaccggcctctacacccaaaggatgtacacagcctaaaagtctcttacacgagcacttaggctcacacccttacaaaaggtttaacacaaattcgagtgaccacaaacggacacttagacaatgacagagattaaccaaaatagtacttaagacaacaaaaccccatggtgcaaagaagagagagcattaaacttctaatcttgttcttaagttccaccctttcattgcaaagaaactagaaactctcttctccaatatcatgcaaccatcttttactctttggccatcttcctccttaagcagcgaagactattgtcttgcccaaaaaagttcccctgaaaatcacctgcaacaagaaattagtgttggagccattaaagactacatcatttctgcacaaccataccgcccaacacaacgctgcgacccctccaaagactttagtttttagcttaggttgaacccccccttagccaattacccaataagctagcaacattcctagttttgagccttagaaaagtagaagaagatagaatttctaagagtttacccttgtcgaattgtttgtgtaatgaggttaacaataagggatttagttcagaaggagaagaagagttagataaccttgttcttggtcacttatgtggtgatttagtagaagaggttatggatgaggagaaagaccacctaagttgtggtgctcaaaaattctccaataattctaacaggaaaaatgctgagataaggaggggaaagaggaaggttagagtcgctattcgcaaaaagagggcatcatggggggaattttctggaatagcagaggtctgggagacttggctaaattcagatttctttcggatacctcaaaagagaaaaagctagactttattgcccttttagagacaggtaaaaatgatttctccaacgctagtcttaagagtttttgtggaggccaagatttcttttggcattggacaagaccaaggggaagatcaggaggtattttgttaggaattaatgaggcggtctttgacatttctagcgttgatgaaggcaagttttatattaagttccacattaaaaataaggatgatggctttcaatggatcctcgtggcaatctatggggcggcccaagaggaatacaaagaagctttccttgttgagttggttaatgcttgcagtaaggagtcactacctattttgcttggtggagatttcaacattattagaaatccttctgaaaagaacaatgataatttcaatgagaagtgtcctttcctctttaacgcagagagttggaactttctaggcgcaaattcacttgggctaactccttgtcaaaaccaatgtttgagaagctagatagaattttgatgagtaccaaatgggaacataagtatcctctagcttcgaatcgagctttgagtagggaactttctgaccatacaccactattgttggacacgggtgttaatactcctaaacaaccaatattcaggtttgagcttggatggttgttaagagatagcttctatgacatggtagcggatgtatggaaaaaggaagttaaggggggactaagttggaaagatggcaaaataggatacgtcgggtgcgtcaatttttgaggggatgggcgaaaaatacaagtggagcatacaagaaagagaaggctaacttgttagcaaaagcggatgagttagacaagaaggctaagatgcaatgtctatcagaacaagagttaaacctcaagaactatctaaaaaatagattagcacttttgctaagggaagaggagataaaatggtaccaacgggcgaaaacaaaaagaattgtggatggtgatagaaatacaaaatactatcatttgatagctaacggaaagcaccggaagactcgaatttttcagttggaacaagaggagggtgtaattaagggtgacgtacagctgagaaagtacattacaaaatattacaaaaacctctttggacccccagaggaaaataatttttctatgagggagtctagaatagaggacattcctcaagtctcaaatgaagaaaatgacatcctaacaaagtaattctcagaggaggaagtaaagcaggctatcttccaaatggaacacaacaaggctccaggtcccgatggatttcctgcagagttctttcaggtgttttgggaagtcattaaaaaggacctaatggccatgttcaatgactttcataaagaagaattgccactacacagcctgaattttggtatcataactcttccacccaaacataaggaggccaaacaaattcaacaataccggcctatctgcttattgaatgtaagcttcaaaattttcacgaaggtactagcaaatagagtagctctagtagctcaaaagatcattagaccttcacagacggcctttttacccgggagaaacataa

SEQ ID NO: 8795 - DNA, 1094 bp, Oryza sativa
ttaaagcaagaataatgtatcaaacaaaggcctaacatatttagatacagcaatatcttgatataaagggcagatttaacatatcaatgaggcatatagaataaatatagttaaatcagatacgatcggctgaaactccgatgctattctaatcagcaactagaaggcaggctagagatcgatattctaagcacgacttaatagatcaaactcaactgatgcagcattaagtatgaaaaaaagaacgatatctagacaatcaagccgctagaagtttcatagaatggtagatatctcatataatctagatcaacattaatatttaacctaatcggctaccctctattaacagatattaaccgatggcaggttagatgatgatattgctagtgattatataagacatatgataactcgacgaattacataaacgggattagagtatcataaagatggaagcactaatcctaagaacgcaatccgtcataacgaattttacctcttgttgaagatcgaaatcgatgcagctcaacccaaaagcaagaactcgtcgaaacaaaactaaagcaaaaagggtggcgatgcgccaagattgtattgaacgtgtgttgttaaaaattacatagggctcggggtctatttatacccaagaattacaagatatgcccataccggacacgactattatctctaacaaactctaagattccataagactttgcggcagacttttgcccatatttatctataaggaatttacataagatatcctaattaatagatacaattgccttcccaggactctatccgtgcttggcaatcatcttgaagcacattaacttgaacccgatgtcgtgtacaagtcgtattgtcggaatcggttgtatcggcttacttagcccgacttagacccagtcgatcctaaccgtagccgatctggactccggccgattcttgctctgtttccgaactcgatctccgcttccgacttcgttttgatccaatcctctttcctgacacagatgttactaaatttagttgttaacacatgccccccaagtccgagatattcgataatgttccgggtttgctgt

SEQ ID NO: 8796 - DNA, 876 bp, Oryza sativa
tcttgcccaattcctcagccgatgggattgtatgaccagtagggagctgaatttgcttttctcggagtagtaaatcaaaaatcttgtaagccttggtgatatcaaagtcatactttttctctttcccaggactttttacccattggcatggtatgacctttttgctcctcacccattcggttgcagctatttcagaatcatcttccttgtcatccgacccatacatgtatggacaaacatgattaactttcttagagcttttcctgacttccgccgacctatgctcatgcaaggttaccttctgtattagatacgataagctatcaaagtctttggacgagaacttctccctgatcggaggaatcataccctggaaggccaaatcggctagttgagcatcagtcaaactcaagctaaagcatttgttcctcatctccctgaatctctgaatgtactcgtgcacgggttcatcatgtcgctgcttgatcactgtcaagtcggtcaacttcatctcatgaaccccactgtagaaatagctatgaaattgcttctccaaatcggcccaactattgatcgacccatatggcaaagaggaaaaccaagtaaaagctgatccagacaaagataaccggagtaacctaactctcagagcgtctacagccaatgcttcaccacactgagcagggaatcggctgatgtgctcataagttgacacgccttcttttcccgaaaacttggagaaatctggaactttaaaccgattggggagagggactctttcaaaccactcaggataaggctgtcgatacaagcttccagtctcttttggtttaagcccaaattgttctctcattacatcggcaatcacattgggcc

SEQ ID NO: 8797 - DNA, 18421 bp, Oryza sativa
ccgatgtcgtgtacaagtcgtattgtcggaatcggctgtatcggcttacttagcccgactcagacccagccgatcctaaccgtagccgatctggactccggccgattcctgctctgtttccgaactcgatctccgcttccgacttcgttttgatccaatcctctttcctgacatagatgttaccaaatttggttgttaacagacatcaaagttggcacaggagttggctgggtcttcatttcagatcaacaaaaggtgggtattaattccttgatttgctttgtactgacttattttctgttgtgtcaacttccactacatctgtctgattaaattttgcaattctgtttggtatgcagggtatccttaatactgtggagaaatgggtacctgaggctgagtataggaactgtgctaggtacatttatgccaattggaaaaggcatttccatgagaagcagttccaaaagaagttctggaggtgtgcaaaagctccatgcagaatgctatttaatcttgctagggctaaacttgcacaggtcactcaagctggagctcaagctatactgaacacacatcctgagcattggagtagagcttggttcaggttaggttctaactgtgactcagttgacaataacttatgtgaatctttcaacaaatggatattagaatctagatttcatccaattatcacaatgcttgagacaattaggagaaaggtcatggttaggatcagtgatcaaaaagcagctggtgctaagtggactactgttgtatgcccaggaattctcaaaaaactcaatgtttacatcactgaatcagctttttgccatgctatttgcaatgaaggtgatagttttgaggttaagcaccatgagcataggtttacaatacacttggacaagaaagagtgctcttgtaggtattggcagctctcaggattaccataccctcatgctatatcatgcatattctatagaacgaacaagctagatgactatattgcaccttgttactatgtggatgcatttagaagcacatatgtgcattgccttcagccattggaaggaatgagtgcttggccacaggatgatagggaaccactaaatgcacctggatacattaagatgccaggaaggccaaaaactgaaagaaggagggagaagcatgagccacccaagccaaccaagatgcccaagtatggcactgtaattagatgcactaggtgcaagtaagttgggcacaacaaaagcagttgttcaaagcatcagtctagtggttctggcacagtgggttctcaatagcaaaatccttcaccaagccagcagatggtgttatcaaatacacaaggcagttctgctcacagcaagaagaggaaatctgtcagcctaactaccacaaacactacaagccaatccaggaccaaacactacaagagcaaggtaaatgcaaaaatttatccattccaaagttatctattaaccgaagcaaagtttaacatttagcacatatatgttattgcaggcaccaatggagagccaggagctggtcagggttgctgcaagtgccaaagtttgcacagaacatggtggatctgctcaagttgatctgcaagcaatagttccccattccgaaagcttcacaactgcatctgtgaggctgacatctggcaaggaaactgtgtctgtctcagctgaagagcctacaaaaaatctgccaaagaagaaagctggaggagctctcattcttcttccatgggaaaccaagaagctctgaatgtgcccatttctgtgtgtcatgttatgttgaaacatgctctttgatgtaatggcagacttttaagccaactatttatgtatgtgatgtaatgacagactgcatttagccaactatatctgtgtgtgatgtaatggtagatactagacaaccaactatttctgtgatgccatactatttggcttgcttatctatgacttaagacataagttgtgatgccagactgatttggctatctatgttacttaattgagacttaatggtgtgcaacttcatttgctattctcttaatggtgcaaatccaattatttcaggaccatttgctccctaactggatgtttcctgcaggaatttacatgttggcttacatatgttgctacaatagatgcactagatccattctgttgaattcaaccaacaatattgcacttaacatccatgtaatctttgcacagcttgaaacatatagcctgctgtattttgttgtcacatttgatattgcaaccattcatttagaactcatctttcaattagcaaccattcattgacataactcattccaaattgatagcacaactgatacatatatctcatcaaacacattgtctttccagagcatagctaacacataataaaggacctcattacatcatattggccacacatcacactgtctcacttcttgccaaagaacaccacaaatagcacaaacatacatgacaccacacatattacaaagacttttctttccttctctaacttatgattcctggccttcaagcacataatttctgcattcttcacagcaaccacaccacgagcatcatctatcgctttactctgtacttccaccttatcccgactctgttcgacctcctttcgcatcacttcgttctccctcctcaacgaattcaccctgtcccgcaaatcattcaagagctccctgatgaagcttgacgtcggcccgtcgtaccatgcccagaaatcacaccccccttgctgcaagaaaaaatcccacattcaaaccctaaaaacgcaaactcaacaaatccaacttgtaataccaaaatccctcacttacccgagcgttttggcacttgtaataccggcgcccagggttgtccatgctccacgagatccacctcaccgccttggctagtggacggcatcggcacatcaccgcgggctgatattctagcggaccaacccgataaggcacgggagatgccttcgactcacgggtagacgacaagccatccctcatcgagctcgacatctccgcgccaccgctcgctgccggtcgccaagtcactgccgccgccgccgccccgctcggttcccgcttcgctagggtttcggtgaatggggataacctaaccgtgcgccaaacatttcgcccattatatcctaactaccgccctgctgactcagcgctgaagaccatggtcaatgtgccacgtaggacaaaatcgggcacaatactgcccagggaccaacactgacccggttttgatagttaggggacccccgatatctggtttgtcggtttgaggacgttttggtaactcgatgacaagttcagggaccttcggtgtacttttctctttctagttcgctcgcgccggtcaccgcgaacactcgaagcctattcatcagacttaccccctcagatgattttttcccagaaagaaggggtcgttccgaaatgtggttaaattagtttctggcccaacccaggagtacgtaaagtctgtcagcattcagcaaactgcccagaagcctagaaaatatgggaccttgggctttacggaccatgtaatttctggcccatttcgctacagaagggcagtactctctagcttgttgtaactagattcaggatcagagtattgggagttcacaatgtttaatgtcttggcatctgtcgtgtgatttttgagaaaaaatcacctaatttttttctcccctcagatctgcatccaacggtaaaaaaataacagtacagagaatccattcaaatagcctgtgattgtgcttgttagcagagtagtatttagtaaagattaacacaaatgttgaatttataactaaaattacagtgttttataactaaaattacatttgtaaaaacagtagatatggcatgtaagtgcactgtaattttagtataagtgcactgtaaattttggtaactagaatatttatcgttttagaacaaatacattacttgagaaaccgtgcagatatttgaagttataaatgttgcatttataactaaaattacagtgctttataactaaaattacatttgtaaaaacagtatatatggcatgtaagttgtcagggttatggataccatatacctaatagtagttgactaaatctcggcaggacccactacatactatatcccatacggaagcaatctttggatataggaggagttccagataaggaaagacaaccagaattctacatgaaaacgacaaggactactcggattgtatccatattggtttccctagttctacttggacaaggggacacctatgggtataaatacaagcctcctaggaggacagggggacacccaccatgagacgatcaacacgatcaacacccactatgggacagaggatcaacactcaacacaatcgacatagaagccacaacatagaagcctacatacgctaagacacgccgccggatatcgactttagagataagcacggctagtcccctacggtgtttccggatactgttaggagagacgaaagcgctatctctgatctcgccgggcacgaattcaaggaggaaggctaccctgttgtcgactacgactcagatcgtcagaccgccatgttgacaacagttagataggctaccccaaatattgtactggtatgattatcatgaataagagcaatatcggcttcggccaacaggatgtagggttattacctgacaattcaggggcccgaacctgtataaaaatccctgtctccgtctcttttacctcagtcttgcgtatatcctagcaccaacgatccccatcctgtccaaataccgtagtcgtgacatcaaacgtcgacagtggcgcgccaggtagggggattttggtgcttcaggatttcgacgagataggtttaagagatggattttccaacaacaagctactcgatgacttcgactgtggggagatctaatccgaccggaatatatcctccgacgagatcaggatcatcgccgccgagaaggagacgccgacctccacccggccgtgcagctgctgtcccaagtgcgacgcccatccaaggaatgccaagcccgacttggtggcaaatcaatctgtatttgcttcgttcttgtgtccggttaggactggaattaggcaaacggaatacgtgcatgcatgacaaccgtgccgaccaatcaggactcaggagatatccatccgcaggcctacatgttgacgtacgtacatatgccgataggtttccaaaacctattcggtatatgcacatcaacacatgtctacacggcacaactgcataatattcaaacaaatcaacaaaagtatttagtagtttgatttttataattgatctactaattccatagatacatccggcatgtatctacaaagatacgcaatattttatacacaatttatcgtacctattttttcaatttatacagcattgtcagatcaataatttattatgtttacccagagcatgttttttatacaatatctgttgcgcggttgtccccgatgttaaatcgactacgatctaacgctgggggctcactccgtcttcttctgtataaatcatgcttgtttacggttgtccccgatgttacatctgctcgttatatcctgataatactagaagatccatgcagtttttagtacatactcgatattctctgctatatatcttgccttctagaaaatatttttcaggaacaattgagcactcgagtaggatgtggtcgagtacaccgtattatcgaggtcattcttgacaaatgcagagtcgtcgcgtccaacttaccaacgaagaccgacgacctatctcatagcaccggccatggctggactactcgagaaaaggttgttatcggataattcctcgcaaatgtcgtcggcttgatcacccgacatgactgcgaacggacatccagatacgctataagttgggtatgtgagtcatgctggccacatgagatacacatataataaaccaactttagcacctccattggtgtccgagagataattctacacgttcgctggttcctaaaccagtacgtagcaatctctcgcaccgcaacctccattggtgttcgagagattctactcgcttgctggttctcgaaccagtacgtagcaatctctcacaccgcaacaccaatgaaccagcacgtagcaatctctcacaccgcaacttccattggtgtttgagagattctactcgctcgctggttctcgaaccagtacgtagcaatctctcacactgcaacttccattggtgttctagagattctactcgctcgctggttcccgaatcagtacgtacaatctctcgcaccgaaacttcagatggtcgaggtacgactacagcaataacacagcggtcctcgcaccatgacttcagatggttgaggaacagctacgactagtcttcgaccaacagtgtagcggtccttgtaccacgactccaaatgatcgagagacacctactcactggttctcaaccagtcaatggtagcgatctctcgtacatttacttctagtggtcgagtttagcctacacctggttctcgatcagcgatgtagcatttctcccactacttccactttaagtgatcgagttacgactactgcctggtcctcgaccagcgatgtagcatttcttccactacttacactttaagtggtcgagttacgactactgcctggtcctcgaccagtgatgtagcgtttctcccactacttccacttcaagtggtcgagtcacgactactgcctggtcctcgaccagcgatgtagcgtttctcccactacttccactttaagtggtcgagttacgactactgcctggtcctcgaccaagggtgtagcgattctcccattactcctgcttcaacaaagttgatatcaggtgcacaatatcgccaaatgttttacccagagatcccttaccacgatgacacctggcgttgaaacctatcctactgtccctttatgccgtcttgacaaggcctccgaggaacctaagggaacttcggctggggacgcccagagccgataaggccttgtcggatcctttagagacgaaagaccatgtaagatctggtcgtgtaagagttctcgccttgcgtattaactaagccgtgtaatcggaaatggactttccaacttcacggctggggactaagatcagtgcttgttcaaccgaggtaggtcaaaggtccaagagccttatcctctgagaacgattctccgacgacaaggctgggggctagggagagtgtatgactctacaaactgactgatcggagtcggtaagagagaggacgctcatatacaaaacactggtctgtacattcaattcaccagtctgtcatattataacatgtcaccctttgagcattcgctcgggggctatttctatctaatattttttctgagtattgatttcaggaaaattctattcgacattatcgaagactccatgtctctatggttctacaccaagatcgactaaggcgagtatgacaaatgttgacaaggctccgtcgcagactctacgcctactcgattgctcgagaacggttggtagatctcgacaaggaataccgaatgaagaaatggtgtacccatcgagataaaatttcttgacttcaatccaaattctcaattacagcaagacaggaaacttagtcgtacgctctgtactttctcggtcgacatcagagattgacttagacaaacccgttcggtgcctgcacgaggctgataaaggaagtctaacgttatctctaaactcacctagaacggtcacgtgtgctcgataacatttcctccaaagtctgtggttgagaatatgaactcgttcatgtgcattgaagtcgggggctattgtcaaggttatggataccacatacctaatagtagttgactaaatatcggcaggacccactacatactatatctcatacggaagcgatcttcggatataggaggagttccggataaggaaagacaaccagagttctacatgaaaacgacaaggactactcggattgtatccatattggtttccctagttctacttggacaaggggacacctatggatataaatacaaggcccctaggaggacagggggacacccaccatgagacgatcaacacgatcaacacccactatgggacagaggatcaacacccaacacaatcgacatagaagccacaacatagaagcctacatacgccaagacacgccgctggatatcaacttcagagatacgcacggggtgtcttcggatactgttaggagagacgaaagcgctatctctgatctcgccgggcacagattcaaggaggaaggctaccctgttgtcgactacgagtcagatcgtcagaccgccatgtcgacaacagttagataggctaccccaaatattgtactggtgtgattatcatgaataagagcaatatcggcttcggccaacaggatgtagggttattacctgacaattcaggggcccgaacctgtataaaaatccctgtctccgtctcttttacctcagtctcgcgtatatcctagcaccaacgatccccatactgtccaaataccgtagtcgtgacatcaaacgtcgacataagtgcactgtaattttagtacaagtgcactgtaaattttggtaactagaatatttgccgttttagtacaaatacattgcttgagaaaccgtgcagttatctgaagtgttaaatattacatttataagttgtaactaaaattacagtgctttataactaaaattacatttgtaaaaacagtagatatggcatgtaagtgcactgtaattttagtacaagtgcactgtaaattttggtaactagaatatttcgttttagtacaaatacattgcttgagaaaccgtgcagatatctgaagtgttaaatattgcatttataagttgtaactaaaattacagtgctttataactaaaattacatttgtaaaaacagtagatatgacatgtaagtgcacttattacaagtgtatttacacttgtaaatggctactgacatgcgtgatgtacaggaatccatcgatatatacaaagtcagattgactcggtcatgtactcaactaatcctgctgttgcacaaatcttggaaaacatcatgtggctagaaaaacgtcatagtttgactatggaagaaatcacccgacaaatatttagcaaaatcgaattacattagccgctagcacgaggcaacaaattatcaatgtctagtacacctagctagtggaatagtggattaattactggtagttacttctagaaacggaatcaaccgtacgtcaatgtcacggataaacttgtggcgtggtgcctcacgaagatcctagtaaagctcaagcacgatgacttatagataatctatcatatgcgtacggcacgatgacttcttcttttaggaggcatgatgacttttggacgcacatactaaccttcttcttatctactctgatctgatcgtcagtttattttaggctgtactgcgctgcatgaattgttatcctatcctaattataaccagcctttctaacatgcatgttatagtgtaacttaatcatcatgctttagctagctgtttgttgattgcttcagttaattactaattaatccaatccatgggagattagaggttgttgctagctagttagagccttgttgctagctagctactccgtagaggtgggccggagacacgatgatttgaaaaggtcagaagcataaacaaattgctgtctccaatagggagacgtggtttagcaagtggatgagtcagtttaatttttgcttatctagtgggaagatgtcatattatttcacgcttgatcaatactccgttgagcaacgtgctctgccgccgtctttccgttgtacttgaacgacataaacaatgttgttttataatgggagaatctattttataccactttgttcgagttcaatgatttgcaatcgacattatcgttttctataatataccgatgactttatcaattgttctacaatagacattcttttcgaaaatatatatccaaaatacccttatggacatacaagattaacaattgattaatctaatttgaagtttcaaaaaaaatataaaatcttttatgtggcgttctaacacatggaattttttaggtaaattttgctacaggacactacgatttcgtggttttagccgtaggttaccgcctgaactcactttaaggggaagacactccataaacgtggtaatttgctaatgtacaccatgccgattataataataatttccggttgaagaggagagagaaatcacgtgaaatgtcaaaaatacccttgggactacatgtcagctctcctatctctgctctctctctatcccctccttctagcgtctgatgtgcggcgtcgggtggtcgtggcggcggaggacgacgccaacaccgcgatagcgacggtggacatggcgggcttccgcgcctcctcctcctcctgcgccttgagcgccgctaggatgtcgagcccgatccctcccgcgtcgccgtgcgccacccgcgatcgatcgggcttgtcggcgacggaaggccgccgctgccatactcttgctgctgcggctactagggtgagcagtgggcgatggagacgccgagcttgccttctccaccatggctgagatgagtagagagagagaggaggagatcccgttgacccatcgcttggtggacttcgcggcattgaggatgatggtggagatggggtcggtggcagcggacccgccgttgctgtcgctccaaccctcacccgcgcgtcgccgcggcccctctgctccacgcatcaaacgtcggaaggaggggatagagagagaggagagacacgagagctgctgacatgtgggtacaaggacatttttgacatttcacgtgatctctctcttctcttcaaccagaaattattattccaatcggcgcggtgtccattggcaaattaccacatttatggagtgtcttcccccaaaagtgagttgggtggtgtcctacggctaaaaccacgaaatcgaagtgtcttgtagcaaaatttgccaaatttgtatagaagtttcaagttttttacatttctattttttataaaaaatataacttatttgttatatgctatataaaatactttttattgctatttttaatataaatcatctttcatacactacataagatatttttatgctattatgtcttgtataagcaaattctttctcatataccacataaaaaaatactttttcctaaaaactaagtatacacaaaaagacttgaaacttgtatacaaacttccatgttatgtaaggtggccacataaaaattttcatttttttgaacttccggtgataatcttgtatgtctctaagggtattttaggtatttttgaaaagaagtttcagcctaatggcgtattgtagaataattgataaagtcaccggtatattataaaaagagacactatcaatggcaaatcattaaactcgagcaactcaggggtatagaattaattctctcttgattaaacaggcaccattgcgttttcggatactggtctggctatctgaagtgtaggatagaatcacaagaactaagccaaccagaggggggtgaatggttagtatacccaaaatccgaaaacttttagcggaaataaaagttaccctcgaaatcgacgagtcacggtctaaccgaaagtgttgcgccggtctgaccgatgtagatcgatcggtcgaaccgccgaagtcgcctgtcgcgcctgccgccgccgccggtctaaccgcctgtatgccgccggtttgaccgctgcttgccgccggtctgaccgccggtgtatcaccggttagaccgccgaaacccggtgaaacacaaatcgaagaactcttaaagtggatgacgactttatttattctctctgtgtttagaaagtgcaccaacagcactccttacaaaaatttcgactaaactcgaaaccctaactcaaaactcaactcaattactctcaaaagcgataccgggaagcctcacgctccccctctatttatacccgaggtaagcagcctaaagccacgaaccaaactcatactaagagtcctaaacaccttagaaaaccctctagtacaagaaacaaactttacataaccaatcgtaccaaatttggactccttccaaattcgactccgcattccatacgcacataatacctccatcgtatgccatatggaatctccatcaaccacgtgcatcaacactagcctaagtatcctgcatgatctctgaccaccacgaacgtcgtcttatccccaaaccgactcccggtccatcaccgcaaatactctcccgaggcatcgagtcacctacacatgaaataaacaaagaaaccatattccgagaccaagctatctccaacttgactcattagtaacaaacaacggtattacgtacgtatagtatccatctagaagtcataatcatgaaataatcacggatatccaaacaaacaacccgaaaccgaaaccgacagagtcggccggtcagaccgcgggctggccggtctgactgcgcgcataccgccggtctgaccggcaacacctgcccggtctgaccggtcacataaaatgacaacacctgtaattcacctataaatccaatcatctccgaaaccacttcgtgaataaatttcaaataacaaaattaataatctccaatgccaattgttcatcacagaataataataaaaacacctttgattttacatgaagcacagttcttattcctagctcagtactgatcgaattgtggacaagacgaccattaatttgtcatttagttagagtcgtccaaattaattgatcagcagctgatttgtcctgaagtatttgacaaattgagcaagaatttgatggtgtggtttgtaattaattgagagtactatacatacaagtggtgttatgcaagctagctgggcactcgatcgatcgtttggctccgatgatgacagccatctcgatctacacgaaggaatcataagaaggtaaaggtatattccaacctccactgtacaactttgaagatgcaaagctagcccagcaactagtacttgcatagtacaaagacctattatatatcagcttatacagggacaagaacaaattgtttaatttgtaaggtccaatgaatcaacgacaaagtagcatgcttctttcatgggcttgataccagaacaattaagaaatatgcataaatatctattatctattatatactaaaagtccaataaaattcctacaaatactctcaagccgtcacgtggcgataaaatcctaaaaattcaaagaaaaaagcaaaatatatatcctttgattttcacttaaattgatgggtccattattataccccgttagatgaaattaatcttaaaacaaaccaaatactatacgtcccagctctcccccttctcgcgcgcataggtaggtatatgtacgtacatgggtacgtacgcttccttcccttcttctttttttttcatttatataatggatatattttttaaataatcataattaaaaaaaaatctaccatcatataactcaggtaactaattagctctatatttttttttgaaaataaaatttataccattatatgttacccattaaatttataatataagataatttccacttaaaatagtgtactcataatattattttcaagtagtgcactattttaaaataaagtttacacaattatattgtgtacctatcaaataaacaattcaagatctacattaactaatttatacgtgtacttaaaccgatgacctattatttaaatcatcggatctattttttattacattatactattattctcaaataatgcactgtttcgaaataaagtctacaccattatattgtgtacccattaaattagcaagttaaaatctatattaacaaatctacacgtacactagaattggtggacccattatttaaatcatcggatgtaatatcctgaaaatccctaataataaaaatcactaaaatttcgaactttttaaaacttttgcattatgctggatgttatggttgctattgcttgccaaactataaattgtcacgattgaagattaagctaaagccgtacaactaagaagtaattagaataagataattattattaatcctataaatatttgtgtacatgatagcaagccaaataaaacacaagtcaattattaataattacaaattgtatgttaaatacttgaaccatgtcgacaagtgtcatgacatctaagtaaccacgaagtagtcgccactacaatgattttatatatataggagtgttccactagaataattaaattaacatttataactttcatcgagtctctcatgggatggattcactcatgtaaaataatttgtcatgcaaataaattgaactttatatataaaataggtttatgtgagtgtttaattaaacatttaggtcaatattgtaccaagtatcaatttacttttatggaataatcgattaaatgtgtccttgtaaaatacattgttatacaaataaactcgaccaatgtgctattgtattattaaggtcacattagaatatttaattagtttttaagaaatatcaaagcttataggttatattggataatttttggataatttaatggaaagcaaattcatttgggaactaataaataaccaaataaatattcaaatcaaacatttgaattctcaaaaccaaaatatattgattacatttcaattcaaattcaatcccattcacttttgcagattagcccctccctttccttcctttccctttttcttccttttctctcttttctcagccgccactattcaatgtccgccaaccgttcgatcccgtctactgcgtgcaccacatcgcttctggccgcgccagtcacgcccgtgccgcaccgcaaccgcgcctccttcccctcagctgcgtccgaccccaaccctagccgcaccgcacttgccgctccgcaaccgtatcgcgttgtatcgcgccgtgcgtcgcatcgcgccggacccacgcccgcgcccgcgtcatcccttccgtgccgcgtcgtgccagggcccgcaccacgccaagccgcacctctaaccgctctcctagattctctccagaaaacacggagctgcaccatcgcccatgtgcgcgcgtcgccgtcgccacgcctgccttcatcacccagacacgcgcgtcccatcgcccccatccacgcccaatggataaaacggagccctctcctccagctagcgcccagacctgcagtctataggttataggtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatccctctcagccttcttctcgtatgcatttcatcgaacaccttgcgatcaccctctcaccaccgctagagatcaccattgtgaggctccccggccggagcaggaggttagagggagtggaggaagagccgtgctgccgccgtcgccatgggggaagccgggtagccgctggacatcaagaaacgccgtcgagcaccttacgtcgctgccgtttgcccctgtcctgcaccgcgtcgagctccacttcgctgcgtttcgccatctcgccatctcgcggtacaccctcgcgcccgtagcgtcctccatacatctaattgctagcgccggcttcaaaatcgacgattagcgcccatggccgtgccgccccagccgccgtttcatcgccggcgagctctccgtgggtaggctatcccgggagctcccctctccatatagttcgtgaaatcgaatccccatacctcgtagatgctcccgcacccttcaattcggccgaaggatgtccctagcaccgaagccccttgtagccgagctcgggcatggcgtcgcctgatggcgccgcgcgcccccgtctcctcgcgcgccggctgccatcggcgggagatcaccggagctcctccgcgcctcaccctggccgtcgccgagccgcccgccgccgtcccggctcgggccggcaacgccggctgcgccgagccgcgcctctgcctcgctcggtaacgggcgagaggaagaagaagatgaggagagagagaaaccgtgtgggacccacatgtgattagcgcacagtaatcctatccctaacggtgattatcccactcaatggcaggtggggtccctatagttaaaatctaagaaaacacaattatatattttgttcctatgacaggcgggacccaatggtaattaaacaagcaggtttgaccctaagtcaaccagggccggtcccacatgtcaaccacggtgggttttggataatgtttccgattaaaaataaatcatttatgaacagtgcatttttacaatttctcggattaactcaaatttgaatctttaaattagtataaattattcattttagctccgattcgagtgaaacttgaacctaaattcatctaaattcataagctttccaatggtatataactcactatttaataaaatatattaatatcaaatgattagattatggtcaacttaaaaatgtgctaataaataaaattgatattgtacagtagagtagatgtcaaataaatatatttaacatgttttgtcactgtagcaaccacataaactaagtataagtaatgtctcaaatgaatggatgtataggaaaatactagtgcttatttaatattcgatggccatataattaaattcatgacttaaaaattagttacataaagtttagcttcatattttgtaactaaaatattaatactcatagatgaatctttaacttgtttatgagaaataataacagagctagtgtgattaaatcacctatacgaaattaattacttaatgtcatgttctttggaatagtatcttttaagttggtaatcttaagttgataaacagtaccaactcgccaaatccacctgcatcacatatactgtatagcttacagtaaatagctcatgcttagtaaatgatctaatactagtatgttattgcactcacaactactgtacagtccatttaaatcatacacaagaacaataacctacctttttcatatattaaactgaggagtctatgataagcgtgtatagtagataaaacactaattataaatcttgacctcacacacaattatagtttgaccgtgacttaggattatttatggtaaaattatgcattgagataaactttaactataatattatggaccacactaatctaacctacatagcatgtaattcgttggaaccctaatacagtaatatttgtagagccatgcttagataatccatcctgttagaactcttgttatgattaaattatccactgagccttggtaaatctcctgtagggtgtcaccatttaaattacaatcaaagctagtttagccatgaactccacatagcaatagttcatagataattccatagtcctgagtattgagttctgtatgtgagcagccatagtttggacttcgtagcaccttacaatccattagcaagcacgagtgatatgaatagccctaggtatattccgaacaattatattttgtttgtgcatatttgattgttgcttgaatattggttttctcgcatattatagaaattgtgtatcgattagtggtgaggcaacgtatgcagcttccaggaggtgaaggttgatcaagattataccaagaataagaactatcctgagcaggcaagtcatcactaatctttgagcatgttgaacctattgcgaaaattatgttgatttaaataaaattgcatgctatatatatgaatatgaatgtcctacttgttatatatgccatgccttgatattgattatctgtatgaccattgtaaaccctgctatcgtgtgtacttagtcaatattgaacaaatgcttagtcatgctaattagaatcatgcattctcatatttatcaagtgctatatgcttgggcaactaccttagggaaggtagttgagatgcggcatgtggagacatgagcgccacattgccatgacaaggatgacacgaactgtgaaaggagaaataaaattaaacactgttttcgactggggcggctggggtacttgggtggagtccggaaaaggctagtacca

SEQ ID NO: 8798 - DNA, 743 bp, Oryza sativa
aacagtttatgctaggtcttaggtttgtgaaatgatatttgaaaactcagctttacgcaaagtaaccatagccactccttgtattatcctgtacattactgcattttgtgtggtggcttgctgagtacttttgtactcattgttgctctatatatcttttagcagagtgttgaagagaagcccttgttagtatgcttgcgtacctaacaagatgatcggagtgtggttccattctaggtctcgttcccagtcgactgcttgtggcatgtcaaccgggcccttgtattattttgtcttccgctgttgttctctgttagttgttggcctgcctggccctaatgtaagcatttaactctcttagcctgaattcattcgtgatatgttgtgatttggctatgtatgtgtgtaccaactactgatccagggattggtactgataaacacagaagatttccgagttccaaaatcgggggtcgacagagctggtatcagagcatatcgactgtagttcgagaacctagatagaatggtcgttagtttaaggactctatatttttcaaagctatttttaaatgctaaaaaaagatctgtgaaaacattcaaacaatttttgacgtcatcttacctttcttggaaaatgtctgattccgatgcaccgaaaagaaaaattattttgataccttacatctcaacccttcctttgaaaaggcaatcttacagctcgatttgataaaaagggggat

SEQ ID NO: 8799 - DNA, 1865 bp, Oryza sativa
  unsure (1)..(1865): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnatgaaagctaaagcatggctacatggctttccacttatttgccaagccctacaactacaagttctctcattcaagtttactgcatgtgtaatggtggatacagttacctcggcggtgccatctccacatctaagaacttcatggtccttgatagccttgctctgagcattaagatctttggtaatggctgggattatcttgccctccatatttctagcaatattggctctcaagtcaaactttgcaacaatcatatgtcttattttctcatgcatatccacaatatgcaagtccttagtttttgacacccaactgttgaatgattcagaaagattattattgatgtagtctaccttacatagttcaaaaaaattgctcctactccaaacatatggatgattctcatccaaccattgtattgcatcaggacacttctcctttatcttgtccatgtggtattcatacctctgaaatgtgcagctcttggcagctccccacatgttctaagaaaacaatgtgccatgatacttcttcttcatgttcttccacaagtgtctcatgcactctcggtgttccactcctggatagacatcatctacagctccctctatccctttgcctgttacaacaaaatgacaaggcatgagatacaagtgtacatcacagtcatgaacaaaagaatgcaaaacagaaattacttgttaatatacctgcatcggtgttgatgaccaatcctgtaggagtacctatggcttgcttcaagttctgaataaaccatgtccaactctccttagactcgatttcaatcaccccataggccactagaaatagccaatcgtggccatcgactgcaacagcagctgccaactgacctcttgaccttcctgtcaagtgagttgaatccattgcaatgtaaggacgacatccttgcaggaaaccatcaatgcatggtttaagagctacaaagaatctcttgaaacaaacatccccattatgctcttcagtgtccaactcaacaacactaccagggattgccttcagaagtgcctctttgtaagtcggcaatagatcatagctctcatcccacttcccatatatcatgtccatagccttctccttggccctaaaaaccctgaaatttgggacatccatcttatacttcttattgaccttctcttgcaactcctttggtcccaatgtgggtttctcctttaaccagtccaccaccctatcagctatccatcccttagaagccattgtatcaccacacttattaactgaaaaacaagtgtggtctggcccattaagcttaacctgcatcaaacaatgtcgggtcccaaaactaaagattcggaaatcgacatgtttaactgtatcaagccctggatcagtagattgacacagcttcaacaatctggatcttcattgcgtacatttaaacaaggctccaaagaagatgttattacataaaataataggggaatttacaagactgtggctaactattacagcagaagttatatagtgactcaactctaaggttttgctatagacttaaaccatctaactaatctagatttgaaaactaggttaaaataagactaacttatatgattgaactcctggcttcggcaagaacttcaatttaattctggaaaagggggttgaag

SEQ ID NO: 8800 - DNA, 10853 bp, Oryza sativa
aatgcagcagcatttagtaaaatcttgaattaggtttctaaccaaagtaccatatgagtcccgatactcaattccgtgagcacggctattcgaatagattcaggtttactttactacagtaaatgtacgctttacccgcaatccatgacatgctaatattcattagcttagtcatggcaaagcttttcagttactaacatcagtggcacctgttccatgaactctcatcctcatgcgctctgaacataacattgtcagcagcgcgaggagttctggcgttcccgaggtttttagagagagaactggttgagagacccccgtcatctcaaccaggttttcacaattatatatatacttgagctcaataaatcatttacctgcgcctcggtaaacgtcacatttgcccttcgcggcatataattgcctcctgcgcgaggacttacaatagaaccactgtacagaggtaccacctttgctagataacttactttgcaaggtctgtccccattctagaattgcggtcgtactcgttcgtttgacataagtacttggtaataactatatcgactgagacagtactagccacccggaaatcaaccaattcctacgtactgtcccaatctaagttcattatatttttatacggactaactaggcagggctaagcaaagctagcatatctggtttgctatgttcaggttatgcattcaaaatcatgtatgactaatgcatagaatagagatataagaatatgggataattatgctcaaaggggaggaataataacttgccttgctccaacgcgaataaatcaaggtaggcaacctgattatccgatgctcgaaataccacaggttgccatccagaatataatagactctactagagaagaggaagaaccaatttcaataaaatccataaaataacaagaaaacgataaacaactaaaagggctagggtttagggtataacctatctcctttatagggtgtagggattactgggctaatatgtgtaggttctaaagggttggaggctagaggggattaagtaataattgtcacttatattttatgtgtggtttttggtttcttggagaataggggatataccgaataatctaactggttaagtggatatgtggctagcattggtcgaggttgggctttggtagaagaatggctaggatttagttgttctcgagtcgatgctgaaataggatagcatatcagctcgtatttcatgcataggctatgggtagtagaagggtaaatggttggtatggagttcggatagcaagctgattgaggtaggataaatattagctagggtttaggtgtttgctagttgctgctagagttggacagtataacgactagaactggtatcttttctagccggtatcaacggatagtttaatggctagagggataggaggtttgtgtgggtttagtggggcggaagtgttactccgacaaccgtgagtggcggcggaacagctaggatcacacagagcccaatagctaactgtgcagcgtgctgtggaggtcgagggaatagtgtagctccgaccactataggcatcgaggcgtggggtgccagtagcagcacttcgaccttaggtttggttttgccgggctttacaaccaacggcctgatgtcggggatagtaaaccgcgagcgtccccatggaaggtgtaaagttccaactggcggctttttagtggctaaagggtattttgggacaaaaagaaaatatttaaaaaggcaaatataaattcaaactatatttgaataaattcaaataaaattataaaatagcaaattttgtgtcaaaagatagggtttgaatttagataaatttaggtccaagtttcactgaaatcggatctacggtttaggagatatgggcttctaaagaataggatttgaattaaatagggaaaatacaaaatgttactgtgcaggggcccacctgtcagtctttctttttctttttctcttctttcttcttcttcctcccgtcatcttcctcctctccttcttcccgtgtaacaacagagagagagagagaaggggcgctggggctccagtggccggggatcggcgacgtcggcggcgacttgtgttcccggacgacgcgcacccggggaagtcggtggctggccgagagagaggggaagttggccggaacggcaagtagaagagcttctcttcggctgcaaaggaggtgttgtggtggttgctatggggtgggggagaagggggaaacgggaaaaatgggttcgccggagggaggcaaagccgatggtgcaaggaaactaggagggaagctataggggaggagatcgaccgatggcggcgtcggccggacttggcaggagagagagagctcgaggagctcggctatggggaaggaaacggggtctctccggctatatataagcgaggaaaggcggtggttagaggcggtttcggaggaggagacgaaggggatcacggcaacggcgacgtgaggaagagaatgacggcgccggcttcgttctcctattggctgatgaaggcggtttggtgcagtggctggcgtcagcagggtgaggtggcggttgacgtcagcggcggatgcttagcggcgaaggaaagacggcggcgacggctcaaagttgcgggcggcggcggcaaagccgcgaacggcagcagtggtgacgtgggcgccatgaatacggtggcggcgctcacagggaggaggagggaatcggtttggctgggaggggtagctgggccggcttgggccgtgcaagagagaaggggaattcggcccaatctaaataggaagaaagtctaattttcatagaggtttaatttagaggagagtttgtaattggaagcaatttggatggctaagttttacaaggaattcgaattcggagaatatttgaataataaggtttgaaaggaaattatatccaaatataatttccagaagagatattttctgatttatttgagtgcgatatctttagaggtgaagtttgagggaatttatttggaagcactcaaataggaaataggaatattcaacactataaataatatggctctagatttaaatatttttgagtatgtggagggaatatggaaggagtagaataaatataattttagcccaaaatatatggcatggattctagagaagtatttgaggctaaaaaggaaatttggatcgagaattaaggataggtttaagatcaaagggatggtttaacaattattggaggtttaggttcaaaggaggattttcttggaccaattcataaaagtataaaggattttcaaactaaatttaaataaaggaaatatttggtcgaaagaaggtttaagatgcaaaatcaaatcaaagagaatacctcaatttaacgagaccaatttttagaataaaaccacgaaagattttaaataccaaaaagggattttatgcatgttaattttaggaggtccctctaattgtaatttcttaggtttaggaaggttattaagaacataagaatcggcatgatgcatatttagaaaatagcatatttttagtatgttacaaacaatcaatggacttgttaaaattcacataaaggcacacatgttaaaattcatgattgaaagcatggaaaaaaaatcagcgcactacatagcttgcaaccatcatatttggacttgctggtggatgcaaaaaacgtccacttgcaaccctcctctgctcgcctacactttgccctaaacctatccttgttttttttaacagtttggaaagcataatcatttaagattgcatggcaggttactgctgatttgcactcatcaacatcgcgaaacagcacatctacatcaatgcatggatcattaacatcatatgaaaaatcatgaatatcatcacaatcatcatcatcatcatcatcaacaatttcatcatcaggttcatagctgttgtcggagtcagagcattcagaatcatagcaatcagaatcagatgatgcagccaagtcagtgtcatagctactatcacttagtgccaccaatgattcagtttcggaatatgagccctcctcatcaactccgactgtctcatcactgacccttttccttgtggctcttttggtatgcttagactttgaaataggtggctctaccactttagctgtgggtagggttagatcagcaggaggacacaaagaaatatgtggagcactttcaatttgcagctgcacactatttctgaaatttggatggacccttctttttgtgggagagcattgcaatgggcctttaaattcatcaacatcggcttcaatattggctacttcatgagctatgttcagcgataaccactcatgcaattgctcatcactactaatctcaacccaagcatcatcacaaatacgccagaaagtaatgtattgtttagaacctcacacaattttagagccgatgaaatcaactaactgcagcaatttgaagctagctatgtccacatctgttgtaaaatgcctacttgtgaaataggtctttgggcccccatctggcaaactaaaatgtgaccttactctaacatcaagaatcaaattacatggaacaggcctacaaataggagcaacacaagataaagaacaactttcagtaaaatttttaggtgcttgtaggaatggagacaacatacaacatataaaccctaggttagattagcaatggagacaccaagttcaattagagtaagacacaacatctaaaccctaaattagcactggacacaacatctataccctaaatttgcatggtattgcatctgttcctataacctagcagggtcacaaccacaagcatgcacaggttcacaggatcacaaccacagggtcactgaaagagaatagagggaaaatacctttctatggtaggaataccttgcatggttgagggagcgtcgatgtcggctacctccgagcgctggccctcctaccgtcaccgcgtgtagcacccgtcgccgccccgcaccccacagctcgctgtcgtcgcccccacagcaagccgttgccgcgccaccacagcaagccgtcgccgcgccccacagctcgccgccgccaccctctcagatcggcgccgccccgcgccccatcaaaccgccgccgccctccacctccacaagcgggcgccagcggggctgtacatcacgccgccgccgcctcctcagctcgccgccgcctccccacacagatcggcgccgccgcccccctcagatcggcgtcgacccggaccggacgtgccgccgccactgccctccaccacaacgagcgggcgccggcgggtctgtgcttgacgccgccgccgccccctcagctcgccgccgccgccgcccccttaggccgccgccgccgcacgcgtactcgccgccgccgccgcacgcacgagtgagagagaggtgagaccgtgaggaatgcacgagtgagagagagagagagtcataatagggtttgggctttggagggtattttcgccattaggaactctgtaaagattttcttttttaaaaaattgaaccctaacggagttagcgaaagagggtcagtcggaagcttcgtactcgaaaaggagggtcaaataagcaaagttcaaaaagtagggtcaaatcggcaattacaattcaaaacagggtcaaataagcaattgcccctttaagaaacgttcaaaacatgtcaagattattcccaaacggaagtatcttcttgcctagacagaatattagtgagctgtagtgacatttctttgttgaaaagttgaaatgttcttatgagagcggaaagtgctgccatttcaaaagcagggaatgtgtgactttgcgtccttttcagccaatacactatcattggcacgctttctgtgcttctaaacagttctccctccattttatattataaattgctttgtttttttcaaatttatttaagtttgaccaactttagtaaaaaaaatatagtaacattttcgatataaaacaaacatattatcaaaatatattcaatgttaaatttaataaaagtaatttggtgtttcagatgttgttaattttttctataaatttggttaaacttaaaaacattgactaggaaaaatgttaaaacgactcataatacaaactggaggaagtatgatttttataaaaaagaacttttttatcaatatttctattaaaaaaacaaacttttcaactttctaatgtttagtttactcatttctgcactcaaaaaattgtcataaatccatcagatataaagaacaggctgaaatcgtcatttaaagatagcagatatggtacttattaacataatagcttggctttctcttaaagtcttaatagtatatacttatatacagtagtatacataaatggctttctcttaatatataccgtttttatctcttgtgagtatcatgtttctgtggctttaaaatcacaatgactattatatagcatctcttttacaatgtatatagcaatgagggagtgttcggctaggccccaccttgaagagagagggagaatagagtagcaggggagagatatagggcctgtttggtatagctccaactcctaaatttaactccaagagttgagtctggagtggagttgtgaagctgcctaaacccagctccacaactctagttcattttgtgagagagttccacccagctccactcccagttttggtggagccgaaattgttcggctgagctccaactccagaaggggtgaagctggagctggagctgtgccaaacaggcccataaacaatgggctattttattccttgtgatagtttttatggctaacggtggatcatccaaaatagatctataaggaccatcttcacaacatcttcacaatatacagggacggttgcttgagaggattaagaccccctctaagatgtgtttagttcacgtcaaaattggaagtttgattgaaattagaacgatgtgacagtaaagttgaaagtttgtgtgtgtaggaaagtttttatgtgatggtaaagttggaagtttgaagaaaaagttgggaactaaaccaggccctatttctacatttgtgaacgtcctaagtcaacgtgggtatagccaatcaaacaatatgcataaactaaacattgttttgtggtaaaaacaccaattcagacaacacgcataaactagacagtgttttgtgtaatggtagttgtaggaatattagggcccggtttagttccacagtttgaacccccaaaacgtcacatcgaacttttctacacacacaaacttccagcttttccgtcacatcgttccaatttcaatcaaacctccaattttggcgtggaactaaacacaccttaggatatgatcagtggcgacactagaataaatcggaggggggtgcaccacctcaaccgtacatgtagtggcacacggaattttgaagacatgctatacaagataacaatagtcgatagactatcaaatgttaaacatcatactagatgatggctaagtgtatgatgaaaatgtaattagaaattcctactttataaaatgtaaagtgaagggggcacaataaaaaagatactcaatattgcaagacacatttaagcattgaatagatacgtttgagaggacatgaaagaagagattgagaagatacgcaaaataaggtaagttattaacgtactgattaactgagtattagttatttcaaactgaaaatagattaatatgaatttcaaagcagtttttttatagatttttttttagaaaaacacaatgtttagcagctcagggggagcttgcgtatgaaaaacgagggatttttgtctcccttatgcatcaaactaacgcacctagactagttaagtgggagtactatatattggtgtgtgataaaatttaaaagtcaaggagctagtgccataactcttcaaattgaaatattagtacttaggattgatctgcaatattactccactttccttaatcccagttcaacagtataattatttaaatcctaaaatactgtctagaaacattaaaaataaaaactaaaattgaattttatatctaaactttaagatttgatgtgaagaaatcagacaaactaaagaaataagatgacgaagttatatgcccttgcctctatccaatcaactggcgatagacatgatcagtaaaacgaaaaaacaaaataacaaaatagtaggctcgtgcgaccaagtggccatgcggccgtgcggtcgtcccgccgcactctggccaggcattggggttgcgctttggccaggcattgggggtgcacgtaaccgagctgaggggggtgtacatgtagcaaaaacagaacatcaagtactgaaaacagaaatacagggttgtgcaccccctcagcctgtatagcttcgccccatagaaaagatttgattagaatcttttcttatctctaatacctttcaattctctatccgtgtaagagcatcaccaagagtatcctaatatttcattcccaaaactatttttataggaatcctaaacaaaatttgatgtgctaaaatattgatccctccaagagattgtctaaaattgacttcctaaaactaaaaggtgggccctctacaaaaccactaactgaaatttatttccgtctctccctctgtgagatcactctcgcgaactcctgatcgcggcctcgacaacagcacatcaacagcagcaccagctgcaaaattcaggaaaaacagtagagaacaatagcacgagaaccagcaagcagcaacagataccttaatcttcagcaagtgagtttgagcaatggtgcaagagcagagattgggatcattcacttgcatcgctgaatgaatcaccaacggcaaactgcttcgacggatgaactcatcttcatgagagaccaatcccagcaaaaggaatgagcaactccggccgagtcatggatgatgggagccgatgcaggcgggctgatttgcgtcgtatcgaggcggtggctcaaatggaggcagcgaaggtggttgggggatagacgaggaagttcaccggctgcagtgcagatggggccgctgccgctgccaaagcacaagctgccaacaccggaaaagctttggggagcggcgcatgatttctagccggccgcggcccgcgggggagatggggctgcctgcaggacaccacgatgaggcgacgaatgacctcgcggcgaaccccgggtgagaaaatttcatgtggcgcgggaattcgctcgggagagggagaatgggagctagcgcctctccccacttgtggagaacgaagaatccgggcttgggaattccaaccggtgggagcttggctagggattctgttggactgggtttttgaacgaaaatccccaaatttcaggattggaaaccatatacagatactgttggtgatgctctaactataatccctatatataccagcctaggaatgaattggtatgcttgttgcttttcttttttttttatttttgttgagacgcaaacttttgttaaatttgcagatgacagcaaacatgtgcagcaactacaaggtacacaacggccaaagaagtggttaaacatgaagcgatgcataccatgtttatccaaaaatgatgggagggtttaataacatcatacattgcattcagggggaaagaagtctatcatacatacaacgccctcgtgatcagttacatttacaaggtcttccatttcaaggattccccagaggcaggagtacaagaatacaatgtggaagtggaatgcttataatacatgcattccatgtacaacacaaatattacatgtatagatgaagatccaacggtaaatcgaattatcttatataaaccaaaaggcttggaaccaaatggtctatctatgtacagaattcaatcatatactgaaaaatggtatatcagcaggggagagagaacttttaccagctgaagcatcaatttctgcatgtagcaaagtatggacattactgatcttcagcgaaaaagttcggttctgcaggcttctgtaataaccttgcaggcactctttcctgcaaacgggcctttcgagtggcatttctccgtaagatccgcatcatattaccagcaaaacgtgaagcatatagcgccgcaccaagactgagcgaactcgaaccatcactgacaattgccgcttgcaacctcttctccttctcaaacaaagtatcctccagtttctttctgcagtatctatgccaagctgcctgtataaaacaagctgcccaggttctccattgctgtgaatagaatctaaatgtatgctggagttgtttgctgtggagtctcctgaattgggtggctacaaacttcaagtcatcagccctcaaagcaaaagcttcgacttcagacagcgttttcacagtcctggttgagctgggaaggtttgaagctgaagtagggtcaagtgcccatgtgagaagctcttcaccacaaaaatctccacctttgataatattggagttgaaaaagccagtctgtccaccatttgtcgtcatactctcaagatttcctctcatgatgaagagcatttcattcactgggtctccttcgcgaatgatgcagctgccttctgtgtacagcatgggctttagacgatcacacatggcatccaagagcttctcatccatgttttcaaacattggaacctgcaaatggtgagaaaaagaatgaagggattaattaactaaagggatagccggtaattatcagctaactaggaatctttgtattaagccatcaatga

SEQ ID NO: 8801 - DNA, 1529 bp, Oryza sativa
taaagtatacttagtagggatctgttgcaatgcacggttgtgatgctaattaaacagaaaaatgatagggaaggtttctgcagtcagctctgtgttgcagagttactaaagttggagctctgtggcaggaatccaggatagagagtagagtacaagtcttgaaaggctgaaaccagttttgcatatcaactttaagaattggtgttgccgtaagcatactagagcaaactcctttctccatgcttcacagagaggaactccagtgttgaaagtgatacgatcccattgtttccaagtttgtctagaaagttaggatggtttattttcctagaagtagcatagcggaatgctgagatatgtcttttgcagaatactggtcagtggtccattagaaagatatgttccatattacatgcaaaacccaccagcacactaaaggagcagccaaagcagtgaaccagtcatgaatttgcactttgatatggcaacaggatttccaaagcaatatgaacagtcatagaacctccctattgttgatgatcatattgtagactggtttatagttgaattgacaagtattcagaagctgacaatacaaattttctaaaaattcatatggcgctttatagaatacatggagaaggaaacaaacaatagggtaattgtctggtttgttcagatagattagactcaatagaggacaacaacgagtggctgactttgctgaatagttcgtggtaaaacaatgtccaagaggtaagctggaaatgaggcgacttacaagggatggatctttcagtcaactggtacagtcctggcctacatttgtaaaacaatgcccacgaattgttcattccataatacatgattgcaatctcccattgtcttccttcagtaaattagaatggatgctctaaatggtatgactatgctacttaagtgtacacacaaccaagaccaactcaacacagacacagtccaaagcactaaatgttcctatcttattgaaatttggtcggtcagtctttcagccggcctggcagaaaaaacactaaatgttggactgtcaaaaatagtactttagtactccctctgtcccaaaaagattgcaattttaggagtgaggggggcaaattagtagggaagggaaatgacctagattgatgaaacaaagttatactataggattgcatttttttttgggacagaatttgaatgctagaattgcaatctttttgcaatggagggtgtagactttaattggctatactaaaccagattactgattagacttcaggaactgccagacttacactatgacccagaagaggaaaggtctgacacaaaaccagaaagtccagaactaacatctgacaaaaccagtacagatgcagctattcaaaataagcaagaaacttggaatttacaaaccacatgcaaattgtttttatgtaacaatctaactaatggtccttgggaaatagaaggcaagaaatcaatcctcaacatatgatttggcatgacatgca

SEQ ID NO: 8802 - DNA, 13978 bp, Oryza sativa
  unsure (1)..(13978): unsure at all n locations
catgacatgcagttgggcttagtgttgatcgtggaagatgcatgttgtctcaagatgaaggtatgaaagattgtgcgagtctcaagaataacccttttcatatacacccagatgggacaagaatcaggattctctcaaaacatagtagcaaattatgcaaaggtatgagaaaataccctcatgagaagcgacaggcaaagatgcctctttatctctctcctaagattcttaggaagatttgaaagaaggccctcttcatcaacccctcttgtttcttgccacctatattgttcatgacgcagtattcgctccttgaggttatcaggaagtaatcgatgtgccatccattgctctgtgtcacgccgtttcactctcatttcttctatacgcacagaggcagattgtagataggtctgcaaaatacatgcaatagaaaattacgaaaggaagaaatcgagccgcttacacatttaattgtcatcccgattacaccttaaacaacagagttgttttcattacatgtaatataagtaaatagcattgcaaaaaaggagctgtttaaccctttaatttttaaggagaaaaaatgatacataaagagaatatgaattggctatataactcgttaattgtggcttctattgaaaagacaatatgcatgccagagaatagataaagagaacatgcatgtcagagaaacacatctacagtgtactattttcattaaaaaagatactccacacaagttgcatatataaaaaatattaactacttaatccaattatgatcataataaaaatatgacagttgatatattccatacctgcacattaccaataaggagtgcaaacaaaactagacctgatgtcgagacgaaaacagcaaatagattctcccatgtatacgtgcttgtcttaagattttgaccaagagaactgcaacaaataaaaaactatatagaaacaatattgaagtatgtgttcttcaagggaaaataaaacgaaggttatttctacagaccttagattttgcagaccccaccaaaagcaataaaacaatttttcaaagaaactcgttgattgtgaaacattttgaagagctggaagataaattccgaaagttggatctgcattgtcagttccatttgtcgggcaaaaatcttgtaagaaactgttatttctagctgcattactcccacaaaataaagatcccgaatcacagccatcatgtctactacatgcatctttccaacaggtgtcttctcgttgaatggaaagaaggtaccaaagagctccaaggacctgcaagcatttaaagcatcagttagtaatatcttgaccatgaataacaaaatatgtgcaaactgactagcctcttatgaagaactgaatggcgtatcacaggcatgcatcttttattttattttattttattgcagtatatctacaggtaccagatgcttttgcagacattttggatatgccttgttttttctgaaagttataatggagcaattaagtgactgtcatggggattgggctgagaggtcaaggccccagggcagcccacctgtcaagagaatgatatcgccgcctcgtacacgcctacatgatatggtattggttggttagagtctgttggataggattagactggcccttccttccatctatgtaaggatggatgtaacatcgtttggatcagcaatgaattcagaatcagtctccctcaacctaagtcctctctcacccctagcagccatcgctgccccgctatcctcctggcagtgtttatccctatgaaccctggcccataacagagacaatcagttcttcagacatcaacatggtgtccaatatacttgcccatgcagaaagggtaatgttggatgccctctataaacccaggggacaggctgcaagttctaaccccagtgcggggcaggctgtacatgcacatcgcaacttggtttttggctgtcgcttatccagaagaattaaaatgggcctgcactcatgctatagaccctgaagcatcataatatcatttgatacaatttcatgtatcaaccccatgcagtaacaaagtggccctaaacttaggctaacttaagctaaacacagtgttaccacaaagccaacatgcgtcaaacccaactcggattcatatgtctgattcgacatgagaaatactactcgggatcggacatgggtgtagaatccaactcagactctgggcatccaattcagcaaacagttccattgattgctaagaggatatgtccaagatatgatcagctcatccacatatacagatagccagatattgtatgtatggcatgcctcactgtgacaacacattttattgtttctactacgaaatacgatatatagttgcctcagacaatatagagcagattgttaaactaaaaacatggttgatactggatagtggatattactatggtactattgtgctgaaaaatctacattaaacatgttgatctttatttcaatgatgtgacaaagctgaagctaacaagcataaattcttcatggacacgcatctatgagaaaaaaagaatccccatatgacattttttttaatctttgtagatctatgtcccaaaaactaaatactaaagttcattcaggtagaatctttcacgaccacaagcaaagaactattgtcaaacaatattcactgaattatcaccaagaatgaaaattaggcagaagatataaaatggcccaaattagcatgccatgtaatttgtgatgtagaagacttacatgactagcaagcatataaattaaaaggttaaatgcagcaccagcccatgctgtctctgtaattataccagccgatctggtgatttgaaggtacaatggtattattcgaatcaaccgaggtacatattgacaaataactataaccattaatatattttttgccgtcataactgaggagccttgcagacggggtagaactaccaatacgagcacctgataacaaaaataaatactgttacaacttaaacaaaagagatccttaggaatgatacatcaagtcaaccacataacacttgaatgtttgttctacctttgcaactcaaaacaacccgcacatgaaaaaggaacaaaataattcatagaatgcatattcccaatttgttcccatccttacttgtctaaaaacttattgcatgcatgattgagtcaaacatgtatatgtttcatgcataataaaaaccaaacatatcttcagtgcctatattttattatcttctggtttgtattatccattcaattgaatcccccacctatgatacaacagctctatccaatttggccactagaaagcatggaagttcatcaaaccatggtgtagtggcacgatcagtagctgcagatcaatcataaatacatgtcgttttgcacattgacatgataccttaaaattgaactttgaccataactaatttctattgtattatatttaagacctggtaaatttgaaatatatggaagtatttctcaagaaaaatctatacacattatcttcaaatgtccagtctgaatatgtaagtccaaaggtttgtgacaggagggggtagggtacaccagagccaagacaatagttcttcaaagtttttttgaagtgtccagtatatctaacagctacatttaactgattactattgcgttccttaaaatcgtacatgagtaaagtagtacaaaagtgaatgcatattaatatactatgcaaagaacctttatgaccctaacaaacaccagacttataagtagctcattgttttaagtgctcagatctaaaagattaatgaagtaaattgcagatgtacctgaggaaggggcagaacagctaagaaatcaatcagaaaatatgttgatagataccgctttgctattgcaaaggtgtcctcaaccaagacacctcgaccaaacactctagaggaaggagcaataaagcctgtcctgaactgaaaaattatatggagtaaatagaatatatctgtaaaaaatcgcaggacacttgctatgatttccaactttttgtccagatataagcagatattgtcaccatcaatcactggaatatagaagaataacgggtccacagaaactgcaataaggcatgatataacaaatatcttgttccatctctgcaagaatggcccttgaggatcaagaactcttgttttggacttcttttcctcagaagctggtttgttgagggtttcaggatgtgaggaattccctaggaatgaaaaggctcctacagttctatccattagcgagtcaaacacattatgccttccttctaaaactgtcttttcggaaccaacagaatgttctgatctccagtcatgaaatctgcacataaaaaaatagcaggtcaaagtactcctcggaataatgtgcatggcagctatttatattgcaacattttttcagtgtagtagaataagaaatttctgtaagccataaaatgaaccaaattgttagtcatgtggagtaggccttcatgaaatctgaacgaaataaaaattttgtttcagacaccaacacactcttggatgttggtacaaggagtgcacagaagctgacctcacatatttgtcctctcggaaagccatggattccaccaaacaccagcatgcaaaacgagaccaacaaggcagcagaaagggatcaaatcttcaatgtcgcattgcagtatcaactccctgacggtcaccaaccataaatcagtagcatccctcaaaatgcaaagatagcaagtacaataaactggacaaaaattgtgtggcccaaagaccaaggaaagaaatatcaagtccaataacgcgacaaaatgtagataaatcgctagtttcaatagaaaaattatcagtcacaagtgaaatgacagctgtgcagcttgtaattaggcaacagcgataagataagttactccaccaaaacaagtaatggccacataaagtatagatcgagtggtaacgttagcattcaacaattcggttacaagtgagctgaaagtggagctgcaatttcctgctcagcttcaacaactaccgaaaacataaccggtttgtgcgcttgttgggaagaaacagccaaaacaaagaactctcgcggagcagagaacagtaactagtacatgacgagaacccggtgccctgaatccgaatcagttcatggatattcacactacgggccaccagggccaccaattccactagtgaatcgcgcagggacgatggggatcattcccaaatcctgagatgctggagcctagcttcccacctaaccaaaatccgcgaaacctaccccgactgattaagatctgagcgagaagcggcgagcagacgaagtagatcggggggggggggggggggggctaancnggagctatccccacggtggagggagggagggagggagggaagaaggaggaggagcaaaagcttaccggaggggcgcagggcgctggcacggcggcggaggaggtggtggtggtggagaggctactgcaagctgctgctacgaggaacaggcggcggaaaaggccgagagacgcgaggggagagcagagagagagagagagagagagaggctactgcaagctgctgctacgaggaagcggcggcggagaaggccgcgagacgcgaggggagaggagagagagagagagagagagagagagaggagaggagaggcggagttcaatgctggcgccgcatgatgcgggtggtggcggtgattgccgtacgccgtagggaggggacgggaggtggactccagctcgaccttgcctatcgtgagacggtctcgcttcgcaaccagccgttcccccgttccgtctagccactccggtgtttgcttggtaagccagtcgcttttctagttccatacatttaaattttatgcagcgaaaccaactgtatcgtgtacttattattattaacactataactgatatcgataaaatttttttagactatcaaactaagagttcataaaataaattataaacttcttatacattaaccaatacataataatcgataataattgaacatatattcatgaacgaactaaaatcgctgaacacacgtgactactccaaaatccacaggctattgtctctttttccatcgcttctctcccttatctttctctatctatctaaactgcatcatgttctcaaaagaagagaagacgaaggtgtgtcttggatctggattagtgtggcttaactacacatttacgaggaagcgttggtaaaggtgggtaggcgaaaaacaccatgacacaaagaggcggaattcaatgctaacttatgacgtggaatgacgcattaatcgtcatacaatataaggagaggggaggtgaacccagctcaaccaaatcatcaggagccctaatacgatcatgcaaccaaacaaccaaaatattccatattgctcgattcacaccattggtatgcttgtcacgagctcatctctagatatgtcactgtaccatcttccatcttccagtatacgtctttattacgacaacctccaaccatttcaaatacatgccactacatctggttaatcgctaaaaaatcatattagaactagatagtgatagatttgtgagccatatcatttaatttacgagacaacgttttcagttatcactactactttttctaagtattataactaccgtgaataaagttttattttacatatcttctatggtgcataaaattttttcaataataaaaaaaatatttgtgtggcaaccaattgtcgacgtttgatatcgcgactatggtattttgcatagtatggagatcattggtacaagggtatatgcgagattgaggtaaaacagatggagacaaggatttttatacaggtccaggccccttatttgacaggtaatagccctactactgttggttgaagccggtgtttcttatttatcataatcacaccggtacaataattgagataacttatctagctattgtcgacttaacggcatggataaccaactcgtagtcgacgacagggtaatcttcttcctcgagtccatactcggcgagatcagagatagcgctagatctctcttgttggcctccgcagatactatattgggtttgtctaggcttatctctgatatcgatatccggcggcttgtcttgacgtgtgttggcttgtattgatctatgttgatatgttgtgtcttgtggcttccctcctctcctcctagggaggcttgtatttatacccatagatgcccccttatccaagtggaactagagagaccaatatggatataatccgggtagtccttgtcgtttccatatagaactctattcgtccttcaatatacgaggtatgattccgtataagacatggtacatggtggaccatgccgagcttagtcaactaatattaggtatgtggtatccataaccatgacaccaatatagtagatattgcttggatagacatccgagtgaactaaaatctttggaccccacaaccactctatagtttattgagctatcggccattttccctcgttgcttctctctttgactctcttattgtttatatatttccatgaaacctccgtcactatcaacatctattcataactctttatatttccttccatatccttaaaatggatggaacgatagccgttggttgcactttgggtgagtgttgaccttgcgacaaccaagatatgatcgtgcgatgcaataatgggatcagcatggctcaatggtaaggaagtttgtgaccatccctcctctaggttaatatgtacaagctaactggaataatttttctctatctattattttctcgtaaactgtgtacttctataaagattgaatcaacttataaaaataataactatagagtatagaataagatacattgtttattagctaatatttaaaacaataaaatagtcagagcttttcttttaaatagtgtacttgtatatgttagacaagcatttcaagaaggaaaatctgagttcatgttccatttattttaccaaccaggtcttccatatcattttttttatgaaaatgaaaggattttgatacttgtcatgaggtacttgtggatgtatcacgacttatcgatcgtcataggtatataaacgtaaattgcgtcaatgttctacctaaaaatttagaataaccgtactacatattctacgtaataagagtaaggaggaacaaactaccattgcaacacctcgtgcagttctaaactatcccaatttcttttaaaggattgtgtaatccacactcttattaactttggaccattttgttttaaaagtggctccaacagatataatacattgtgacaaaaatcttatattgggatcatggttgttaagtcgtaaagttgagatcgagatacccctagactgacctgtcaaattggttgactagtcaattacttggtcatgcaaaaacagggatgcaatatatagtctttaccactgttatactatgctaagcaatacatgtagtattactgtagagtagaatgcaagatgataagttgataagaaataaaactgaagtactaaacacaataagccaattggtgaattggtgattttctacgactaatctatgactaaccatgactaatcgcatgacttgttatttggtcgagtcgtggttctctagtcgacttgcttgatcgactttactattaatcgcaactagctgggtgacttgataacaatggttgggatgtatggagatttctctatttgacccaatcaaaccaagttcagcttataatggaagatactatggtatgtgtgatggagccaacgacacaccattgagcccagttaactaatatcatttcccataattgattacttttttcatacatcaataataaacaatagagaaccggtagcaaaaaaaatgtaaggatgtaatccgagcggccatccgacctagcaggaggtggctccgccactagtattagaaaaacagaagagtttatttttattttttgtgcacattgaattcaattttattccatatccctgcatagttaagggtgtgtttggatggatattatggcggcttgtattttgtgggtgatggtgggtgggagtgggatagggcggcccagagagaaatattccccttagataccgtatggagggatccggacgatttgcccagacgcagccaactgagcgccctaacggatggagggatctttctgtttttctccctttcccccttttatgtgcgtgtgatttttttatttctctttagaattttgtttgtttgtaatagattggtacttttgtcggccttgtgaatttgaagggggtatactcaccacctgtattcaattgcaaccattcatctatcatactctctctaaccaaaacaaatggatcaccgaaccgaccttcattcttacaagtaaaaaaaaaatcttagatagccatcttcactcaactaaaaaaataaggccgccatattccttttcagttaaatgcatgttacatttgtcggtaatatgtgagccgaagtcacgtaacttcgactgcagatgatcctgattcgaaccagacgtgccctaaactcctgaataatcattattataagaaaagaaaaaaaagaattcctagaaaccggggccatttctagcggagaggaggcagggtccccggggtccacccatacgccacaggggaatctgcccacacccacaccaccgtccccttcctccttcaccccgcccccgccgcttcctcctcccctccaccgccccacgcccccccagatcccccaaccccattattaacccaccgccccccgcgcgcgccactggatctcgcctcgatcgccgcggtggcggtggggaggggagcgcaccgcctgcccagccatgagatggtatgcttcgctagcctgaggagggctctgcctctgctgctgcgcgccaccaccaccaccaccccccgcttccttctccccagggccctctccggcggcgttggcggcggggcggcggtggatgcgcgcgcgcttctccgtgggcacagcgggtggcgcgggctccgggtggccgccaggatgatgctcgactcctccgactccgccgccgctgcggggcagatgcagccgcagcagcgtgcggcgggggccgtcgcctgcagcgcgcaggacggtggtgccgcagggtacgccagcggcgggtgggcgaggtaataatgataataataataataataatgaataatgcgtgtctttacactttcatggttattatagctctatgtatctgtttcgatcctaaaccatctcgttttcgcctctagtgtgaaatgaaccgtgttggcatttgaatgtggtcctttgcgctggggaattggtttggtttgttcagttgtcctgtggtggtagccaattagcatgaagaaacctgctaggccccaaatatgaaggatgcaaatgtagcagatattctgattgctattaatggcttagtggattggttctgcatgatattattcgcgcctgtacaattttgtgaaatagttaatgcgtgaaaagcttatcgtaaaacagtaatgctctaaaaggtggtaattgcgtgctcagcactattctttgcttatagataacaatcttccatttttgtggcaatgtgccgatgcgtatggatgatttttatgtagataccggaagtagtatatacatatgcaatgagttaggggctgtttgattttaagccctaagctgacaaaccaaagtttggcaatgcacatgcttttttgtcctccatttggctggtgaccacaatttgtgtgccctctctatttggcaaaggtaggcaataatttgtgtgctctctctatttggcaaaggtaggcaatagacttaccaaacttttggggacaaaatttgaatggcaatatctgaccaaattttggtggcttagcctatctccatgcccatataaaaaaaatattggtaaaaccaaaacatgtttttttgctacttttttctctaggcacacatttagtcacggttattagatttcaattggacttatagatgatatatatataattatagaagaccttagttttgtatgatgcacaacaagggcgaggtatgaacccatgatggcataaaaatccattgcctagtaagatttaagaatgtgccagcttttgaatttatgattataaagatttaagtacaagagaggaggccctattggacatatgagcttagttccaagaagatcgttatgagtggatttttacagcggatgaagaaacatggtatttgccatactaaagtttataaaccgaagagtatcccaatcacccaaacaaccaaacaatacttgtttgaatatccaccataaaaagtttggttcactttcatgccacaaaaaatgttgaagccatctcagatcagacatatcactttgttcccttccatccaaactcctgactcactaatgttgactcatgcctaggccatgttccatctagtctactacctaaacccagtcgttctgtgctcctttggtccttccccagaattctgttcctgcatcatcttcacagttaatgtcctgcaggtatgatgtttgtgtacccactcaaaattataaggacataattactcctaagagaccaaatataggactacatacatgattaaatagctaatacacgatcttcctcataatatcgcctgctgcattcatcagccaaaatgagcaaagctcactgaaatccttagctcctgtctttaacatactcaaactgggaagttagtggccatggcagcatgactggagcgataggttgtgcctcttacatatggttgcgatggagtcactatctcagcatggaagagcacagtgagggtgaaatcatttgatatgacactgattctcacttagcagggagggcgcagtgatgtgcttgtagatggacatggcattttggagattgcggggtactaggagtaagaaagtaggtaatgcagtggctcaagagacaagcggagcttcagtgaagaaagagtgtagggaggagcaggtctggttgagccattaaatatgatgggggcctggtgataagttgccatcagagactttggatggaagataccatagtggtatcagagagttgcgaagctttggttgtttttggtgaactagactttttatggtatttatgaaaaacaaaaacatttcgggctccttggaagttgaatgctgaaatttcacaggagtttcatagaggcagtttacatccaacaggaatcaggaaaaaaaattccatgttcaaaggagaccttaggttatatacttgatgttctccttaaaaagccatgcaaatagggatggataatgagcaagtttggctcgttagacttggctggtcaggttcattatgataaggagccaacttggatcagctcattaaccttaccgagctaaaagactggctcggcttattttgctaacttgagctggctcgttagcaagctagaaatgttcaaacatgtcatgtacaatttaatatttaccaatttatcatatattagcaaaatagtagcaccaagttatcatatattagtaaaatatttattaaatataaaaggatatgaagtaattctgacattaagtaatacaaatagaatggtcttttatacaaacatgcttaatgagtagcttgcaaactggctggcttggtattggctgattaagctaacgagctaaacagccagtttggcttggcttgtttagaacatgagttcaagctgaactggtccacgagctttgagcgttttgttcacccctacatgggaactccaaaaagggtacatatgcaacatgcccttaggggcatgctattgtacaagtaggtcaattgattagtgttgtcaagaaaagtaggctcctatttacatgattgcatcacagccatatggtactagtggcgctcaaatatatgttttcttaactttggatatacattgagcaccaaaagaggtgtaagcaagttacttttgaccaaactatgcaccttttttaggaaactgtcagtcatacatttcaagcaaaccagtactttatgccataatttatgtgattcccatacttttgtattgaccttttctttctcaattttggtaaagaatttgagcacttgacctagtcctgcattaataagaagactgaattgtgcgatggatcccattccttggaatatgaagtagttctataagtctgtgcttacacaatcatgatggcctcttattctagttttttcctgcatcctattttgactgccttaaaggcttaaacataccatgtttgttcaacatgcaatcatgaccgaatatatcagagtttacaatgtgatctcttttgctggaatatgggacaattaattttatctccaatgtttaaatttccatctctttacaagaatcattcattctctttggactcattatttgacatgctaccttggttaacgtaatgtccgaaaaatttgtgacagagaagatggtaaactgaaatgtggatattcaagttttagagggaagagagccaccatggaggatttctatgatgtaaagttaactgaaatcgatggacaggctgttagcctatttggtgtatttgatggtatggtttccatctttccttgtctactttcgtgattccgtgcccaccatgtttttcttttgaagatttggtgcattaggtcatggaggaccacgtgctgctgagtatttgaaggaaaatttgttcgaaaatcttctgaaacaccctgagttcctgacagatacaaagcttgccataagtaatttttctctttgattcttacctttccagttctctgtt

SEQ ID NO: 8803 - DNA, 7323 bp, Oryza sativa
tgctaacgattatttcctgtaccataatttaaggctagtgacaagggttgcttattttctagacattctggatctgatatctaggtgggatctgaattggtaacttaattactgaactcttgaaagaactaagtttacctgcatggtgctgtttctaatttgcttgggcatgtttggtttcccttcccaacctggctagccttggttcactctacaaaagtgcacatgggagtccggtttcaatactttctagtttttttattcagtttatatttgtcttccccacccatccattaacacctaaagtgcccatgggactcctgtttcaatattttctagttttttttattcagtttatatttgtcttccatacccatccattaacacctaaagattttcacttattcgttttttctagctatggcactgtcagaagatcacaaacctaacaggagtgatgagcggaagagaattgaaaatgcaggaggagttgtcatttgggctggtaagctaaatcttcattcttggatgcactgggcatagtttgcctttgtaagctcacatggacaaggcaggttgcacaaggcttgtccatttggtgccttctgatctccttgtagtttatgttaggttctctatgtcatacctgggttgtttagcattgcagccttatttacctaaaatcatgccatctctgtatatatttttctgtttgttttttaaaagtgagtttattcccaggtacttggagggtaggaggtgtactggcaatgtcgcgtgcatttggcaatcgtctactgaagccatttgtggtggcagagcctgaaattcaggtatcttattgcacttaatcatgctatgatttgtaggcctcattttatgtagtttaacctactctagttaaaggcttagcctagtctagatgaaagtcagaataggaggtatttgcagttcaacttgtctctttgtatgactcctctgctgtataattctgatcatgaccatatagcttgtgtgtgaagcttgattaatgtcttaagaaattacaggaagaacttgtcaatgaagacttggaatgcctcgttcttgctagcgatggactttgggatgtcgtggaaaatgaggtaataaaccaccaagcacattatctcaacctgaaaacgattcgaatttctcaatgaaaccactgctgcttatgtagcattgaacaaagcatcactttattgtcttctctgtctgatctgggtatacatttttaatgattgctaaattctctgataattctgttaccaaaataggaagctgtttcccttgcgaaaacagaagacctgcctgagtcggtggctaggaaactcacggaaatagcctattctcgaggcagcgctgacaacattacatgcatcgtggtgcaatttcaccatgataaaactgaataataagatgggactagagctgatgaaaggttgaaggtttttctacttcaagctactttccagcagtccaaccacagagggggttccccaggagatgttgctcctgtagcatttgctaaggattgtttcgttgattcttttccttgtgtaggaatcattttttgttttcagaggtgttacgaacagaaaattttatttcgagtgtaacacacagttttaattggatggatactaataaatcaattgcttgtttacctaattacctgccattacgggcatggcatataattctcgatgatatatagttcttttttggcaatagtagggtacataggtctgtttaatgttttgcatggtccgaatttcaacaagcttaatgttgattctgggccgaacttgtgtggatcatttggtccatttaacgttagtgacgggccaaatttaactatgctcatatgcataataacttatcaatagccgaagcaaagcgatacaacaattgcggtttagcgtacaccccaatgataaaatggtgagattaggcccgcaaacaacattatttggcctaagcttgttgtaactaaatttagcccaccctcacattaacgggtagaattaagcactgttaacacaggccggatttactcattaaacaatctgaagctggttaaaacaggccctaaaactgctaaatcagacggacaaatgacgattaccgtcctagttaaacatgccgaatttagctaacttcggcttaatcgtaagtttactgggccgcttaatcgtaagtttactgggccagagacaccagtcaccttagagcactgatcacacgcatgaacacaatgatttcagagaaaaaaaacctttcagtacaggcaagatttcagagaagcttgtgtatcagatacaaactgtcatactctggaccatatcttctccggtcgagaggatagctatgtaggagtaactccaaaatcaagatgcaatagtctacagaaagaacagtccaacgaaggattacaatctttttctttaacaattggcattttctagtgctctgagctgtatcttttatgcgttattgcatttcctgttggccatgaacaaaagcaacaacactcaaaagtacaaaaaaaaaaaaagagttcagtgataacacacaggagaacaaggccagacataacaagacaggaaaacaatgttacttctcaatgaaaataaccaagcacttgcccgcccacattctgcttaattgcttcctcatgatccagtacaccatttggagttgtgatcacgacatagccccactgcatgacaaacagcgcactgagtcagcaataatacactatgtaaaataaggggtgtagaagtgataatgaattgagttacgacgataactcaatcacaaaaacgctaggtaacaccaattagttgcttaatattaatgaaagtgggcaaaaaaaaccatgtttttgcgagaaatcaaatttgccaatgtggcctatcaccctgaagggatagccaatggtccatggatcttatcatttgctttgttttctgaaagggactttgcatcagtgacacttaacaaacatgctagttataattcttctcatcatccatattctatcaattcagctccttaaaaatatttttcaaaatggattttacactgccatgttgaaagagtttgctgtgtcagaaaataattgcaacaaagaagatacagtacgatcgtgttaactacaaacatcaattatgaagttttctaaggaattaaatgttcatgatactaagatattgtaggctactgtctgatctagttaaatattttgttgctcctatacatgatttactttacatgattgacattacatacattccgttactttcaacaagagagtacataaaatatctagcatttaaaaccaagaacttataggaacttcagcttcttaattctccaagacactatttgcagtgtaaaaaaggataagaagaatagtccaacaactaactaaatatttcaatggtcacaaattagtagatggaatacctgccgtgttggaagcatccgaactctgtattgttctatttccttggctctaatatcctgcctataagtaagagccttacaatctttaatccttccatgaagctctacattgatttttccaactctatggggatcgatgacctcaaactttttaatgtaccctgtaaaatattaaaagcccaaatgtcagaaaaaaactagacaggcaacatatgtgggctaaacaaatggagggcaccgagcaatatcagaatatttccttttgtttttcgcatgaagaagccaaaatacaaggagaaaacaggcgagtcagtatgccaagtatcattttgttttccttgggtctgttatcggtttattgcggtgcataatttcaagtgaccggtgcaatgcaaacactcttgtgttagatgaaatgggtataagaagctcaagcacagaacgatctagggaatagcaaacaaatgcccgacctgacctgaccgattgaagagataaaaggatagtaggatatagcaaagcctaaacatcaagctaccaataaaacaaaaatctagcatcttaagaatatgcacactcgccttcattttccgatagcaatccacagtttcccacaataagaaatgacaatgctaactctaactcatcacatttcgtccatccagatgacgcaaatataagacacaaaaacaagtcaattatctaatctagccgtctaggtaccgaaagatcccaaaaatcgttcttagcatgaccatctcacttcgtgttcgtttctgtagtttcctccgtaaaacccaaaacccccaaaagtaaagcatcatccctcacaactaatccaaacatttgctatgctcggtgggtgggattacttgagtaaagactagtaaatcgcacattgaacccaacagactcctcccccgcccccacatgaatgaaaccctcgtgttcgacagtagtagaacagctcaagcagcagcagcagcaagcagtgcagactacgcgggcggaagcagtaggggcgctccgaaatgaagaggaagcccacctcggtgcttcatgatgttgaggaaggagaccatgacgccggagatgggctgcagcagcgccgtcgccttccccctccgctccgcgttcaccatcgtccgcagcgcgtcgttcaggatccgccgccccatcctctctctcctcgcctcgccgccgccgccgccgccgccgccggagcagatggagttctgcacccgcagcaagggcaacgcacgcacgcacacggccgcacgagtcgcgggctggaaaggaggtgttattcggcctaatgggccttgggcctttggggttacagatgagccttctagggttgctggtgggctttgtgttttctttgtttggaccttcggttatcttgtacttcctccgtcgtagaaaaagattaatttccgattataatgaaaaacatggtatatatccgaaattcgtagtttgtattttcctttttcgaaagcgttgcatgtagtgagtgatttttgatttttgatattcacaggtggaactcataatgcgtctcgttcttagaaacaatctcggtctaagatggaaaaattgccactctcaaactcgtttgaggttagtcaatctcgaggtcacatgtagggataaagtggacaatcccataaaccgtataaaaattcgtttactagtttatttttttatatggtagtataaattttagagaaaaagaattaaataaaaaatgggataagcgggataaaaaatcttgcttgcccgtgccgcttgcatccctaatcacatgtgttgacagaagcacgattgcttagggtagctccacggattgcacttgatagagttaactgagtatcattctcggttcaagccatcaatcaatagtgataactacgctccaagctgatcagttcatttaaaaatgaagatcactttcaatgcttgaactctacctcttaactgcctgaaaagtccccattttttctctcatccccctagatctcctcctcccattcattttgtagtttctctaaattttctccactaaaaaaaggaagcatgcatattatgggttctcccaagatacaatactatggcaatcgctattggttgatggcttgaaccatggtaagagaatgtaaatgttttggtaatgcaaacgtaaatgttttcccatcactctgtgaatggaaacagaacaagcgttaccgtgctttgtttggattcgagcagaagatcacttaccgtaatgttttccgaaaacacttgatatcggacggtaacgagtttgtattgggtccatatcgcttcccatggtacccgatcccgtcgtatgcaaagcaaggcccggtcctgccaatttagtggcccggagcgaagctagaaagatgagccctttaatacaactctgataatataatgatgtttctaataaatgcaaacaagttatatatctttctcctgtgctttctaaatctaagttcatatggtctatggacttctatatctatagcatacatatatgttgtgaggctccttaacttcgagggcctagtgcgatggcatagctcgacccccctagggctgggccttaagcaaacacataataacttgatcagattgcagtgcgaatagattgtggaagaaaactctccaaccaaacagcacctgagtaaaaccttttgcgcgaagtaaggtcgaacacataaggcattgctacgattgcgtaacctagcttattccataaaggtgcttgccttttagcgaaaacaactagtacatacacatgacatagcaaaatcatgctctctcaccaatgttaacaattatttttggagggaagatcatcaccaatgttaatatcaacatatcttaacactgaaagggacctaacacacacagtacaccggcctggttgaaagttcgaaggatgctgttccagctaccaactactatacctcgcattgggtgacatgaatatacatctctacaaggcacaaggtgattactagctcacaaggtgatcatcatcattctgtcccatcatgcctgttttctctctagccatcttgtggaatgctctttatttcactgtcaggccgtccttttcccccacaaaaagaaaataatgctggtggctccaccttttgtcatcactgatcagctctggtttctgttttattttgagcttttgataattgagtaggtgcaccctatgatggctggtttctgggacatgccaaattttgcatgcctcatcattattcacctcttttggtcattaaattagtcctcctctgtggtaaaagaaaaactactcccatatgtctgtcttatgtgcattattatcaggaagagaatatggaaaggttgttcttgataagtactctcctcattcctaaatataagaacctaatactcgatgggattgtctatatttgcagtattatgatatgtcccatctaatattatgttttttatatcttgggacgaagaaaatactaggtaaggagaaacttttgactctaaccatatatgtgtgacctgcgaccacacaatattgttaccatcaggaaaaaattagtatcatgtatatatggagaacattaatttatatgaatacatcttccctatgtctactctttgctaggaatgaccatttcaacttatctattgccaaagtgcaatcatccttaagtccaagcaacccatcgaatatcagaaaacccaacaacaaagaaacatattgattaagtattaacattgctaatgggactcaaaactgtggcaataaactgcacatatctatat

SEQ ID NO: 8804 - DNA, 12160 bp, Oryza sativa
atcatttgtctcacaagaagaaatatttcagtccaagaagctatagaggatttgcaaagaaagtaacatgcataacccttttttatatggagatcatcattttaatggcatggagcatttagacctcaaggaacaacaagatattcagaaacacaaccccttcgactcaagtttgcaaagatatataagttcagaatagagtttgccttggtcacccatatatattttttagagaaggttttttttttacccagcctctatatccaatcgaatatatgcagcattttttttaaaaaccggaacttagctattccccttccttcccattccaaatctcatgtataaaagacgctccttgaccaatctttacctacttaaaacattggtagagtttttgtcttccatcaatcgaataatcatgatccttcatccaatagatctaacagcaagatccctactcctcgactcctgcccctcgctttccgtctccgccccccgcttcttcagttagttgatgagcataaaagaagccatatcggacatggagagagaaagaggagaactgatttgttgatgatcggactccaatcaccctaaacaaaatcagtattaccaaaggaaaaggaagagattgatcgattaatttcataggttgagttgatttgaacgcgatgggccgaggtcctgcaacgtgcggtggcaagagagctcttggttggtgccgactgctttgtgaggaggcaattgaggggaggtccggcagcggattcctatattgtcgatggatcttatcgatgttttgcatctttacaatgataagctatctaatgtgattattattattattgttgtaaaaacctgagataatatgtggtttaatatatttgtcttcacccattgcaacgcgcaggtattcttgctagtcgagtgtacggaagaagagaacaaaaatattaaaccaagttcaccatatcgtatcctgttgcaacgcacccagcagctagtttcttggaaaaaggtaagtgggtccggtgcaattgtgcaaatccccctccctctgtccctcaccggtgtgtggcctcgcttcccattggctccggcgccctcgattcgtacggtgaacggcaaggcacaccgcggcttaaacacagcgtttgctcggttgcaccggaaacctcacctcactctcctcagctagctgcttaattacttgcagctagctcagctgcccggaatggtggagatggacgccggcggccggccggagccaagtccaccgtcgggccagtgctcctccgccgtcaccatgcgcatcaacgcgcccgtccacctcgtaagtgctcaggctcacccatctgatctctccagtagcgccaaacctgtcaatctttcgatcggccggttaattaatttctcttctctgaaatttggttcttgcattgatttttgagacttcttgatcttggatgtgtgtttcttgggtctctctttgttttcactgataatgatgttgtatatgctagctcttgctggcagtttaccagcacacgctgaaacttcactgaaaacgaagattttccacgaaaaaaaatgaaataagtacacaagtggaagagaacaggttgcagaagttcagaagaactgaacctaaaaaaataagtgttttttcccctcgagagttagctgaatttttacaaatttaaatgaagccctctgttttagatatactcttctagtagctaatggacaacaacaatggaaaatggatcaagtgtatgcgtatctgcaggtaattaaggtcttccagctgctatatatacattacgttgtaggttgttagatgcatcttgaagaaaaaacaagattcaaacaaatatgtgaaacaggctcgtcctttgtttgttcaaaagtttgatgagcctctgcattcaatgacaaattgataatagcaagaagaatatatgttttgtatgctaacagacctagagggatgtctgttaccatcctgttgctctttcttcgcaaaatccatattattataaagggaaagttttaagtgttttaatgagtatcattatagacaaagcacattgaaaagaacatcagctagaagtaattggtaagacaagaatcttactttttccttttttggcatgcacttatgtttcattaattgtagggacaagctagtccctctgtttcatccatatttcttgaatttacttatatatattatagagaaaatcccctgtgtatccctgaaagttcacctaatcccttctgtacctttgaattttgctcaatcccttaaatatccctgaattttagtttggatcctttccatgccctttccgctagttgactgttaaattcttatgaaaaagtccattttaccctttggtataaagaagcatataaattaatagagtatattgttgaagcatagaaatttgttatatgagactattatgtttatgagatagttatgcaccatattatttgcgataaatatacttttagatgtgatataaaaaattaatacttatttattagttattaatagatttttttagcatatgtgttctgatagtaataaataaatctgttgtattactatgaaaacacatatgctacataaaagaacttttaataactaataaataagtattaactttttatatcatatgtaaaagtaaatttgtcacaaataatatggtgcatcacatactcataaatataatagtctcatccaataaatttttacattctaacaatatacttcattaatttattatgtttcttcatagcaaagggcaaaatggactttttcaaaagaatttaacggtcaactaacagtcaactagcggaaagggcatggaagggatccaaactaaaattcaagggtatgtaagagattgagcaaaattcagggatatagaagggattaggtgaactttcatgggtacataggggattttctctatattatataatgcaatcagtcttacttttttttatcctgttgttttattaaaacgagatacaattagatatcggtattttttttaataaaacaagtataacttccaaactcgtgtaccaactagagctttaaaaatcatattaatccatatcaacatttgaattttagtgggttgagttatgcatccacaacttctgtaggaatgactgtaaattgtagatgattttgatcacttattctctagtccggtggccttagtctgatgtggttcttgtagatagacttaaatcatagaactaaatcaaaatgttagggatgaaacacttttttggtgtagtgcagttgtaggtgtatgattctgcccactacagttttactctccgtgctcatatttacacacacaagatcttgcgcttaataagtatgtaggaatcttgtttatttcactgttttatgtttgatttttatctttcagtttgttttagaggggtgcatttatgtgcatgtacagtggtgtagatgtgcgtcttcagtgtaataaagaaaataatcttacatcatatacccattgtaaggaaagggccttactcttgtaaactgccagatgtccatttttcatcaacaacatactgaaaaactatctaatttcacctcacaattatcaaaatatgtaatcagttgtaaataagattatattgtaccagacatcaaaataagaagtggaaggatgagaaaaagatattactgagctttgtcaaattgtaactaaagatggtcttcttccccaaaagtgaaattttctcttatcagttaaatgaatttgattcactaaaaaaattactgaatttaaatgtaccagtttgataccaacattttttttaactctgcttccaagattcctctgttggcagtttacgccatggtttcatatctcctcttcctaaccggccaaataaatcagattgcatctctagtcaatgccttccagctgctatgcatactgtgaaagttttctgaatccatctgaagccaaacatgtttgtaatgttatgcagttgtttcagctgctagcctgctaccatcctaatttgtctatttgaacggcagaattattcaacaaatgtgtcaagcaggcatatcgatcccgatgttccacttttctgaacattagctaaagcagaaaggacagtctgtgttttcgtttatttccacttcattgaataccttataatggataacctggctgctgcgtcaaagacgcacaaagcatagcatgacacatatcattacaataattccacaccaagaagaataatatgcatgaccccactaacttgtttctgatgatagtttaggtgtttcatttttggcaaattctaatagcccaccaagaagaataacttgcatgagcccaccaagttgtttctatcttcataaccagatgcatgagaatcttacttttatttctttctttttggaaatgtttttatctttcattcattaattaagctttgaacataccagctggtgggtctaccaatattttgcagtagaaattagtagtcaaagttacatctcaaatcaataccggtggatgttcaaaacaacatctttaaccacaagagtacctatctgactgaaaaaaaatactacatctgtcccattataagtgcagttgtgggtttacgtgtccaattttgattgtctgtcttatttaaaaatttatgaaaaataaaaaaaatattagtcatatataaaatactattcatgttttatcatctaataacaataaaaatactatcataaaaaaatttcaaataagacagacggtcaaatgttgaatataaacagtgtaaaaccataatttttctaggatggaggtagtaagttatcgtctgcactagagcactaggagggagtttttaagagggattgaaagtttagaggaatgagactattaagtgttttgtttggttgggagacatagaaattttggtgggataaggatggggaattgagaaggaactctctccttttcaatacctgtgtaggggcatccgggcatgtaattgggagggaattcctcctttactttgtctaagcaaatctcagccatccgtttttattgatgacctaatcaccaactaaactccctgtcaatttctatcacctccaccaaacaagatattgaaattaaaaataaaatgtccatcttaatctcatcatcaattccctcgttgaaacttccaattcccttcactcgagttaccaaacaagccgtagaatttcctggcggattgaagtttttttttttggcttccggtcacttgcaggtttggtccatagtgagaagatttgaagagccacacatcttccagcccttcgtgcgcggctgcacgatgcgagggagtactagtctcgccgttggttgtgtgcgagaggttgatttcaagtcgggcttccctgccaagagcagtgtagaaaggcttgagatccttgacgacaaggagcacgtcttcggtgtcaggatcattggaggtgaccataggctcaaggtatgctcgttcatatctcagaggcctgtttgatttgtcactaaacgaattctacaaccaagatttgacgttattgacttttggtaagtttgctaaatatttcgtattaccaaaatttatgtttttactttttttttctttcccccccgatgtaagactctcctttttccttctaatataaccagcaattctcttaccatctactataaattttttttttgttgaagtaacgttcggtttaaagcctcattaaattttggtgtggttttaaattccacctactttctaaggatctgtttggttgagctcgtagaagctacagcttctccaagaatcaaaagttcttccaaatactttagatttttatctagattttaaaaagtagttatagaatcaagaaaataaactagaagccagaagctggttttccgacttctccttattctcactagttgcttatctgaatccaaagctctctatacagggccttaacatctgtgtatattttaggctggaggcagtacatattttgtctggtgtatatcaaaatttggtaggttgaatttatcaacaaaccaagctgtctccatattttttgatgacatagaaaattaatcagtttgatcatggatggccaacctaaagcaaaaaaaaaaggagtagctaggtagtattccctccgttccatatgataagtggtttgacctttttttctagtcaaactttgttaagattgatcaagtttatggaaaaatttagcaatatataaaatattagattaatttcattagatctaacattgaatatatttttttaatagtttgttttgcgttgaaaacactactatattttttgaaaacttattcaaatttgaagaggtttgactaaaaaaaagtaaataacttataatatgaaatggatggagtaatatttgttacagaaatggttcaaactaacaaatagaatccgacagacacatttgcggagtagaatttgtgttctaaaaatgggcgaacatgttcactaatattcatggtaaacatgttcatccctttagtcctacataataagacatactccatccattaaaaaaaattaattctatatgtgtccagatttatctttaaatgaattttttttggacggagggagtactttttttcctcacattgaaaaatattacacatacaaaaaatcttgcaccccacaagctcacccaattaagcgtataatttccactttcaagtttcaatatgactcacaccatagtgaaaaatattacacaatgttgcagtacagtaattcttctcggtttttttttttgtgacaagagtcaaagtaatgtggaaatcctcgaaaaaaaaatagtaacgtggaaatctcctagaaaagcctgatcagtatatgaaaagatagaacgaatgctttcccatcctggtgttgtcgtgcttgtgtaggttaggccaactactgtctactggctggctgaccacaaacataaattaattaattaactgatgatcccatgcttaattaattttttaatagttaaaaaggtttgtatctccaatctctgcttttgagactatttatattctgcagaattactcgtcagtgttgacggccaagcccgaggccatcgacggcgagccggcgacgctggtgtcggagtccttcgtcgtcgacgtccccgaagggaacaccgccgacgagacgcgccacttcgtcgagttcctcatccggtgcaacctcaggtcactcgcgatggtttctcaacgtctcctgcttgcccagggggatctcgccgagcctcctgcacaatgactggattttagacaagacattaattggagggtttttttttttttgcattgttggcttgttgccatttgcatagcagcagcaaaattggggtaatcccagaagtatacatattcttttacgtgatgctaggtgaggaaggttactactgtaataccgtcgtcgagatatatgttagagtgcgtgacccaatccaccaatcatgggtcattaaggtcacattagactggcaacatcacatgttcaaccagaaccataactttactttataggtttacacaactcgaaaaactagacttgtagatatggatcaggctactcctatttaaattaccaaaatgaaactaaacttaacaatctcctctttcacacatcaggtccaacaatctactcatttacatcaactcatatgatcacaaagacttgtctgtgagctatgcttaacaatccctctcgtcatatcagagcccatacgaccctaattaaagacttgttaatatcattccctatcatatcaacccatatgacatcgaaaatttatttacgcgccatgcctaccatcaatctatcatattgtataagagctcatacaaccccagagacttgttctgagctcccccataacctcgtgaccctaggaaattgatccacgtttctaaactccagttctgataccacttgttttattgcaaagctcgttccactaaatgtggtccttccaaatcacattgggtctaatacaccaataaatctaaccacatgcacaactttagatcatatatttacacaacccaaaaggttattatgaggtgtgagaatttataatttccaccttttaagttatgctttctcatcatcaaatacttatataagaataaatctaacaaaatatagttataatcctttatattttaccaaacttgggtatagaacgatatatgaaacatgtttagattgctaccttgacatgccaaaatttagcataaggtgtgtttagtttttttgtgtaaagtttttgaagtatacagacacacatttgatgtattaaacgtagactaataacaaaacaaattacatatttcgcctgtaaactgcgagacgaatttattaagcctaattaatccatcattagcaaatgtttactgtagcatcacattgtcaaattatgacgtaattaggcttaaaagattcgtctcgcaatttacatgcaaactgtgcaattggttttttcccccacatttaataccccatgtatgtgtccaaatatttgatgtgacgtttttgaccaatttttttttaggatctaaacaatgcctaactggaaagatcgtagcggatcaaacagcaacatctatccctgacagtgtccccatgcatgcataatacgacataaatataattaatgcaccatttgactgtgcattgcgtaaataaattactttgtataattattttaagttctatattgtcaaccaatcgctctatatatataccttaatttgcgatagtcaactcgattgcgatgcccgtggtgtggtaccagcgtggtcactacattggattggacaacactttaggtccatgaattattactgtgaaagtgttttgacaaacagtaataagtcattagttttgtcaaatgggatgaaatgaagccatttattgcatagtccaaattaggcccacacttctacgttaaatgggctgaaattaggtcgacccgatcgaatgtaaaatagaaaaagtatactttgactccctcaagtatcgcccgagtattattcatgtcctccgaccataaaaccgggtatatcgactcttctaactatcaaaaccggtgcaaacaatacccctcagtggttttggaggacgtggcgcctacatggcggtcttgactaagtctttgtccaacgtggcgcttacgtggcactagaataaaaccaaaaataaaaaatatgtgggacccatacgtcattcacacgaagaagtacggtggaaccactgacatgtgggacccacatgtcatcctccctctcctctcctctctccgttatctctccccccccggcctttctgttcactgcggcggggacgacagtggggagcggcggtcgggacaacagcggtggggagcgggcggtggtggcggtggggacgaggcggtggggaacggttgcggcgacggtcagttgctgcggcagcggcggtagcggtggggagcggcggcggcgacggtcggctgcggcagcagcggtggcggtggggagcgacggcagcgacggtcggcggcggcagcggtggcggcgacggtcggcggcagcggcggttgcggtggggacgaggcggtggggagcggcggcggcgacagtcagctgcggcagtggcagtggcggtggggagcggctgcggtggcggtggggacgatggtggcggggagcggcggcagctgttgcggtggggagtggcagctttgctcgcgccctcgcccgcacagaacgttaggcagccgctctgctccagccgccgcgccatctcctccggcatcatcatcgccgccgtctcctcatccggcacgcattccacatagccgagatcggtgttgtccctgctcacctctaacatggccgcggtcttcttggggctcgggtactccgcggagcttgggcgccgccgtttcttgccctttttcattgcaatcatggcgcaaagaagcacggccatgaacgatccggcggtagccgcaccgaatgaatccaactagctgatgttgtcacgttgcagtccgtcgccggtggccgcggcactctgcatcgggggagcggtggagctgttcttgccaggtccgtgaaagaagaggaggtgggacccctggcacttgcggtggagaacctcgccccagagctctggattgcgaacgcggcggcgcccatctgcgccatgacgggggtgatcgacacaatactctttcttttaatgacatatgggtcccacattttttaaaaattttattctaatgacacgtaagcgccacgtaggacaaagacttgtcaagaccgccacatcagccaaaaccatctccaaaaccacagagggatattgtttgcaccggttttgatagttggaggagtggatttacccggttttatggttggaggatatgaatcatacttgggtgatagttgagggagtcaaagtatactttttccatgtaaaattaattaagcctcccacgagataaaatgggtcgtaaattgacaaattaattaggcccatttcaaagttccaacgattaataagctggatttaggcctattgatgggctaaattagaccactcaaatcgcgcaagtttcaactttcagttcagaaagggctttgtgttcaacatgcgcggtcgcccactcccacggtcatctacatctaagcatgtggatctccctccactcgttttctgcgtgcataattcccaaactgccgatgtgttctttaaaaaagtttctatacgaaagttacttaaaaaaatcatattattctatttttttaaaaaaatagataatatttaattaatcacgcaccaatagaccgttttattttccgtgtgcaattcgcttatcggtaaccagctccaacaaacacacactaaacaattaaacatgggagtccctattgcgaatttcctgcagtttacaaatccgttggatcgttttttcttaacaaaactcggaataaaaaaatggatgggattagtttacccaatcttttgatgatgatgctctttactataccgtagtaaaaaaatcaacagcgaaagcaacgagtgagagaaaggtgggtggtgcgccgcaagtgcatgcgccgcccaaaccggcctattggattggattttggcccggtcgtgctggaacaccaacacatactttgctttatacttggccggctgatctagtgtccacagcattttgcacctgtcatgcgtacggtatatctttatgtttgtctccatggtggattccactcaaatatatactgtctagctaggacgagattgtgatattttctaatacaacaaacttaaaattaaaagagaggggtatatctagattcattttattagaaaatatcatatccgatccgttgattttttataggacggagaaagtatgtactaccacttgaaaaaacaactttgtacatttttatactccaacactgattaattaccgtgcgacttagtaattcacaactaaatattatatatatatattttgttttcctttggaagcaccaattgtaattaaggtgtggtggagtcgtgttggtgggtacatacatgattttaaccattacgattattttttctatttttgtaagtattatacattcgataattaagattataacgaagcacagacaaatattatagtcgcacgtacgaatacgttttcggtggaatccgttttcggtggaatcctgatgtagtcgggtatctgatgacgctagtctctttaaccatatcttaggagatgcattgatcatgtccgatgcgcgcactcgtagaattaaaaaataaatctcttgttttaagaaaagatgaatttgcaggagaggggttgacattattcaaaaagaaaaagactcaattattctcgaacttgttgaatagttaaattggtcgaacaacaaccttttatccctgcacagcttatccggagtatcgtaccttatcatgtatccagcatgtgtccctacttatctcgcatggatgcggtttctcatgcggagataagggtaccaaaggaaaa

SEQ ID NO: 8805 - DNA, 6332 bp, Oryza sativa
  unsure (1)..(6332): unsure at all n locations
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgtggttcacggatttaggcttgacgcaaaacttctaaacttgggtagctgaaggacaactcatagcagacaattaattccacaagtaatttctgagaccattgttgatcaaatttccactttattacagcagcagcatctagcccatagcatgatttcagcttagaataaatctggtgaagcctatattcaccctcacaatttgccaaatgcctaaagcaactattagtaacaaccccaccccacgtgtagctttaaacattttaccacaatgagaacaccgagcttccgccagcgcatcaccatcatatattggatcaaaatcatttcatatagttgatgttaatttgtgtttttagttatagatgataaacctaattatttgaattaagcatacattaaaacacatgatcgaacaaagcggtcaattaaattatatgcatcaattgcatgaataaatagcagtagaattacatgaaaaaaaaataagtaaagaaaaagaccatgtctttcggatcaaaatacttacattgtcaagtttaattgtttcctcttcaattgcttcctcaaaagatggagacggtgacatcacaatcctaatctccggagatctaacgatttatacaataggtgatttgagccgctttgttgccggagtctgttgcttttctgtcgaggctttacgtttatatcccttaaggtacttgaggagagtatctcttttgaggcacaatgggcaacatctacaacagtaaaaggaatttttgtctgccatgaaataaattgtaagcataaactctgctaataacaaaaattcaaaccagcatatagggaacacttcaccttataaaagaaaaaaagcaattggaacagtaacatctgttttggtaataagtttctgctaaattattgattcatcagcatgctatgttgagaaatggacagggtataagctatatagccaaaacagttacggttaaatttcagcatagcacattgtaatcatataggtacagcagacatgattattagtatattatcttacttcagacgttatcatgataaaaaggtaggcacgagatggaaccaaatcatgtccttcatccatcccccacatgtttgatgagaaaattccatctatagatttttttttcgcaagaatttagccactacatatccagtaagcatcatgtatgtttttttaccaagcattatgtatgtttttttaccatgatcaagtactaaattggcatgagttatttaacaaaggaaattcatatatttagtaataacaatagggggttgattctacagccataagcaaaaatcattgcatcgccaaaataaagattcaagaactcacctgcgtagaaaccaatggggatggagaagccaatctggtaggagccatagcaagcaggggtgatggaggaagtgagatgggcagcggagtgagcgtcacgacaggcaccagagtgggcgccacgaccggtgatggcgtcaccatggctggttgcggaggaggtcggccgagaggaagatgagcacggccatgagaggcatcaatggacggcgtgtcaacaacggcagtagtggctgaggactgccgttgaggaggcggctgctagggttgagccggcagcactctagatcttgtctagcgtgattcgatcccctcctcccctgcatgcgcgataagtgggttgtggcgccactgggccactgtgggcagtcgcattaactcacatatcttctattgggttgcacataagtgagttagtgggtaagtggggtgggctagcccagtgggttagtggcaggccaccccacttttagccttactctgacgcatctctctcatcatcgagtaggtcatattgctagctgcgcagcgaacaatgcgttgatgtccaccctggccaccagctcatttgctcagccactacaaaaccatcaaatccaaacaactcttcaagaagcagagcagcaagaaagtgggtgacggtaaccaacattgtcgatggtgacgatctgcatgcgatattgcgacttgaagtagaagtagacgtactcgatgtagctgagggagaagttatcgagccactcgccagagacgatgccctctaggtactcattgatagcccatgtgcaggttccccagcaccagggctgccaccacgctctgcagcacgttgagtaatgatggtagtcaactccaaccaatgaagccgccacgacactgagatccgtgttgaggccgatgtgggtgctcaagaaaagggcagaggtatcaggggcggtgtagaggcatctacaccgccggagagcggagagcaaatgcgtcgatgggtgcgcaggggagtagatcgaagcgatggcagcgtggtggaggtgacggcggagcaggaagagcaagagcagctgagtggattgggtgacagtgtgtgggggattgattggaggaaataaggtgcgatgtttgcgttggaggaagttgcggcatgcgccatgcgtgactgaggaatgatccggcgtctgcgtgatttcattgttggatcgcatctcacatcagggatttttatatctggaccattggataggatgatctaatggttagggagggcctgcataacattctatgtgcgttttcgtgggtgcatctagcaaaagagtgaactgcttcttttcatattagtatcaatgatacttgctcttagaaatagttggatatatctattccaataaatgtgcatccttcctccatttcaaatttttaagacaatagatgagactactgtcggtctctatattaacaagtggatatacacggatctattaatgctgcatatcccatcatttcaatgtgcatatctgatatctctccaacgtcactagtagtaaggtctaataaataaatatacaggctagctataaaaacagagccttcccctatagacacaaaacgatactagaaattagaaaaggaaagcagccaagtcgatcatcacatcacctgatcgttcttgtgagctcgggtgacaacgttaattaattcgtaagaaactgcggcaccggcagtagcatcaatggcacggggaagcgccgccgcgccggggctgctgctggcgctttgctgcgcggctgccgccatcgccgtcgtccacggcgaggattgggccgtcggcgacaacaagggatggtccttcggcgtcgccggctgggagaacggcaagcgaatccagcccggcgacgagcttggtgagatcgatgctcgatcgagcaacataatttatactttctcccttttgtattttgtattacaagtttgctttcacttttaagagaagtcgaacatttttaagtttgattaagtttatagaaatataatattttttaaatattatcaagatatatttaataaaactaatttagcgttgtagttggacaaacctaaatttgtcttaaaaaacaaaaacgacttaatccaatttgatcatgagtttgatatataaatacatatggatgtggatacgcagtgttcaagtatgacgcgaagattcacaacgtggtggaggtggaccgggccgggtacggcgggtgcacggtgaccgggccgtccaaggtgtacaactccggcgacgaccggatcaagctcgccggcggcgaggccttcttcatctgcagcatccgggaccactgcaccgcgggcatgaaggtcaaggtcgcggtcacggccaacgcgtaggtcgtacctagctagacttgcatgatgatagtctcgtctagattaagcagaatctattccgaccctcattgattatactctaataagtcaaaaccaaagctaaaaccaaaattgaattttcaacttaaatttgatgctgattttaacatacttttatcagtgtcctctagtgagctccaaatttaaaaactttaaaaacgaccgtaatgagcccaaaattttacttgggctgaactacgagagggaggtcgcaatgcggacatgggctgaaaattggactattatacgttggcccaactagcgcaaaattaaggaataagttcacccgaggtccctcgacttaacagcgagattttttgaggtcccttaaccacgaaaccagaaatgtgtacccctcaattatgtaaaaccgtccaaaaaaaagtccctaggcagtatagacgtccggtttcgctgacgtgacgtcctagttagcaaaaaaaataaaaaaataatatggcacccacgagtgagtgagaaggaaatagtaagggcccacttgtcagcatcatcctcttcctttctctttcttcttctcttttcccttttcttgccgcagaggggagagctgcagtagtcgccgcggcagcaaagcggccggagtggcggcggcggagagcggagtcggcggctgcgaagcaggcaggacggggcagcggcgggcgagcgtggctgcgagtgccgacggcggacaagcaggcaggtggagcgttggagagcggagcaggcgggaggcagcgacgggcgagcgcggctactagcggcgacggcgggcgagcaggcacgcggagcagcggagagcggagcctgcggcgggcggtggccgcagccacccgcatgccgtagctcgacccttccctgcccattatcccgctcgccgccgagccctctcccggcgctcccatcggtgcacgcgaccacaccgggacgctggggagcctgcagctgctgatgttgagcggcgtcggactgcgtgggcagctggagaagcacggcatcctcccgtgttggaccagcccatggacgggcagggcatggtggacaaccccatgaatccggttggctagctagctgcatgcagcgtgcaaactaattaatgggtgtttcataacgacgacgacggcgactggaggcagacggggcagctggggacggtgccgccgaaggagcggacgccggaggcgatgcgtcggctagacagacgcgcattctgtggcgggttcgggaggcaggcgaagcggcggcggagcatcgacggcctgcccatctgcctgctcgtcgtcgagccctctcccggcgctcccatcggcgcacgcgtcaccccggccgctctcctccgcatcctctgccggtgtcgcgccgaggaggtgcgcggcgccgtggaggcggcgtggctggcgatagcgagtacgccgttcgcttgctaacccgccgtggctccggatggggagaggcgcgcgccggccgccgctcccgccgtcgcgggcggtcgcgccggccgcctctctccccttctctggcgccggccgcctcctctccccctctcctgcttcttccccgcgcgccgcagcgcccgctgcgttggcaaccgcgcccgctccgctgtcggccgccatcttcccgcctgcgcgtgagagctgagaagttgagaagagaagagaaaaagaaaaaaaaagagatgtggggcccacatcattttctctcactgacatgtgggcccctacatatttattttaattatttttgctgactaggatgccacatcatcaaaaccagccatgtatactgtcttgggacccaaattagatggttttgtaaagttgaggggtgaagatttctggttttgtggttaagggaactcaaaaaatctcgctgttaagttgagggacctccggtgaacttattcccaaaattaaaaatcccgcgttgggccggctctcatgccggatcaacaggacatgacatggcttagcatatcaaggaataagtacactttgactcccttaaaagtgacccatatctaatccatgacactaaaccgcaaaatcagatatattgacctctaagctgttaaaattggtgcaatttaactctctcagtggttttggagaacggattttctgacatggcgtctacgtagcagtgttgacctagtctgctattgacgtggcgctagggtggcattacaattaaaaacatacatgtggggcccattcgtcattcacacaaaaggaaattttggggg

SEQ ID NO: 8806 - DNA, 10649 bp, Oryza sativa
ctgcgctactgccggggaaggaagcggttcgaccaatccatcctcctccgcacgctccgccgccactgccgccgaggaaggaagcccgccacgcgctcggcgatgagagaccggcccctccccgccaaggttcgaccagtccatcctcctcctcctccgcagctccggcgccgccccggcccctgcccgccgccgccggcggctgggtccctactcgttgtgttcctccaaaggggaggagaaagggggtgagaaagagagggatgaggggggagagagagagggaggacgaagaatgaagacggctgacttgtggggcccacatttatatttgtgtgatacaaatgggtcctgctcatttttttaaattataatacacataagtgccacgtcaactccacgtggaataaaaaccaagtcaacacctccacgtatgcatcacgtcagcgaaaccgctctccaaaaccaccgaatgagtcaaattgcactagttttaatagttgaggggttgaaatatctgatattatggatcaggatacgaatcagattcgaccatattaattaactgcattcaacggttaactggtaattttgctcgttaggttcgttttctttttttcggttttgctaggccctatttaatccggcagtgttacgttcgtcaattcctgaatctgctttcgtaaaagctgttggcaataactaattaatcaagccatagccttagcttcaagcaactaatacatactatgcatgtgtcgaaatctagaaacaatggtcatgcagatatttggtaaatccgattggagatttttaaatagacttgaataaatgtattctctattttatattggtattattagctattgtttagttatttcctgttttttacgtgctctatattgagtgaaatatataataagtagatctaacttatttagtcgcaaaggctgagattcttttctttatcttaaaaaatagccttgcttggccggatttggattaattgaagtaaagcccagtcattaggattggtaccagcctttggctttggttaatcagttaaagtaaagtactttcattataggataaggaccttccttggaccgaggctcactgtgaccgtgtcacatgcaaacacaaacctagcttagttaacttcggttagctaaacacaccttttgcaaacacgaccctcgatatctggatttgattatggtcgatctcaatattccttcgttaactgacgtcactgcatacgcaaaattgaagtccaaggggagcttgataagggcatggttggcacagctccagctccacctcttctagagttggagctcagccaaatagttttagctccaccaaaactgggagttgagctgggtggagctctcttacaaaataaactagagttatgaagctgggtttagtcagctccacaactccactccaaacccaactcctggagttaaatttaagagttggagctgtaccaaatagacccttagggtatagccaactacaccctccggattgataatacttatcgtttttaacaacggtacggtcttaaaaaataactttgaccgttattttttattataatatatatataaatgttaacaaatatataattttttgaagtattttttaagattaatatatgcatatagtcaccatatttcattgacaaatattttacaaattataaataaccaaagattttaaagtttgacatcacacttgtccaaaacgataagtattattagcccggagaaagtactataactgatttaatagccaattcatacaatagttacctataaacctatattgcactattaatacaaggtttcatatgtcatacaaacattgtgttttagtccgtgctatagctggctacaaatctgtagcccgcttctcttctctcctcttttatatactcaatatgtgtttatagcggcttacagtctgctattgtacctgctctgcacccatctatatatagactgatcgaccacccggttctttcaaactaagggggtgtttggatgggactaaaattgtttagtccatgtcacatcggatgtttgacgctaattagaagtattaaacataaattaatgacaaaacccattccataagcctggactaattcgcgagacgaatctattgagactaattaatccatgattaggctatgtgatgctacaataattcaataaacacgtgctaattatagattaattaggtttaaaaaattgtctcgtgaattagctctcatttatgtaattatttttgtaagtagtctatgtttaatactctattttatatataaacatctgatgtggtaggaactaactttagtaactgtatccaaacatccccctatgtagatgcgttttgtagagacccaagtatccaaccaaacttttgtactttagataaataaatctctagacgaggcccctgtgtgtagttattacacgttgaaaaaaaaacaaaagaatggagagtttgcatttgccagcgtttccttcacatagacgcagggatatgaaaatggtcaatcggaaaactgccaatcccatttccatttctttcatatattttattttgggaaacataagcataatggttaaggcggaaatgataatgctaccgctattgttgggatttcaaagatgaaggggatgtttagatcgagtggtgtcggatattatatatggtgtcgcatgaaatattcgaacactaataaaaaactaattacagaatccttcagtaaaccgcgaggggcactaataaaaaaactaattacaacgtttcttcagtaaaactatttttgaaatagcaagtcatgtactactacctccgtcccaaaataagtgtagccatagatatccgtgtttagcattttgaccgtccgtcttatttgaaaaatttatgaaaaaattaaaaagaattagccacacataaagtactactcatgttttatcatgtaatagcaataaaaatgctaatcataattttttttcaaataagacaaatggtcaaacgttagtgtggagattatggataccccatatctacatgacagttataatttagtcggatatacggtaccaaatatagatagaatatctctataaggactcgggttagattctaaacttgtatgtcaaagaaatacccgggatcttagtcggttacgattgtattttatctataatcctatattccgttaggatatggactgtattttgtaaagcggacctcttcccctatataaggaggggtctgtgtgcctctcggggtatgatcttttttccagtttatagaatcaataacacactcggcggaatcatccccggacaggagggtattacttcttgaataagaaggcctaaacctgtataaaattccttgtctccaaacccatccactttcctagcttgatcgcctcccccttttattattgccgaaatcttgtttcgacagttggacatgaacagtgctaaaactgcacttattttgggacgaagggagtaatagagaatacgatgaatgtaggcgaagtgctgttagtgttaggatatgtcatgacctgattcctagtactgggcagtattataatacctccgttttttaatagatgacgccgttgactttttctcatatgtttgaccattcgtcttattcaaaaaatttacgtaattataatttattttgttatgagttgttttatgactcatagtactttaagtgttatttatatcttatacatttgcataaaatttttgaataagatgaatggtcaaacatgtgagaaaaagtcaacggcgtcatctattaaaaaacggagtatttccttagtcaatttctgcgactttgctcttcacttcgtaatattcctcaacataataatatattactccctctagttttaaaattttaatatttaataccgttaattcttttatatatgtttgatggtttgttttattagcaaaaatacataattattattcatttgttttgtcattaaatagttttttcatatttgtaaaaataataataagataaattaatgatcaaatatatattgaaaagtcaataataccatataaaaaacctaaaaaaactcgaaagaatatacgaataattttacggacttatttaaacactactagaaaaaatgttttttttagcaacgttggccttttatttttccaggcgggtatgaccctcggagctaaatagccgcctagaaaaatgtaaatcggggtggagctcaccatccgcctgcgaaaatcattttttccaggcggaccacttaagaggtccgcctgcgaaaataaatcggaaccttatgtggtccgtctacaaaaatcacaccgccaaaaaaaaagggtcatccttatcctctcctccaccattcttatcctctcctctccaccactcatcccccctcctctctctctccttctccctcacacacttagcaaaaaaaatcctccaccggctcacctcatccctgcctccgctgccggctgccctcctccctgcctccgccgccggctccctcctcgacgacgacgacgaccgcgacgccgcctccgctcgccgtcggctcccctcggtcgtgagatgatgaccttcgcaacgccgtgaagcagcggatccaccagctcccctcccccccgcctccgtcgtcagctgccctcctccccgtctccgccgccggctccctcctcgatgagacgccgcctcagtgagccgtcggctcccctcggccgcaacgatgatgaccttcgcggcgctgtgaagcggcggatctaccggctcccctcctccccgcctccaccgccggctgccctcctcgatgacgacgacgaccgcgacgccacctccgcgagccgtcggctcgcctcggccgcgacgacgacgacgacgttcgcggcaccatgaagcggcggatccaccggctcccctcctccctgcctccgccgccggttcccctcctcgccgtcggctccatctccgccaccggctccctcctcgcccccagcttcctccctctcgacgacgacggtgccaacgacgctaagacgaccacgacgtgacaacggcgccaccagcttcatcctcaacgacgacgaccacgacgcgacgacgatgacgatgcgacgacggcagcaacccctgtggggacggcagcagatggaggaggagagccgtcgtcagctagagggagagaccgacggcggtggtggggcgtcttttttttattcgctgaaatttgctttgcaggcgagtgaatctgccacctgcgaagatgccgtccgcctgcaaaaattgattttcgcaggcggacctcagatccgcctgcgaaaattatctattttcacagtcgtttgcttataggcggaacaccggtccgcctgaaaagacggatttggcccgcctgcaaaaaccttttttctagaagtgaaatacacacacgggggctagttatcgaatattatctctcaacatatttttctatcatctattaacttattaaaggaacagaaaaatgagccttcacattcgctctcacggcctagaaattaccatattaatcggagaaaaagaaaaacatagtccatatagaaatacaatttaaaaatagttaaaattcggaattaaaaaataaggaatagtggaagaggagactagagtccatatagaaataaaattaagaaataacagaaattcggaattaaaaataaggaatattagaagtagagtatagagtccatgtagaaatacaattaagaaataatagaaaatcagaattaaaaataaggaatatgagaagtagagtatagagtccatataggaatttaaaactaattaaaattcagaataaacataataaaattaaaagtagagtttagagttagtataaaatacaatttacaaataactaaaattcgaaattgaaaaaaatgggaagaagagtataaagtcaatataggaatacaatttagaagtaactgaaattcaagattaaaaattgaatattgtaagatgaatttagagtctacatagaaatacaattagaaataataaaaattcattattaaaaataaataatattagaagaagagcctagagtctatatagaaatacattttttagaaaacaaaaattcagaataaaaaaaagaaatattgaaattcagataggaatataatttataaataactaaaatttgatattgaaaataattaataactaacacgtatataaaatacaatatgaatattacacatgagtagtttcgtaaagttagtacaaaattttaaattatgttgccattttaatatatttgaataatacatttagaaaacatatatgctattatataagagaaaatataatgattctagccgcgcaatacgcgcggaccttttcctgaattattcggatgcatatggtacaacatattctacgtgagttacaagttgccaaaatgtcaaagtgcaacgtactatcctctaacccgtctgagtgtttaacttggaactcgtttgttaaaccaatcagatagtgccacgtcaaccatacagcccatcagtgggccccccacccgcggcctacaaagcaaatgcccccgccccccgcctcctctcgtcggtcaacgccgcgctcgatctctcgccgccatggcccgcctcgccgtcgccgccgcactcctcctcgtcgccctctgccgcgtcgtccacggcgaggccgatcaggagaccgcccccgcctacgccaaccgtgaagcctacgtcgagcacaatggtggtgacgccgccggcacgtccgtcgccatcgtcccgccctacctcgacgccgccgccgccgcccgtgacgagcccgcggcggcggcggcgagccccgaggggcctgtgatcccggtcgacgacgacgcggcggaccagcagggcttcctccgcttcccctgccgctaccactgccgctaccgccaccacatgcgccacggcggccatcgccatggggagggattccatggcaaggaggagaagcagcagctggtgttcgagatgccagtcgagccggcgacccgcggcgaggagcgcagggaggaggaggagggggtggttctccccgtcgcggagccagatccggactcgcgccgccagtatgccgccgtagccgccgccgaggaggaagacgaggatgagatggcgaggctccaccacggccgccgctcccaccaccaccatcatcgccaccaccatcatcaccacgacgagaacgaggaggacgagcacgagcaggccgacgaggcttcgcccgccgtggagcggttgatcagcttccaccgccgccgccaccaccaccaccaccacgaagacgaccacgagcagcgcgaggagggtgcgcccatgaagcggttccgccaccaccacgaggaggaggaggagtccgagatgaggaccaagcgcttccaccaccaccaccacaaggacgacgacgagcgcgagctggaggagatggcgaggcggtggatcaggaaggcgctgatgagcagcaggatgcaccaccaccgcggctgccgcttccaccaccaccaccaccacctcagcttccgccaccgcgcggaggacgccgccgccgccggcgaggaggaggagaaaggcggggtgatgagttggctcaaggactttgtgaaccgcttctaggtctctcgatcgatcagcctagcttgccgctgcttcttcttctccatcgtctgcttgtgttgttgtgtcgagttcattcatgattcatatggctgctgtgtattctacttttctacggccgtatatgtatttcgtataccgtatttgtgttgtggtactctcgacttatcccgagtgttcatgttgttgtttgtgtcacggatgttaataaattgttctcctatttcaaatgcgtgcattaattaatcatgtttctatgtaacaaattaaatgttgctcgatcgctatataaaccatttcagttgtctgaaaaccgctacgatcaaaatcgcagagaggcaacaacaagattgcgtgcatgaatactcagctgaaaacagacgactgacaagctagcttgattctggcagtcaccaacaagatttcctgaaatcaggggcgttcttaacctgcttaattaaatttcatggacataactacacagcgaccggtctctggtttgcataaagcagcgatcactccgtcctatatttaaatctctttttagcttaaaaagtactatagtgcacgttttttacctctttaatcacttgtatcttttaaatcacatattatttttaagatctatttgcatcattatactccacttaaaatatatgacaaaacgagatccctgttgaataaattaaaacattttattaatttaaaagtaatttatttaaattatagaagtaacttagctatgtaatagaagtaactctatatagcattagaagtaattacgttatgagtgagttccagtaagaaacttatgtggagtaaattcaaaagtgtagagaagattttcatgtaaatacatttatgaaagtaaatttaataaagcctgaaagtaatttacataaatcataaaagtaacttagcataaaatgaaagtaagttattacagtaagttattacgatattagaagtaaatttatcgtaggaataaaaatataagtctatttagaaattaaatttaatcagcacaaattatggaattgagtaaaaaaaataaaagtaatcaactcaaagcattatgaaattacgagaagtaatttaatcaaatctaaaagtaatttatatataagataaaagtaatttgcatatataataaaaagtaatttacaacataaatgttttttcatcataatattatcatgtaagatcttgatataaagatttaattgcaacgaatacaatggtgtaatcggattatagatcgaataagtaatttaagagaaaattttataagaagaaaaaaaaatgcacaacctaatagcataaactacttgcatgcatgtctgtaacgctactagtgcttctcacgtaattatccgtgtcgctcgttaattctaaatcgagatgcctctcgaaatagattttgtgatatttcatcttgactttgaagcgggcatatatgaactccccgcatactcttgacgatattccctatgttcaatcaccaaagcctccttttgattgaagaaaattacagacattttgggcttattcaatttgttgtcaaaatcaaccaaaccaaattttggtattgctgaattttagtaaagtaacaagctaaacaagatttttaccatcgcaactttcccaatttctaccaatattgggtaattctctacaaacttctattcacaaaactatataccaaaatttgataaggtgttaaattaaacaccaaaatttggtaattctctacaaacttctattcacaaaactatataccaaaatttgataaggtgttaaattaaacaccaaattttggctttaccaataaatgataagttgtcttttaacattgaactaaacaagcccttcattataattgaattcattcataaagtgctgattaaattagttgctgaatagcaaacccctctctcgtattctttctcttcggcagtagtgttagcctccatctttaggaggtccctttcgggtttgctctttgataacatcttcgttagcttataatgcttttttttcggttttaccatccttcatgggcttatgcgtaaattaactgtcatctcagcaaacattatcacacacacacaaaatttgaggtattatatagtctcactttatgcttttaaaaagaatgagttcatgtaaaattactgttaacttccgcgtttaaatggagcaccgacagcagaaggcgcgagcagtgattgtatcatccgtgatttcactggtggagaaaccatctttggtcggtccaccagttttcacaatagtcccggttatattaaaaaccaggactaaaaatatctttaatcccgatttaaaagctctaccaaccgggactaaagatctatttatagtcccgattggtaacaccaaccaggaaaaaagatcgatataagctttactcccagttgatgttaccaaccgggactaaagattgatctttagtcccggttggtcacgcctaccgggaataaagtcgacataagcgggatagttgcacgcggatcggatcaatacaatctcctcctctccttttttaactcatctcctcacagagtcacccttatctcttcctctccctcctcctttcctctcctcctctccctcctcctttcctctcctcctcctttcctttcctcctctccctcctcctttcctctcctcctctccctcctccccacctccctctgcaacggcggggcgcggagggccggcccgcgcgacggcgcggcgagcggagggccatccggccggcgcggcggtgcggcgcgcggagggccgggcgaggcggcgcgctggcggctggcggccggcgcggcggcgcggcgcacggagggccgagcgaggccgcgtgcgggcggctggcggcgacgggcggctcgg

SEQ ID NO: 8807 - DNA, 8073 bp, Oryza sativa
ttctttccttttttttgagaatctgtgattcggatctgaaatgatttgtgtgtgatgtatttgatttgtgtgtgatgtgaatatgtgatgtatttgtcatgaattttgtagaagttgtgatgtaatttttttaagattttgtgatgtatttagagatattgatttgagaatttagagactattcggggatgattgatttgggattttgggatgggatagagtgaatcaatatattaaaaacaataaagaaaaaaatagaataaagtagcaaccggatctagcctctttagtcccggttggtgttagtatctttagtcccggttggtaacaccaaccgggaaaaaaaatggatttttactcccggttttttcacccggaactaaagatagcgatctttagtctcggattcatagtcccggttggaaaaccgggactatagggggttacgaaccgggagtaaaaactccttctctaccagtgggttacagtgatcatccattaaccatggattaacatacctcaatagattcgtctcgcaaaatagcctaggggttatggaatggattttgtcagtaatgtacgtttaatacttctaaatagtaagattccgtagagatatttaatagcacagaggattcaaacaaggccaaagtgaagaatgtgtttggttaatactattctgttgtgtacagttaggttgttcttcatggagtactccatatgtatatgtttgtcgtacaacaaatcctcataattttttttatcagtgagccatctctgcacaagagcgtgcacacagctagatgtacgatgatttgagtcaacgatccacccacatattgtttatccttccggctaacagcatttgattgcaactataccactaacttcccctcaaaaaaaaaaaaatcccctaaaaaaaactagtataccactaacaatttggtacatcagacacacacatcgatcagcgaacctgacggagaacacaagagtagaaaaatgcgtgccatgcttgattaaccaatggtaaggtcactcttttccccccgacattttttatcttttaaaaattcgatgaatcttttaagcctcggaagagcatttgatttgattcctgatatatatacgtcattgcgtgcgcaatttgggtttgacaagggaaccaccggccattccagactgaccaaaccaagatcgtacgtgttgtaaagtttcaaacaaaaaggatcatcacgtcgtaatgttattattatggagtagttgagagcttaatcaagctaatgtttagtctaagatactcctagtaataataactagacgataacccgtgctttgctgcgggatacatattagaatattagagaaatgatgaaatgatttggattgaaatattatgaaaataatttgagaatgatgatttagcatgtgtatgtttaattttagaataaaataaaataaagtgtagatataattactgtaggcttgcatgttaagctttgtgtgcttaataggttgatgtggcatacttgtttgtaggttttaggagtgctaataaatactatgcttgcatgttaagatttaggtgtttagtgggcattagctttatagaaataagagagaaaagaaaccgtaattaaacggatcggatcagatcgaggtggccagacggacccggcccaataacagcccgtttgacctctcctcccatctgggcatttttggggcccactagtgagcagttcgtcccgttccgacgagcgggacccacccacccatccccgccgccgtccccacccaccgccgccgtcgatggagggttccccggaggcggcggatcggctggatccgggcgccgtttcgggctcgatccggccggtgacgagcttgccgaggaggatgaagacgagagattagggggatcgagatggatgccgagatccgatctaggctggcgctgcgcctgcgagatctgatcgcgagctaaccctatgggtacgaacgctgaatcatactatctgctagagtactaaaatttctggatattatatatatgatgcataagtagcaaggactaatagcaggtttaacaagtatctggggattagcttttgttaatcatcgtcagtggaaaagggggtttaatttagagcagtaagattagggattacattatcccgggagtattacttttgaagcgcagcccttttttctttgttttatcctgtccagagtgtttttgtttccatttacatcttgattttagatgttgttagtgtctttgattgaactatcattattaggatcatgaactggaagatttgctgccacagttttcagaacacatttcctaaagtatagtacagttatcagagtagaaattgtccaaatgagaatgttagtagcacatattatgtcagtatcacaatcatatagaagtacctgacaaacgaaacaggaattttcgatcagtgcttgtaccatatcctatccatttccaatttttgatacgcacactgacttatctttgtaggttagctgttggattatatcctttgttctgattgagtagacccaatctaatcgcctcttggtctcaaaaaaaaaaaatctaatcgcctcttgcagagagcctccttcctcatccattgagccgcctctgatgaccctagaattgtttgtggaacagccaacagataaattaggagtaaaaatgtgcacattcaactctcatttgatcacaagtctgacggagtattaatctcacacaagctgggatttattattcagattagaacatatttgcactcagactgacaacttagaagccaaacctttctctaacaaaaagacacctaaaactccttaactgattagcacaagcctaacatattgatcaatcccaaccacaattagggagcagtcaaacctaaaaaaaaagcaagcacaacctttctaatcaaaaaacattatacaactggatcacactaatagctgcagaaccctgaagaaaggctggtcgtgagctctgcacacggccccggctgcacacccagcgccgcgccatggacgtccctgcacttccaagctgcattattcctccacccaaacagcttcacgttggcgaggcatatcctcgtgaacggcgagttcctgatcccctcgatcgacccgggctgctgcacattgacaccccacacgttcttgatgctgacagcatccacggtgggcagcgcgagctggctgaagtgctcatctgggtggtcaccgacatcgccggcgatgcgcagcccgttgcggacgctgttcatgcggacgttgtcaacggtgatgttcctgatgatgccgcccctcccaatgttggtcttgatgtggatgccgtagccgctgttgaagatgctgcagtcctccaccagcacgttgctgacgcctcccgatgcctcgctgccgatggcgatgccgctgaagggggacgagcccctgacgcgcctgatggtgatgcccgagctcggccgcccgtaggcgatgccgtactcgtcccagccgctcttgatggccacgagatcgtcgccggttgagatgtaggagtcctcgatgcatacgttggtgctagaatctgtgggaggattcagtattattagcatgttccatgtactcttggatggtcaggcatgtagcaaagaaaaattaatcaatttatatgtggtttgtttgtgtgccagaagcttaagatgaatttgcatacctggatcaactccatcggtgttgggcgagtcatgtggtgcgatgatcatcatgttggttatgaccacattgctgggtgtagaaaatgaattggatcagtatttcagcataaatgggcatttgaaactgaacattctcaagaattttgtagctgtgtcacaagatttcttatttctggtaactattccataatggattgtattgaaattttcacatatcaactatttttcggccttccaacattgctctgaaagaaatattaagcagtgacaaatttttgcaggaaggagatgaacatttcaactttcaagcgtgtgcttactcgcaataaacaggatggatgttccagaagggtgaattcttgagaacaatgttggagatgtgaatgccactggaatgcatgaattccagaaggttgggcctggtatgctgaagtgtcctttgcctccacatgttccaccatacatcaccttgtccatcgatgattcccttgtcacctttttttttaatataaaaaaaatctgacatgttaattacttgcatcaattttaatgagttcttttgcaggaacagtcagagaaaattgctacagacgaaataagagcacagttagttcagttgcctggtgagagtaagcctgactgcttgttgtctgcttgagcatataatgctggcttaaaccagtcaccaacttaatagtagaagtgatgtaaactgtaccagagtggtacagaatcaaatcagttcactgttccatttcctgttcttggcatgcatgtacatccactagatatggaacaggagcaagattcaactttaccgacaacaggtcgtccaccgtgctacccaccaaggtatgtttgtattctaaatctctcagtaatggcctaaaccttaaaataacaaacctctgacaaaccaccatggaagagtacatattttaaccatgatggacaaatcccttactactatttatctaaagttgcgttaactaggtctattatcttttcggttccttttatttattaccctattatgtctgatgcgtgtaagcaacaaagtagtcttcctttagtcactcactcccatgctatcatataatctttttttcctcggtgtgtgcagaattcttttttgcaggatgtatgcatgtctctttgaatattctctgaccaggagaccaaagttagttggttgagacttaagaattgacaatcaagaccatcacaagaacacagtataccaaaacaacaggggagaaagtgagcagcagagaagctaccaccatgcaacaactagaaataccggagctgagctaagctgagcttcaattcttcacctgtaatcacgatgtcgcggaggccgtcgccgtggatgaagctggtgtacctcgcccccggcagctccctcccccttccgtacgacggcagcggctccgccagcggccagctcctcgtctcctgcgtcgatgtcaacgacaccactcaccaccaagaagaagagaggaaaagaaaaacatggccatggcggtggcgaggtgagagtgagacctgtgtggccttgaggacggcgcccctggcgaggaagagggtcatgtggctggtgaggttgaagctgccggtgagccacgttccggccggcacgagcagcgtggtgccgccgcggcggcgctggtgctggatgcggtacactgccttgtggaacgcccacgtgttcaccgtccggccgtcgcccacgccgccgaactcggcgatggacaccgtctccggccgtggcctcgccggcaccgcaccggcgcacgtcgtcgcctccgccgcgtcacattgcaccaacaacaccaccagtagcacggtgaccgcgaagccatgcccatgcaacgcggccatcaaagaaaaaatgagaggaaattgtttgcggctaaactaaagagagagaggccaagcagagagctccaagaagagcttttttctaccggtgtttgtgtgatccctataggagaaaggtggccaaatcctgagcttaacaatgctgagagtgagggttgaagagaggaaggcaaagcaaagctatagcttgctcccaagtgcaagaatccaagggtggtgtgaggagagccaagcagatgagtccagaggatgggatggggtggctcagctttggagcaaacctgtgactcgctagctcacttactctcttgtgagtgtgagtgtgagtgaagagaagaaagaaaatggagaatgtcttgtgaaagagagccagttttggtctccagtgaaagcagtgaagcttttattcagatcttgcatgctcatatataatggctgctccatttcgcaattttcaactcaggtgtgtcagaatggtaaaaataaaaatcaaaatttctcccatgctgttagtaaggtaatctccttccttttatttgaaagctaggcaggtgttctaccgagatgaaatgcaaagggaatttcttgcttaattaacatgacagtcatgcggttgatctaccaccagatttggcgtagaggcaggggcccttcatttgctgcttttttatcatcttcttttttcttgcgtttcattgcatctaatgctttctcatcgtggtacataattaaagccattgggatcgtgagcaaaggtagaagaaacatgctttatcagcatggcatggaccaaattaaaagatctctacatgcactccagctggtattatgttttgaacgtatatacatgggcaaaatatggacttctgccatgtagattgtagaatttaaattcagtcaggtgtaagatgactgagttgttatacattgtacatacgtactaatactccctccgttttttaatagatgacgccgttgattttttctcacatgtttgaccattggtcttattcaaaaaatttatgtaattataatttattttgttatgagttgttttatcactcatagtactttaagtgtgatttatatcttatacattttcataaaatttttgaataagacgaatggtcaaacatgtgagaaaaagttaacggcgtcatctattaaaaaacggagggagtactatttaagttcactagctgatttctccacgccgttttcctagagcaacaatttttgaaagcaaatttaaatataattattttttatgtaactatattgagaaaatctatatcgttattataatttagactcaccctgatcggatagtgtaaatctttctctctttttctaagagtaaatttcacataactacatatatttgagctaaattatcacgaaactacatatttaaggtaatgtatcacaaactacagattaacataaacttatcacaaaactaccggtttaaggctaagtatcgcaaaactatggatttagtaatatatttatcacaaaactatagattttgaagtttaaattcttagcactaatgttatatttgagttataaatgttcaagttttatgattaaattggcaatcggtagttttgtgataactttgttactataaatttgtagttttatgatattccaccttaaatttgtagttttgtgataaatttaatgttaaatctatagttacgtgatacattatatgaaatttactctttcttgatcaacatggtaatgaagctttgttggctaaaatggcaaaccttctctttataatataatgtactaatcaatagacattttttaaaatgatcaatgtgacataacacgattgcctttattgaaaaataaaaaagttgcattcactttttttttggcttacataggagagacacgtgcggatgcaccactacacgcactagtaatctttcatgcactcttcaaatttctattgaaaagcaatacccgtgtgtatataattatttacctccacaagtgcgatgtttccctatgctcatttaatttactccgaaatgaataggagaagcacaagagtacaacggtttgactatccattaaggcttattttccttaaatagaagaagatgtctacaaatattaggcatgtgcgtattggctttcaatttattaaaagacatactctcagatgtttatatgtagtggtgtgtgagcatatgcatgacaagaaaaaaaaagatttactctaaacaactcataacatatatgaatatggtgaattgcatattggacaacttttttttactaatgttttaacttggactagtgtttaacaacacttttcactttcaaccagctaagttaacaaaagtgtttctatttcaacctgtatccatatcttttaggtctcttcctgctctcctctcagaccaaacaaagtctgagcaaa

SEQ ID NO: 8808 - DNA, 15667 bp, Oryza sativa
aaaacgagaaaggggaggtttccatggggtccagatcccttagagttagctataacttcaccaggtggatttgaccaaatccatgacatcaattgtttcctatggctaagatgaagccacgtattaacttatattaattaactccctcaatcacatatgcttgaatgaaaattacttaccttttcttctttttatgttcctaatgagtatgtttctgccaacaacattaacaaagtttgcacgctctcttcttctccaaacaagaagctatggtcatgtatagaactatgttaaacatttagtacgtgcaaacatgcataaacaatatacacacaaacatattgctaaaacattagagccacaagcccaatatgatttttatattgtggatgaaccatgaaatttctaggttatgcaagtaaaattagtttgtatattctttagatatatagatatatagtattcattgatttgttacaaatattaggatgaagaaaaaaaaactagtgggaattagttagttcatcccaaccgttgttatacagagacgactgagatttgatcaaatatctatcgggtggagttggagtgaactccagggaatccccacccatcctccctaagctcactcgagctccagctcttttgctgctcaaaactggagcgctatctcctctaacacaaagtgtaattcacttttctttttttaacccttaacatgaaagagcaaagatattttaccttgtaaaatagaaaaagactttttgctttgttctttcttggaattgggggttcacggatcggaggaattgaggtgggggcgactgtgcagcaggtggaatcttctgtgtgagcgagcggtttatcgtgttaatggacgagacgtcaaagaagatcaagcagggaccagcagagccaatatcatcctgcgttcttgtgatgttgcattatattgcatggtgtgctttgcactttgcacagtcaccatcgcatcaactggtgagcgtcgacagtgccttttttctaggctgggtgcctgggttttaatttgctgcatttttatttggaagaaagaaatgtattactcaatcaaagcgtcctcgcatacaagttgcgagataaaattacagctttctcccaaccaaaaaaccagaaaaggaatcaactctagccttatttgctaaaaaatggctaacacaattttgactacggaaaacttattaactgcttaaatattgtattaaattgtgcttagctaatgtatgcagtataaaactaagtgcttatatggaaatcctgtaacatcttggttagttttcactctctttggggcactgcttttgtttttttaaagaaaattatcaaaaaaaaaaactactacatgcatcccaaaataatcctatctaggataagatttgacctatcctatgataacaaatttagaccaagggaaaactctgaaatggtaaaaaaaaagaagctaaataggagaaatcgtaaatacgaaattgagcaaatgaaaggaaaactcgagagaattatttagttatttctctaaggtttgtttattctagaaaaaggaaagtaaaaatacttgacaagagtgaaaaagagattataacgatctcctcttagtcctacggcctccaccatcctcatgctggtgtagtcgttacccagtgtcacccctcgccccaaaatctaaactctaggttttttttctagcggactttcatgtcattattgttggtgagttcctccccttcttccctcaatctagtgctaggttttaatgtgactgagattcttagtaattttatcatctaagatatatctagcaattcctatacacctgacaatgtcgtagcatgaatataatccattagggtaggcttaagttatgcatggctgaaattcactaatatccacatatgcaggaccttttgcttgtacacatcctggctgacaagccggccgactgaaaacggccgtgtgttgtgtttttagcggtgggtcgcttggcgtttgttgacggccatgtgacactgttaggcccaatggccgatgcaccgatatggccagctttgtgtgtgcgatgctgtgcacagtgctcttgctggggtccaaaaggtaggagacaaacggaacttcgtccatttgcaggggcattgtggtccttatatatgactcccaagttcaacgcacgcatgattttccgttcaaaagtgcatatatactctcctcgttatttgttactacaagtcagcctagctacctacatgtggatttcacgcccagcccttagaacatatcaattcaatagatattagtagccaccgcgaaatttggaaggagcgaaacacaacaaaacattgctttgacgccaagctcaatgctgggtaagaatgtaaggtcatttcacagtggcattgtttgtccacatagacagattgcatgtgtggagaagaaaagggatggggaccatgtttttgtggagtcctcgcatcctctgttggtacctgatgaggacatcctccactattacccactggcaaagacgctaaagtcgggcggcgaccgtgtgagcctctgaataatcccaccttgcttagcgagccattcttcccctattggactagtcttttagggagattgggcttgtgccaaagaactgttggggtccgagcaaccttaagttattgggcctcggccaaccccacctggaccggattgttatcagtaccgatggcctcgtcaaaaaaaaaacagtttcatcgaggaaagctatcgatggcctcgtggctaaaagcgtgtgaggtgtgtgtgagagaggggagaggatgggtgggtggggacgacctggagctgatcagcccaatctgctcatcgcccaacagcaccacacccttgcccctggccgttctcctgcagcgccagattgacaggcagcatccgacaacttcggatcgagaagagagatggaggtgacgctcgctagatccaccccatccgatggtgaggacatgagtcattgcctgagagagaggggagaggcagcagtgacgcagtctgacagagaggggagctcatcccaccgcttgatctgcgccacggagctcccgccatccctctctcccacaccgagtccacgccgtcgagctcatcggtgcactaagggtggagggtcattgatctgggttggaggagaagagggtcgtggccggcggtgacggagaggagcgggtgtcaccgctgttcgtcgtgccgtgcattgtgggaactgagagggagggaggggataagggagagagaaggtggtgagtggattttatattcttttctggattttagggtgtgcaatacgtaatttggtacttctatgtaaattagaaaaagcataagaactgaaacatgaagtattaggggtgaaatataaaattaaaatcactcctatagccaattgcactgtgaagaacccagattttgaacccatggagtctatgtggcactccgaggtcttatatatgggtgaaacgcactacgagtgccctatgatggaggaggagacactagtgtggtcatgaggaggggacaacatcacccctcccccccaccaccaccacgagtttgaccttaaagcacgaacctttacctgccccttgattccatcttgtatatagcttttgtatcacttaaactctattctgacatacaatataatcttcttttattgacaagataacatgcatatataatatgatccattcaattagaccataattaagctccacaaaagctctaaacacctatatatagttcatcatatcctgatttaggagaaacactagtggtgtgatggactgatggtagagttgtgggtgtatgaatttacacatcagttcaaattctagtttccacaagtactacgcacatataaatgggctttcaacataaatttgttaagatcaggaacgggtatcagagacgcattcaaggatgtgtgagtgtagtgttgcatctatagtgttgtgtgcgtgcgtgtgcgtctaccgtgtaatctaaaaaagaaaaaaaatcatctctctttcggcattgtctatgaaaaatataactatgcaaacatgctagtataagcctctttcgtcagtgctgataattggcccaatgtgaaagacagatgattcgtaggcagaataagtttatttttcctccctcatgtcttgctctagtcgaatcgcatccctcaagcataaaactaggtataatgtctctctcaatttcaaaaaccagtacaaatcaacttctttctatggtttgtgaaacgatttatgcttacgtgataggttgacttggtcccctgttctgacaaggtaacccattcattaaagaggttaaaaatagaagtgggatccatatctaagtgataagggtaaaatttttttaaaaaatacagtgggacctacttttcagcctactcctctctcgagccccaaacagcggcacctccatgtgttgctctggcgtcgcctctactggaggggtccgtcactgcgccagaggacgcggtcgacgggtagaagtgggcagtgatgggcctgacacatagaaggaacacctccatcgagagcgtgatctcgttgacctctggtgacgcatctggttcctcccagagagggtatcaccatcgcctgtggcgacgacacccaccgctgtagcacatgtcgccacacgctcgtccttgaaagaggtcccccattgaagtcgggtgcagatacaatgatgtgggcaatgtgggtacagccaagtaaggtgacggctggcctcctacttcacggatggcttcctcgcctgacaggatggtgcatcgtatactactcaatctaaacaaaccaactagtaaaatatggaatactactatatcttattcggcatgcaatcatcaaagcttcatcaccaaatctctgaatgcatatatatgatcaaatcaatccagcatgtacacaatgcacagcaggaactcccggtcgtagcagcacatgcatcaccacgccgatccaaacgctgcagctccccagcaactcgtacaccttcaggtgcatcacaaattcctgcacatatcaagctaaccaattcttaagcacaccacccaacgattgcaccaactattctaaataatctggcctgctcaaatgaaatcaaccgtgagccaaattatggcgtaaacattaagtccgattttacaattgagggagatggttcaatacgagcaagacatgagggaggtcaagttgacttatcagtttgtttcataagcataattcggatgggcagcgtctcgtcttgtgtccgtccaccagcagcatcccacgtaggaaaaagtacaccgaaggtctcttaacttgtcatcgagttacaaaatcgtacaaaaccggatatataaaatccctcagcttacaaaaccgtttgcttcggtggttttgagttttgaccctggttttgtcctacatggcggctgagtcagcgtaggacccgtgtgggccccacatgttagtaagccatgtcatcacctctctctctttcccctcctctctctcacttttctgaggccgacgacgggcggcgctgtggggaggaggccgccgggggagggggggagggcagaggaggaggtccggcggccggcgtcgcgccggcggaggcaacgccgccgcccgcatcctcgttgccgccgccatgccgtgcagcctgatgaagggcgcgtcggactactgcaacatctatgtggtggcgaagggcaagtcggtgaacgtgaggcttgccaagtgcggcgtagctgcgctgccgttgctgcccacccgctcgccgcttgccagtgaacgttgtagccttttcgccgctcgcctctccgacggtacgatccgtcgacgccgctgtcgggcgccgccgcgctgccggacaggacgatggccaccaccggcactccaatctgaaagaaaaacaacgcacaatctacattccgtcagtgtcgaaaaagagaaaaaagaaactcctggtgcagatcaaatcagcgaccttaaaattcccaatttgatgtacacaggctacaacgtttgcaagcactctaaaaaggagcaaaagcacgaagagaacaatgaacaacaccactggtaggagtatatgcacacattacgcccaaatcacaggctttggagtttggtctaacttaatcataagattagcacgcgaagccaaaaaaagggaaaaggaaaaatctcctgtaatcccccctcactccggcatgctcgccgatgatctccggtgccggaacgccttgagcgggctcgggaagtgccaaccccaccacgccttcgccgtcacggccgccgctttttcctccactgccgtcgcggagaccgagctcgacctcacgagccccatctcctcctcgtcgtcctcctccgctgcagcaatacctcgacgcgtccgccggcggcagcttcccccactgcgaaggctgccgccgccgccctcctctcccgcctcgccccggcggcctcctccccagccgccggccggcttgcccacagaagaggagaggagaagagaagaggagaggagaggagaggagagagagagagaggaggaggaagggagagagatgacgtagcatcctgataggtggagtctacgtggatcccacgctgacttagctgtcaggtaggataaaaccggaatcagaaccactgaaggatttattgtgaccgattgttaagtaaggatgccgcatatatgtttttgctgttgagggatgattttgtatcttgatgataagttgagggaccttttcgtgtactttttcctcccacgtagaagaacgcaatttcggctgccggccttctgggctggataaggcaacggcccacgtaaggaagacgcgtgatgggcctttcgagggaacaaagggccgtcgtagtttcaggcccaaaaagaaagtctagaggccgagagagatgctccgttttctctgcctctcctcacagaattccacgcattgcctcgttttttctgctctgctcgattaaagctgcagagaagggcagagttttcatggccatgtccatgtccatgtccagcacaacgctccaaggccggcataggtagactttttgaacggtacacctacgcctcaccgaccgctcagcctggccccgggccccggcggccggcgcggtgaaaaacgtcggccaccagccaccgtccgtgcggagaactgcgggcgccgccgcacacgcgcccgcggtgagaaatggatggacgcgacgcgagtgcgagtgcgagcgcgaccaaggacgggataggaggaggccgagatgtgtatggccaaggccatacgcataccctttgtgggggcaggggaagcggccgcgcgcgacgggacgacgaggggattttgggtggggtgggggcgcaagggggtgacatggcggcgcgacgctgcagattttggggggccgaaatccccgatagggagagacgaggatgaggcctctgctggccattggttcgccccaatcgtgtccttccaagaaaatccacctcatccccttcctctccatccccccgttgctctcaccacacgtacgcgcgcggcgcaaccctacaaactacaaactcaactcgactcgcctctccatcctcccttgattatttgttctctctttccctttccagcctcggtttagctacctccatcagcagcacacgaaccactaattaattacgccatgttctaaaccaggattcggcttggctactttctcgattttcattagcacgattttaacgattttaaagctgctaaacagcgtgtgtttttttcttctaatttttatatagaagttgttttgaaaaatccaaataaatttattgatcatttcttactaaactgattatatgccaatcacgtttctccttttgcgtgcaagttttcaacatctatttagaaagcgcccgagtttcacacacaattctcacctcaattacttgctctccaggaaatgcttatttgcaatgtcaatttttttacagcacccattaaccaacactgctatatgcaatagtagccttgactatatctaccaagaattcaaatcccaaaacaaaacatcgctgtaaccctatagtattttagtactgcttcttttgtttaaaattttcctatagtattgtgtttacatgaaacactcacacacactaggcacatcgatggcaaatctacaaccccactaaatttctattgaaaatatatatgctaaacacctttttagctgcttatcgtgttccacttataaagttgttctccatacaaaaatatacaacaaaaccagtctaatattaattacatatcagcatatggcacaccgtttgattatattattctagggcccacatgtaaatatactaccccacgaaattaaattctttgtaaattccactatatatcatactatctctgttttttaatagataaagccgttgatttttgaacacatatttaaccatttgtcttattaaaagaaaactagctaggtgccccgcgtaattgagcggctaacacccaagcaaaatcatatattttcagtatgattttgcttaaaatttattaaatagctatcttgttgtcttaagactttgaaagaccaaaccttatcatctccgtatttctaattatatagtttttaaaagtcacaccagctgctaccccttacttctgccatatccttctttatttgctcgctcaatctaccattatttctattaattatcctttaaatcttaaacaattggatcttatagtttttagagtttattgtctcgttgggtttcgtttttataatttgtaaaagtcccgtcaaacgctgccataatattcctctacggtccgtccactgtctttttctctttattgtttgggattttaaaaatcgaacataattattgttcaggttcattttttttactttttagaagtctcgccaaactgtcagcggctttgccattgtactcctttatggctcgcccgctgcctcccttctttagtgtcattgagatattaaaatcgaacataattatcattgtttttttaccttttaagaagttccgaacctttagaaattggactttgtagtttttagagtttattttcttgttgggttttattttttataatttttagaagtcccgtcaaacgataccactatactcccctacgacccatccgccgcctactctttgttttcattgggattctaaaaatcgaacataactatcgttggaatttattttttatttttaagaagtcccgccaacagttaacagctctgcaactatactcttatacaccccgcccgctgcttctcctttttactgtcattgagattttaaaaaccgaatatgattatcaacgggtttttttttactttctagaagtcccggcaaccgtcttgcctgtttgcttcatggcctgcctgtcgtccctccttttaatcgtcattaggattctatttggtgttttattaacagtttttatacgtcgtatcaaccgtcaccactctactcctttataggcttgttacttaatttacctcatcatttattttagatggtcttctctttcaatagtctttattttttctcaccaattttagttatttataaattgtattcctaactaaaatattttttctttttctaatttcagaatttatttttttttcaaattttaattaatactgtatagtgttcttttaatatttttattttttatttttgaattttagttgtttcaaaattgtattcctactttaactctcttttaatttttctaatttttgatattattttatttttattttgaattttaattaatctcgtattaggttcttatatgaattcttctttcaatattgcttatttttaattatgaatttcagttattttcaaattgtattcctacttgaactcttcttttcgttttgctaattttggattttatttttatttttattctgaatattaattaatctcgctttgggtttttatatggactcttctctcaatattccttattttaaatttcgaatttcagttatttttaaattgtattcctacttagactcttaatttttttctattttcagattttattttatttttattctgaatttcgattaatctcatattgggttcctatatggagttttctttcaatattacttatttttaattccgaattcagctatttttaaattgtatttctatttggactctccttttctttttctccgattaatgtgggaatttctagcccccacggcggcaaagtggtgccttcatttaaggctgttttaataatataatagattatgcagaagtataagatataaatcatgtttaaagtattttgagggataaaataactcacaacaaaataaattataattacgtatttttgaataagacggatggtcaaacgtgtgacagaaaattaacgacgtcatctattaaaaaagcagaggtagtattaatttagactaaaataattcaccaaacacttcaccggttcaccctttgtcctattccgttctgcagagaaaacagtgcttgaggttcagagttagtagaagctgcaactctcagctttgctagctagctagaagcagctatatatcccttatcctcttatcgcctctcaccctctagcttccctctccactgcctccctcgctcgctatctcctgcctaagcgctaagctaagcgacctgcagttctgcaatgctaaggccaacgtagagctgccgcttaatcccgtctcgcttgattggtttctgacaagaacgagattatcgagaggtttcaattcattagcttagcttagctaattagcttgagggacgccagccatggcgcccaaggcagggaaggccaagccgcacaaggccaagggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggtgagcgccggggcgcgtattatctccgtcttctcgcatggatattttcgcgtaattaattaattaatatggaccacccagtattctgaccagtgaccactgtaactgaatatgtactgttccttctattcgatggccttaattgtgcttgcatgttaaacgacaaaattaagtaaattcttctctagctttcacttgcaacactttcatcttgtttttttttaaaaaaaagaaaaaaaaactttgtttaaagcgaaagtgcctaccacttttctcttagaaacttctatatttatttttttcaattgcacagaaaacgtgtttttcttgtgctaattagcaatggcgagcgaccgagcataagcggcaacttaacaaagctggcaaagaatgaccccactcgttgaaatgtacatgatgagaatttttattttctatacgaacattacacaaaaaagttcatgggcaatttacacatcctaattatttttgagcaagttagcaatggttgtgttagcttaagtacatagtaccattttgtgcaatggcatgtagcctactgattatagtaacctgagtagcgtcccaattcccaaggttttgagttcaaatctcctagtgaattttagattagggctgtgtttagttccacgctaaaattaaaaatttgaagaaaaaaattagaagtttatgtgtgtaggaaagttttgatgtgatggaaaagttgaaagtttgaagaaaaagttgaaaactaaacaagactgggttatttttggggttaaagttccgagtttaaatctcaaattttatattgggttatttgtgtgcctaaattatcaatttaaatatggtacttataattcgcagtggtaggtgccaactcgctgcctagctcattttgtgtttgtggtgctttgttcagggcatatcaacggacaagatcctcgacgtccggaagctcctggccgtccacgtggacacatgccacctcaccaactactccctgtcccacgaggtcggtcagaggatcccaacggctcacatccgcctcgagattcgtgcccactgacagcctgtactttctccctctctgccaccaatgcaggttcgtggggcccagctcaaggacacggtggaggtcgcctccctgaagccgtgccacgtcagcatcgtcgagggtaagtctgaacgagcaaatcccgtatttctcgaggaccaaaacgcaaaaaaataaaaaactcaccgtctcgtctcccatggcgcgcggcagagggctacacggaggagctcgccgtggcgcacgtgcggcggctgctcgacatcgtcgcctgcaccgccgcgttcgggccgaggaagagtgcgcccgagcagaagcccgcatcgccgtcgtctcccgatgcgccaccgccaccgcccccgccggcgtcgcccgacgccgccaagacccccgggtcgcccgccggcggcggcggcggcgttggcgccggaggcggtggaggagaggagccgatgtacccgccgccgaagctgggacagttctacgagttcttctccttctcccacctctccccgcccctccattgtgagtgctagtagtttcgttcttctcattcatttttgttttcttttttttttatttgagcgcattcggaacagcagaagatggtgagccggttcgggtgatatttattttttttcttccacttttgttaagtgaaaatgcgattggtttcagatattaggaggtcgacgcgcccattcgttgatgacaagacagaggacgacttcttccagatcgatgtgagtttgcttgaagaaaaatagcacaaatgtgatgtttctttttagtttaattgattcgattgcattacattagagtagctagataaggtttgccaatagttgtttcaaaatctcatgctaatttaactatatattcattagattagactgcaactcatatatatgaaaactacaattaattaatttatcatagcacgcacgtaaccatcaatatggccaatgtcataaaaaaatgcaatatgacactcatttgcacctgtataattctccaagcgttctgcaattgggtgttggtgtgcaggtaagggtttgtagtgggaagccggtgaccatcgtggcctccaaagctggattctatccagcagggaagcgagcgctcatcagccactcccttgttgggctgttgcagcagacgagccgggcgtttgatggagtacgtgtgaccttggagattttgtgatttgattattaatgaatggtatctcattgatgtggaaatatgtgtgcgattttgtaggcttacaaggctcttatgaaggcttttgttgagcataataaggtgaggtcttgctaatgcttgatttcttgattattttcagacatgcctgaatatgtgactatttaaaaattattaatttcaaagctaaactttaggttagagatcattttctaggtttattggtcaatgcatttgaagagacataccctattttccacggaaacaattgaattcgtggaattggaaataagctaatgcattttgtttcactaaactgaatagtgtgcttgttttaatgtacctatatatatattttgtttgcatgtattaacacaactttgcaattgcatttgagagatttatagttcacattttattgacatttccttgcagtttggaaatcttccttatggattccggtcaaacacttgggtggtccctcctgctgttgctgatttgccatcggtgtttccaccccttccaactgaagatgaaacatggggtagcaatggtggtggtcagggaagagatggaaaacatgaccataggccatgggcaaaagaatttgccatactggctgcaatgccttgcaaaacagctgaggagaggcaaatccgagacaggaaggctttcctactccatagtttatttgtagatgttgcagttcttaaagctgttgcagctattcagcaaatggtccctgacaagagttcacttgaaacaccgaatgacaccacaaatccagatttgcacacgcaacaaattggagatatgaaaataacagtcacaaaggacaaagcggatgcaagttctaagttagatgtcaagttagatggaagtcaagctccaggaatgctgtctgatgaacttgctaagagaaatctgttgaagggcatcactgctgacgagagtgcaacagtacatgtaagactttcttctttgatacgggctgttgcagtttacttttatccattttcctgtttattgtcgatgtaattttattagtttacaggatactgctactcttggtgtggtggttgtgaagcattgtggatacacagctgttgttcaagttccagcagatgctcaactgacaactgtttctctagcacaacatgatattgacattgaagatcagcctgaaggaggtagcaacgcactgaatgtcaataggttagtacttggaaaattgattttatatatatatatatatatatatatatatatatatatatatatatatatatatatatatatatatatatatataatcttatgctaacctgataattctaaaccatgggtttacccaaatcagtcctaagtgatttactttacctctgttcgtcttggtccatttcattctttctctcttttcttaatctatttttaccattgtattggttggataaaatctatgacaatcatgtttatctcttttcagcttaaggatgctgcttcataaaccatgtattcaaccatctggaggagttcagcggttgcaaagttctcctcaagagagtgaatatagtacaaattttgtccgtaagataatgacagatagtctgcagaagcttgaatgtgaagctccaagagaaacaagaccaataagatgggagcttggagcttgctgggtgcagcacctacagaatcagacttctgagaaggccgacactaagaaaaatgaggagaccaaggatgttcctacagtgaaaggtctggggaaacagtttggtcagctgaaggagatcaagaagaagacagatgaaaagagtggaaagggtgcatccacaaaagaaaatacttcgacaaatacaaatgatgcgcaaacagtcaactcttccagcacaaaggaggataatgaggcaattctacagagatggcttccagaagctgctttccagagactaaaggaatctgaaactggactgcatgctaaggtttttccctgatcatttctgtttggagatttctcaaatgtcgtcccaagaaattacctcatttttaccggccccttcttctccaaacaacag

SEQ ID NO: 8809 - DNA, 2742 bp, Oryza sativa
tttttccctcgaggttcaacattataggttacacttgttcatttttggaaccatgtttgaacgacaactcctgcaatttaggtaggacttgagctagttaccaaagattatgacatggatatgccacatccattcagaaggtcagatataatcagcattgttcctatctacaaggtaaagtttaaccctttggattctgtaattgaatgagatgcaaatacttcctgtttattaacatgtttaaccatgatgtctttactccagcatgttgcatgctcatcagcagacggtcgaaccctgttggagtcatccaagactttcctggacaagggaaagcttgaggatgctgttaactatggcacaaaggtacagtcctgatcttgtgtcttgacacatcatgatgatttcttgaccactacatcctgttgattatacatggtgatgcaggctcttgcaaaacttgttgctgtttgtggtccttatcacagaatgacagcaggagcatacagccttttggcagtagtgctttatcatactggtgacttcaaccaggtattttctttttgggatttaagccagtagttattttatacattgctctgtagaatgtaatattgcaaatattgtcttctgtgcaaatattgttaaagttgaattctgattctagacaaatcttgggtacgatgaatgggaatcatgcagaattattttgaacaacagttaatatgatgatcatgtggaaattgtgactgtaagctgcttaagtgtaatataatgcaaaatgtttctcattcatgttacatgaagtactgaaatatacacttgtcaaggggttaactcgtagttttttgagtgaaggtttaacttgtatatgcatatatatacatatacatacatacatacatacatacatactatccagtgctgtgaagactggctttataaatgttcactctctattttaccaggcaacaatctatcaacagaaggctttagatataaatgagagagaacttggactagatcatccagatacaatgaaaagctatggagatcttgcagttttctattaccgcctgcagcatacagaattggcattaaagtatgtgcttgttgtcgtttacaaaagctatatgcctagggtaccatctagtttgtttttatgagtaagctatgaagtctgttctatttactctctttggaaatctcaactatgttatgctctgttttgtgtatcaggtatgtgaatcgtgccctatatcttttgcacctgacatgtggaccctctcatcctaatactgctgcaacttatattaatgtggcaatgatggaagaagggctgggtaatgttcatgttgcacttcgttaccttcatgaggctctaaaatgcaacaagaggttgcttggtgctgatcacatacaggtttgcaaccctatctgttttagttctcaattgagttccgacacatacagtagtctaattcatggccacatcagttttgatgttcacactcgttttgctgggaactatgagaaccattccctttcatgatccaaagaaaacttgagactgaaaactcatcttatatatcttgatgtttttattgacagactgctgctagttaccatgctattgctattgctctgtctttaatggaagcatactctttaagtgtccaacatgaaaaaaccactttacgaatacttcaagcaaagcttgggtcggaagatcttcgtacacaggtaagccgacaaaaattgcttcctggtgatgtgttcttccacttaccaatcaatttcattctttagttattttccattctactgcagcaaggaaatctaataactatgttttccacaggatgctgctgcttggcttgaatattttgagtccaaggcactagagcagcaggaagcagcacgtaatggtactccaaagcctgatgcttcaatagcaagcagaggccacctgaggtagatgacatgattgctcgtctttaccatgttgtttcataaaagtggttgcaaaagttaggattgagttttgtttatttgtgaatcaatgatctctattgcactattgccatttctagtactggaaatggcaggggctctccctctatctaaaaataaaagggaaaaaaaactcatctctaagtgtctacatggactaataaatgccatagcgtgctgactaagcttgtcactgttatccttatgatgattacatttcgggggtagaggcttacaaaaggaaaagagtatacttatttaaatttacatatcgatctattttggatgattgtctttgcttgtgcttaggtttgatttttctttcagtgtatcagatcttctggattatatcaatccagatgatgaactcaaggctaaggaaatgcaaaagaaacaagcccgcgctaaggtatgtttattgttaaggccttccactggtactatatggcattcttttatttcgccaatggtcactcatatgtgcacattatgaataatagatcaaaggtcgtgccgggcaaaatccatctgaagtagtcgatgatgaagatcaaaggagcccaccacctaaaagtgaccattcattaattgagaaggaaagttctgaagtcaaagagaatggaacgtttattcagaaagagaaactgaaagaagaaataccaggtaacaccttaagccgtatacctcaagatgattttactgaagagtacacgtcggatgaagggtggc

SEQ ID NO: 8810 - DNA, 13048 bp, Oryza sativa
agacacaacctgagaagaaaagagatcttgtagcctcagatgtatcatcgtcatctcaatcattaccaacagtaactgaagctaatgccccaaacgaagtagcatctatggtgactgaggcaaatgattcttcctccaatgatgatgaaagagatgcaggagaggatgctcaagaacagatgtctagtggaggcgaaaatgagaaatcttcaccatctgaaagtgaaaagaatgattcaccaggtgccaaagagacggccagtaagctttctgctgctgctgctccattcaatccctccactgttccagcttttgggtcaatggccattccaggtttcagagaacatggaggattgctgccatcaccagccaatgtacccccgatgttgtcgatccctcttcgtaaacaccctcaccaatctgcaaccgcaagagtcccttatggtccacggttggctggaggctacaacagatcaggtcaccgtggccctcgtaacaagtctgccttgccaagcagtgaaggccttaccgaagcaaacacatttgccactagggtgatgaaccctaacgcagccgagtttgtgccaggtcaatctcggagtcctaatggcaacccagcatctccaaacggacctctagcatcaccaggtggcactgaagcttcacctcatggccttccttctccctcagacagtatagtagaatcacctgcaactgcatctccacaagtttctgaaattagccagaccagtcctgaaggaaatgatacaaccagtggggtcgatactgaaaatgggagtgaaaaacaggacactgatggcaagaaccatgtggaaagtaaagacggcgaaggggagcctgagcaaaccgaagcttccaaaggtgatggagatggtgcaattaccccggaagatggttcagccgtgactgaaaatccaaagtcctgggcagactacagtgatggagaagctgaggctgttgaggttgcaagctgagaaaagataaaccttctcagtacacacagaaaattttacctcttttacagatgagactttttcttctggacagcatacaaatgcaaaaccggcacactgctattttgtgtagagaattagttcctttcctgatccatctcatggtatgtagcatctacacgtgcttctgcagttccaatggccttgaaaggttatgcaatggcagagaactttgaagatctcttcctgagagtgatcgatgagccctttttttcagcttgctttgcatttgctccaaagaaacttgggaagagcaagcacacgagagattggttagcgcatatataccatagttcatagtcttccctttttgcctatcattttgttcaacttgttattatgtactggaccatctgtcgacataacacatgtgaacttatttttactctgaattttgatatattagaattgttgaaccatgtaaattgtaaagaaagtggtgcctatttggcctcttgcttgatgtgaattttacccaagatgaaatccgggattcaaagtgcatggcagaaatggaaacctggaggatacatctaatctacctagtgagttaaccgtccgtgctgatcagattatgtaatcggtcttggctttaatgaagagtacttttttttttggttttttttcagctcaatcttcttaattaaatactttagcgaattgctttagttaattaggaacaccgtcacatactcacataatccctccgtccccaaaagacggttcttttagagagtcaaagtcattccaagcaaaacattagaagactattatgctcttcgttaatacagagagaaatgaggggagaatgaatgaggagactattggttcaatggcaaaaaaaaaaaaagagaaaaggattcaataatattaaagagggctaataaatcattaagaagacagtcttcgtgggacaaattttgagctaaaaaacacagcaagcgcaaaattcaatagtgtagcacaccgaggtagagtcgtagagatcagtcatcatgcacgtgaaatcatgttgttagaaaaaaaaaagatgacccgttaaaactattatgcaatattattgttgcatttgggttctcaggccattcccaacccaagacactaaatatagttttcataaattctacattatcaaaaaaaatcagtactagacactactctttcaatgctaacaccacttttatatacttaaatttaatgttttgtcttggatattgtgtagaaacaatatatctttcctcatttattcacttgccacatcatcttttatactagggagaaaattgacattgtgccattgtcacgatggggtttcgctcaaatgccactgtacagatgggattcgataatacgccactttcaacccgtgcatctacgctcaaatgccatttactccatctcttcccaattaaaatcatctttccctgttttctatttgtttctgaccaaaataccctagctggtatcattcgtggggagaaagagatgggtgtcgggcgaggcggactggaggagaagcttcgccgcggaagcggccggcatggggcagagtaaagcttaaagaagcttgtgttctctcctagttcaagcctgcacaaacaagcaagttgctgcttaccaggatgacaggaagtccagatcaatggctgcttcttggatctgggcagctgctccatcgtcacaagtgatgggattgccgctggcggtggtgaagacaggcgtcgacgacattgatgaagaaggccacagcaacggttgtgatggtggagaagtaggcgcggcgctgcgaccggcgaaacaggaatgcggtgatgacgacgagccgcgaagaggcttggtgcctcggtgagccgatctgcgacgatcgacagacggtgggggacgacgagaagaactgcggtgaggtcggccgggcggcggcttgctgcttggagatggctgatcgaggatgaacacgatggctcacggcagcagctcgctgccggtacgccgacaccattgctgtccatgttgaacagggaaaacaaggggaaaacaatgtgaaaacaggggtgttttggtcaacacacaagataaaatagggcaaaatgattttaattggaaagaaacgatgcaaatggcatttgagcgtagacacacgggttgaaagtgacattttattgaatcccatctgtgtaatggcatttcagcgaaatcccatcgtgacaatggcacaatgtcaattttctctatactagatgacagcttatttaatgttagagcaggtacaataggaagctataagtcaactataaacatattttaaagaaataaagaaagatagagaagagcagctggctacagatctatagccagctgcaacacgaactctaagacgtaatgtgtgtatgataggtagaaccaagtatttatagtatagtaagcaattattgtatgaactgactattatattgactatagatgatttggagctagtagtgagctatactattgaacttgctcttatagacaccatcctagttattgggttgggaattgccttatggctgatctcttcatgttaccggtggtagcgctacgatttgttcttttcttctttccggagcattgaaaaaaatcgaacatagtatggattgaccatttgtttgtcatgctccctttttggctttttttgttctctgtgataagtgcttagcagttagcacttggtgatgttttcgattaatttcaaaatataagcattttaggttgtttagtaaatagtaacattaaaattttagtaatttcagttgttaaagtttgaattttcaattgcttatatccccttctaagtacctgattgttgagaaattatggattttcatgcattagaattagtgtctcaaaatacttatattgtgctataatcttcgaatactataaaaatccttggactttagaatagtgggagtatgaccgtgtgcatacttaactactttagaggatatgaattcatggttacaatccatattttatcctttcggaccacttgatcagttagttatgtatttggttcatgggaagaaaggatgggatggccacaaagggaatattacacatttacaccttccttcagtgaagctcgctctactgagcaaacccttagaaattagcttagcttcactcaaacttacctctgtgactcgcgcgacgaactttttgcatttagtgtcgatatttgctcatgtgtgtgcgatggttttcaccagaacaaaataattcaaaaaacaccaaagcatgagtattggacatattgaagcggattgggtgcttctgtttaaaaaaatctctccgtgactcgtgcgactaaattttgttcatttagtgcagacattagctcacatcctccacgtgtgacacctagccgactaggtggagaaccacctagagtaataagcgcgatgatgatgacctgacatcggcccaagctaggtgctcctccaagaactataactcccaagctcacaagatccaaaactccctcgctcacaagatttttggctcaagaactaagtggagaaggctaggagccctagagaagctaagggatatgtccaaaagatgtgctatccagacaatcaaaatggggatgggtagggttaaatactagcccatccccacaactaacagttaccaattcaaactctggaagttcaagtgtggaagatcggaacttcaggtcaacacttcaactagcaactaagatagggactggaatctcctttccaaaagacttgaaccttaagtccgaggttgttatactggtccagagaaatgacctgaacttccggtcagccttccagcgccgaacaatgaattctgacctaacgtttcggtgcaatttatcaaaatttttggtcaaagttcaaggaccgccaattttccttttgtatgtgtggtgcattgtgtctctctctacaaaattaagggtgatactagggcacttagacacaacgcataccattgatgccagcccctcttaatagtgtagtgtagttttcctatgactcaaattcaaaccgaaaataaatttaaatcgccttgagccaatcaccgattcgcatcaatttgtggggtcggggtctccatctttttagattattaagcacataggatgaatacctacactaatctcattcaacatgatatatcctctaattacattgtcatttatcatcaaaacctactaaggatctagaagcacttcacaatgtattagaggtgtggatggaagtcacctccacgcaaaatatgccaaagaaagccctcaagtcgataactattctagttgcatgggaactgtggaaggagagaaactcaagaatcttcaaaaatctgggaaacactccaacctccatcatggcaaaaataaagtaaaggaggaagcgcatatatgggtaatggcggggtgagttgcctaactgagatttactggttgtgtgagtagtcatcttcctttccttggtccggaatgaccctaactcccaattcctttgtacctatgaactcttcttctctatcaatatataagacaaacttcttgccttcttttcaaaaaaacaaaaaaaaacaacgtattagaggtagctagcagttgagtagttgaccttgcatacacagataaccaataggactaatttcacgcttccttcacactgaggtgaccacttacaccactaaacaacaaacgggaaataaccatgattagacattaaacaaagacatgcggatgcagtgagccatgtgtaacgctcaccttgatatcgaccatttcccaacttcttcgaggatttcattatattaattaatgtcaacagcggagagcttttgcgttgctaaccgttgatcatattatgcctctccctttcacattacaagtgattactgtacccccttaattacttctaggcgacttttgtgccaaccactttggatttgactatgcatcagagctcttaatttgttgagctacaagttaaatgagccagaaacaattgatcaagctcagcagctacagtatttcaagctctctcttaaccatgatagagatctagagaagtaaatttacattaaggtggcaattgaactaaaggcaaaactaattacagagagccctccaagcctcgaaaccggctggcatttaggcccttatatggttctaataatccctgtacttcaacactaacgaaacacacaatattttttttaggcccttgtgacatactagggtggtaaagaacagcaacagaggctcaaagaggaggcacaatattttttttttcttctcttttggtttgaacatagcacagcagtagcagcagcactctctcacaagtctctcatgaaccattcaacaacaacaagaagaaaaagaacctaagggctccattggagaatagcaactctgcacaatctaattaagcatttgcaacacaaaatagctcttggaatcttggcaacaatcaccggtcgaggggctcggtttggtccttgacaaccaggcgttcagaaacctctgcaagagatttcaggttgcatttcagcagggcctccacgaagtagcatgtctcatccttggtgttcccctccgggacgtcgacgacgaacgactcgatcaccagcgtcccgggccggccgtcgatcacctccgggtggacggtcaggatggaggagtaattctgtggaaagaaggaaaaaagaaatgacaataagatcagtttattcagctcacaagttcagtgtccttgagctaacaccaagaggcagagataaggttctccctcggattcggacaagtggtttccattatccagatgcagtgcatgtgaggccatttgtgccagcatcgccgctgagcaaagcaaacggataatggaccatgagtccatgccaaaacaagtgacagatcctttttttttaaaaaaaatgttttggaacaagtgacagatcctctcatttttttattttgttttaattttgagaaagtccaaaaaaataccattgacaagcatccaatttcaagaaatgtctactagttccatgaaatatcatcgtacaaacgattttgtcccagaaataccatcgccgttaaggttccgttaacggcgtgggatggatggaaccctaacgacaatggtatttctaggacaaaatcgcttgtacgatggcattttatagaactcgcactcattgatggcatttcttggatttgggtgtttatcaatggcatttcttggattttctatttaatttttgttttgaaacaagtgacagatcctcatgcaacgaattcggcaggtaaggtcaaagaaatggccagtcagggccatgctgttagttcatatggccaagggaatacaatacaaccaatagcttgttttgtggttagacgacaaaagttcgttgaagatgtgacaattgaaaaattcaggttgcgcagaccagcaggaaatatctcccccacagtccattatcatggccagtggggaggcatgaattagagcactaataaaataacaaattacggattaacctcatcattgtaagcgcattagcgtgcatgttccttgttgtcaataactgaacaggacatgagcagaacagatgacaaaaaagtacacctgtctattgtttcaagtgtgctctgtttgctagtccagggacagtgtatccagcaaaaaccttttctttttcaaagcaagagagtctattactctaatcagtggaatcaacccgtcatgtgcatacggtttgactatgcaaagcactgagatagtaaaatggtttaagatgacagatcatgcagaatatgttgcagcaccaagctgcagataaggttctagtaaccaatggttaaagtatactccctccgtttcgaaatgtttgacgccgttgactttttatcacatgtttgaccgttcgtcttattcaaaaaatttaagtaattattaattcttttcctatcatttgattcattgttaaatatatttttatataggcatataattttacatatctcataaaagtttttgaataagacgaatggtcaaacatgtgctaaaaagtcaacggtgtcaaacatttcgaaacggagggagtactaatttggcataaaaaaatgcagcagctgctgcaagggtatgaaatgctctaattgtcaacaaaatctgaaaattcaggaagctgctgtagctgataaaatctctagtgcccatctgaagttcagttagaaggtactatgtgaatcttgattagaaatctggagaacagatgattactgcttccttagtaatcaaggaagtttcaatcctaaacagaaaaaggaaaatcgaaaaatgcacaatagtcacatgtaagatatcagttattaacatgtctgatccatagtaacatgtaacatctgaacagcaaattaattacaagattattaacggttgatcaacatggaaacataccttgagcctatgatcacctcccacgaacctgacactgagtatgtgctcattgtcatctaacagctccagcctctcagtgcttcttgtggcaggcaggccagacttaacattaacctcccttacactgccaatctcaatgttccctttcatctcacaccggctcacaaatggcttgaaaagctgtggctgatcaaaacgcctcaccagagaccaaacctgcaggtttggttgccacaaattcaattagctgcagtttggttgactacacaaaagtatattaggcaaaaaaaatatgtagaaattaataatctttcaacaaacagggcagttgatattaaatgttcttgcataaagatcccaactgtgctagatcattcaggctgtcctatcaatgaacagttgaaagaaaaaacagaaattaactgaagaggctggcaaggatggtgcaaaagtttcattcaagacagattgaataggacagctcttttaatcagagacacacaatttctaaatggagaatttctaaatggagaaacagaggctagactctagagaatgccaatgatctctatagaaatatactcctatttggagttggaattaggcatcctttaagaatatgctgattattactgttgctggtaattgacaaaaatgataactttatatcatttgattaactctcagtgtcacaggcatcacatgattctgcaaaaaaaaaaaaaaacaaaaaaacaaaacaaaacgcaaaaaagaaagctaaatttcaacccaatcttcttagaaccactcaatagatatcgaaaggagtggaatccaactcaagggtatctctaccatttctttgcaggagtattacttattaagagaataaaggtacaactaagaaaaaggttaataaagtagtaagtagaaaccaatgcaagaacatccagaaatccaaaaataatcaaacaaaaaacaaatcagataaagccgggatctcgaggtggggggaagcatcttcccacgtgagatggcggtacgaaaggcagaattaaaaatccgtgcgattttcgtactagccatcatatcattgcgatcaatcatctgcgcattcttcttcctgcagagcaaatccagcaaagtagcatgcccaatccaagaacagctccacgattgttgcaagaaacagaaatcaatcgcaagcatcgcgtatataaaactgtttcgatcaattgccgcacactaatcagaaaggggaacaagaagaaaaaaaagaaaagcagaacaagaaagcctccaaattaagcttttcgatttgttggcatccttcctgatcgagaaattaaagaagagagccccaagaataaacaaaccaagaaaccgaagcagcgatggattcaggggaagctgcagaaggtcaccaggtggacgggggccttgatgtgcttggcgacggcggaggagcactggtggtcgcggggctcgtggcggtggaaccgcctcacgtactccgtctccgccgcgcgcagtcgcacctctcgtccgccagccgccacctcctccccgccgccgtctccgccgctcctcctcccacctccaccatcctcaagaaccccccctccctccgccccggcaatggacgcgacagcgacgcgcgcaggcggcgaagaccaggaggaggagaggagttttggtttgcctctggctttggtggtgcgtcgacgacgaggtgatcgacgacgacgacgacgacctatcgatggcagtgaggccgcgggctcagggtgtggtggtggttgttattcgatcgggggagtttttcggatacagccctgtgaggttcttgaaattgtagattggtccctcctctcttttttccttggatattattatttggcttgtgacttctgaattgatggatggatgggccccaagacatgagaggtgatgacattgttatctcttagaaatagctttttttttcttgttttgtttggtatatactctcttttttaaaaaataataataataattctaagtatgaatctggacatgcgtccaatggagggtacacgatggacactatgccccttttcttctgctccctctttttcaaaaatgatgggacatattttactactatgaatctagacggtttccctgattagattcgtagtaatacaatgtgtctcatcttatcttaatttcttatatttttagacggaggtagtaatactaaagatgggtgcaatgtcccaaaaaaaactactagtaatttagaaaatatgggggcaattcttttatgagaaaaaggaacataagtggcaaaagagaataatgataggttagttcacacttcataagtagactagactagcaaagttgcccgaatttttgtcatactatgaaactattccaaggatgccaacataatacttacaagtttatatttttattggggaaaaaacgtgtcatacgagatattgtgcatcataacaaaaaatcttgaggatcgatcaaatttgaccttgagccacgcaaaatatatcacacatcatacaagatattgtacatcgtaccaaaaaaattgatcaattttgaccttaagccacatggaatatatcgcatgcaagccaataatatgtacacgattttattgatttatttctcgatgaatagaacttaaagatataaaccctcatgctcgaatatcttgttgacaatatcaacaagtgcaatttagcctttgagttcttttattaagattactatatatacacaaataaccctctagatataaggtataacatatacatttaacctttttcaaaattataggatcaatgttttcttttctcctccaaagataggtataatgtattgcatagtagtaataaaagttgatataaaattctatttagttgttggtcatataccaaagtagtattagctagtgaacccctctcatgggcataaatagttaagataaattacaaaatagatacactcaagccaaaatattttatagacattcaagccaaaataaaagtggcaaaagagaacaatcataagttagttcagacttcacaagtagattagactagcaaagttgctcgaatttttgtcatactagggaaccttttccttaataaggatgccagcactatacttgcacgattatatttttcttgggggaaaaacatgtcatacgagatattgtacgtcataacaacaacctcgaggattgatcaaatttgaccttgagtcacgcaaaatacatcacatgtcatacgagatattgtacatcatacaaaaaaaaatcttgtggatagatcaaatttgacctcgagccatgcgaaatatatcacacgtcatacaagatattgtacatcataccaaaaatgttgtcaatcgatcaaatttgaccttgagccacgtggaatatatcacatgcaacccgataatatgtacacaattttattgatttatttcttggtgagttgcacttaaagatataaatactcatgattgaatatctattgacaaaaattgtgaggcttgcaagtgcaatttagcctttgaattcttttgctgagattaatatgcacagataaccctctagatataaggtatcacatatccatttaccccttttcaaaattataggttcaatgttttcctttctcctctaaaaacaggtataatatattttatataagtaacaaaagtagaaataaaatgttactagtagtggttggttgtatgaaagaagtattagctagtgaaccatctcatgggcataaatagttaacacaaattaagaaatagatatagtcaagccaaaatatcttatagacagtcaagccaaaataaaagtggaaaaatagaaaattgataggttagttcagttttttgaagtagactagactagcaaagttgcccgaattttgtcatacctgtgaactctctcctaaataaggatgacaacttcatagttacacgtgtgttgttttatgaaaaaaatacatatcctacaaaatattgtacatcataccaaaataagtcttgtcgatcgatcaaatttgaccttgagccacacaaaatatatcacgtgtcatacaatatattgtacattgtacccaatcttctttgtcgatctatcaaatttgaccttgagccacgcgaaatatatcacatgcaacccaataatatgtacacaattttttatttcttgttgagtttcaattaaatatatataaacccttatgctcaaaactgtaggttcagtgttttcctttttccactaaagataggtataatgtatttttatagtagaaataaaatgttatttagtagttgatggaatgaaagtagtattagtgagcccctcttatgggcataaatagtcataagacaaattacagaaagtagatatgatcaagtcaaattatcttaaagataacacataagctgatgaaaaactccggttaaagttcccctagtggaacactaccataataaatgagttgacatcat

SEQ ID NO: 8811 - DNA, 551 bp, Oryza sativa
tcgagccacacacgacgcccacgtcctgtttacttggccgcaacttcacaagtactgagtcctcgccgacgtcgttgcttgcaccaaccaactaacctgcatgcatgcaaactgaccacttcctactcctaatcttgtgcaagactcggctaatcactagcccacaattatgcatggctaactaactaagctacatacatgtgctctcatctcctggctctttattggctcactactccctgccaaccactactcactaagccatgcagcacccacgtacatatagctagctcgccaggccatgcaatacacacatgcatatagataaacatgctgaaattaagaaacaacaagattaatttctaacaagggagccgtcggcgcgcgcgacatgtgggtctgtctctcccggcatgcggcgggaaccagcggcggcagaagcgggagtggcggcgatagccgtgagcttcgtggatgcctccataaatgacgacgacgacggggtctgccggcaacttctgcgacgaggcttcaccgatgagatggccccc

SEQ ID NO: 8812 - DNA, 1620 bp, Oryza sativa
ttttctatgtatcaattcaatatccctttagaaagcttgatgactctgtgtagtgtgatttctgtgcaaataagtcttgcagcttagctaatggaaatagtaaaaaaaatcttcaatatatcacctcccaaccttgtccatgatttttatatcattgctaagttttgatggaatttgttcgtttgaaagcttgaagatagtggtgtttatgcttgcaattaaccttacctgatttcttttctgtgattttcgtgttaagaatccggctattagcattattgtttcagttgtaaaagaatatgttgattgttaggacaggctttcgaccaattaggctcctcatcttggcaatattgtaaggcaccgtgtctctccctattcaacatatagagaacagccatttatttttcttttagtagcaagagaaattacattggccagaatggccagttgtgaactgaattatcctgaacctgtgctgtgtgatttgatggtatatgcaggatgttttatttgtgggcattaccgtcttccctctttcatggacggtatgatgaggaactcccattgtgcaagctcttcagcatgcctaattgggtacgcatgtatgcaaaccactttcccaattaattaacactactgtttttacttccctataggtcaattgattggtgaagcattttatcccttttcgaacagaaccaatgaagcaacaacaagacagtgtggtcctattttgttttttgcaaatccaagccattagtacgacttactatatatgaaactcgcccctgcgtgctgtatgatatcctgtataaaacctacatcttgcgatgagcattgtaactgctttgaatttatgaaagttacttatctaatgcactgtgcttctaggaatctgtcaatgcttgtagcaatcaaacgaggaatatagctaggaataggaaatattgatttaaacttactgatccttgaagtagatcatttagccatattctgatttacaactgactatgctaacaatcagcatattctgatttatgactggaacaataattctaatagatcaacttctattaccatgttaatcccaaaatacgttaattgttagcatagatcagcttcaaatatgctaataatgcaggcaaaaattgatgtcctgtgaagagtactatatcaatgctatatgctatacccatccttttcctgtcaacaaactgcagtatccatccccatggaaatcaaccatttacaagttatggtactactgtttgctaattagcttttcatcttagatggtcatcgtgcacactgcacttctttgtaaatataacatacctcctacgtatctagcagttattagagactgctaactaacaagatgcttatgtgtagtgaacaatccagtatgttatcgttgtcttatattttgtttctgatatgtttatttacctttcctaattttcagctctttctgcaaatctactcaacatattatcacactcttcgcaccaaccacgcataggccttcatgaaacaagacagagtggttagctcttccgtttgctttaaattcttttatgccttcagccaacagctgacacccagttttcattacag

SEQ ID NO: 8813 - DNA, 810 bp, Oryza sativa
cgaaggcggtcgacggtgaaagcgaagatgcccactaatggcggcatgataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtagacggaggcaccaatcggcggcgacggaggcaggccggcggtgaagatgtagacgcccaacaacggcggcataataggccagccgtgtagacggaggcaccaatcggcggcgacggaggcaggccggcggtgaagatgtagacgcccaacaacggaggcataataggccagccgtgtaggcggaggcaccaatcggcggcgacggaggcaggccggcggtgaagatgtagacgcccaacaacggtggtgtgaccaaccaaccatataggcgaagacaccagtcggcggcgacggaggcaggccggcggtgaagatgtagacgcccaacaacggcggcataataggccagccgtgtagacggaggcaccaatcggcggcgacggaggcaggccggcggtgaagatgtagacgcccaacaacggtggcataataggccagccgtgcaggcggaggcaccactcggcggcaacggaggcaggccggcggtgaagtcgtagacacccaacagcggcggcataataggccagccgtgtaggcggaggcaccaatcggcggcgacggaggcagg

SEQ ID NO: 8814 - DNA, 7491 bp, Oryza sativa
ttcggcccaggtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattggcgaacatattgtcaaattttactcaggtttacgaacttgctaagtgcacatcgagatctctaaacttggtttagagtatcatctcggtccaaagccgcgtttgaccgtgctcttgcctatgtgacacgccacatagacgatgacatggaattttttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtgtacgcattgactcgatcaatcaacggggagggaacacaacacggcggccatcgatggccggcgttttgcagatcacatcgtcgacgaccaccacgaggtacaatattgtcggcctcatcttcttcttctccgtcttctgcgacgatctctactcgccggctccagtcgccttggccttgaccttcaaccacaccaacttcggcccggacgagcagacgaacatcaggctggaaggcgacgccgccttcagcgccgacttctccttcagcggcgacggcggcgggtgggtcgacatcagcgccaacaggcacggcagcatcgaagacagccgtggcagggtgtcgtacgcccttccggtccctctctgggacgccgccaccggcgaggttgccagcttcaccaccggcttctccttcgtcatcaacccgcccaaacaggacggcggcatcgacaacaagggcgccggcatggccttcttcctcgccggcttcccgtcgaggctccccggctcctacccctacaacctcggcctcaccaaccagaccgccgaccaggtggccgccggcgacgaccggttcgtcgccgtggagttcgacaccttcaacgacaccatcgtgcacgaccccgacgccacctacgaccacctcggcgtcgacgtcaactccgtcgtgtccaagacgaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgttgccggagcaggtcgccgtcggcttctccgccgcgacgtccacatccgtcgagctgcatcagctacgttcatggtacttcagctcgtcgctggaacccaaggccgcaccgccaccggtggcgccgccgtcaccgtcaccaccgcctacctccggttcaggaagtggcggggttgtagcgggagccaccgtcggcgcagcactgttcgtcgtgctcctctttgccatggtagcagtcgtcgtactcgtacgacgacgacatcagaggaagaagatgagggaggcggaggaggcgaacgacgacgacgatgacacggaaggcgatcccatcatggagatcgagaacgggacggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattgacgaacatattgtcaaatttaactcaagtgatcagctaacttctattttgtcacagggtcaagattattcttgggctcggatcagccctattctaccttcatgaggagtgggagcaatgtgtcgtacaccgtgacatcaagccaagcaatgtcatgttggatgagtccttcaatgccaaactaggtgacttcggacttgcaaggttcattgatcacatcgtggggatgcagacaatgactgcagtctctgggacaccgggctatgttgatcctgaatgcgtgatcaccggcagagcaagcgcagaatccgacgtttatagcttcggcattgtcctactggaggtggcgtgcgggaggaggccgatgagcttactagacagccagaagaatggtatcttccggttggtcgagtgggcttgggatttgtacggcaagggagacattctcatggccgctgatgagcggctcaacggcgactacgacgcggcggagatggagcgtgtcattgtcatcgggctctggtgcgcacaccctgatccgaacgcgcgtccgtctatcagaaatgccatggctatgctccaatccggtgggcaactgccagtgttgccggctaagatgcccgtgccgatgtacattcctccagtggtctctgtagatgagctcttcacgtcgcctgcagggatgtcatcctcaagtgcgacgcagtcatcaacaacaacggtgagtggctacgcaacccacatctcgacttcttctgacacatccacttcagctggttcgaaggactcgtcttcgttgctcaaacatcagttctagtaatgttcagttcatttgagttgttcttgattttacagtagttgatgcttggatgggatgttcagctcgtcagcgcccgttgatttgatctttagacttttgcttaattgccggtgtgagtaatctggtatttacgccatgctttgaacttttacagtcattttaagtttgtctacaaatatgtatgtataaatgtataatgccacatttctattcattcagattgccgatatacctaacagctcgttctttcgatcgtccgcttgctagaagccagttaatgttctgggcctcaggcccattagtagagtaggcctccatcctccttattgccttcaccatcaggcccatagtacaaagttaggctgggccatagcctgcaggcaaagttgctttaatcaattcctagtgattttgctatatactgtatttattagcaaattttctcccaaaatattgacatgtaaatataatataattatagtgtaactacatcgttagatttgcttcaagattcgtactaacgagagaaaaaaatcacaccgcatacacatctggggattcggtcacatgacctccattttatagaaatagcatattactaagagatttttaaaagttacatacaagttaaattttagttttatgtaaattaaaatgtattgtactatttattttatctaccaaaatttttgaagaaaatttataaacgaatatataggtagtaccattagaggaagctattagcagagaccttgagacattgactggtctctcttgagtagatagatatatatgtactttttttttccagcatcactctcgatcaatcagtggatggctacaataattttagataggatagtgctagtccttgacttatggtctcctgaaagcaactactacttgctactacaatagtttcagtcttcatataggctcctgtagtccttcgacttgcggtttcatgtgcattgcacctagctctactatcaatggtgattggtgatcagatgtgtttgtgttttggatatatatatctagatatcggtgcctaactttatacggtagtataattttttaaaggtagaggacaacaataatttatactatcaattattcaaaggatttttataactttgtgtcgttagaacgaaaccagtgcacgtgcttaaaatcaacatcagcataggctcattatattcctcgaagtctagaaaattaatcaaaccaatgttcatggaggcaatggttaattttcagtcacaattttgagaagtttgggcgcaccataaaaaaaataaaatacaccagcagttcttaaactagttaggaggtttcactcaggtttacgaacttgctaagtgcacatcgagatctctaaacttggtttactgtatcatctcggttcaaagccgcgtttgaccgtggtcttgcctatgtgacacgccacatggacgatgacatggaattcttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtatacgcattgactctattaatcagcgggggagggaacacggtggcgatcgatggccggcgtcttgccggcaaccaccacgacgaacaatattgtcgggctcatcttcttctgtcagatcgtcatctgacagtgctgaggaagatactgaagaagaactgagcttggaagcagagcaggacgatgatgagaagatgcagctgaagctgaagatgcagagcagggaggagttatggaccatcgacccgcgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacaatctggtatcagagcctcaatttgtctcgaaatcctcttgattttgctgtaaaattccttgcaagggattggaaccgacttcggttggattccgcgaaaaggaaacttgcccttctaggttagcgaaattcggagagtagacaagttcaggcctcggatccaggagtagcgccatggatacggatgggaagcttgatgtgttgctcaagttggtggaggggaacgagaagaagcgggtggaagcggatgagtgtacgagggcggagtaccaagagctcaagaagacggtggaatccagaattcctgtggttgagaagaaggtggaggtgttgagcgaggcgttgctcgagctgaatctcaaggtgaaccgcttggagggatagatgcagaggacagttaaggaagaagttcctcaaggcaaggttgctgatccgaaaccgaccacaccatctggtatgcgagatcttcacctgttttcctctgcttctactttcggaaacaattctaggaagtctgatcaaggaggtgaaattcccatggacattagtgctaacggtccacccatggtttgtccacaattcaatggtgataaccctcagatgtggaaatcaaattgtgagcaatattttgaagtttatggcacacatcctatcaattgggtaaaaattgcaaccctgaatttcgtgggcaatgctgcgttctggatgcaatctgttaggtctcaactgcagggaattacttgggtggggttatgtgaattggtgtgtagcaggtttgctaaagataggcatcaggcactgattcgccaatggattcatatttctcagactgggtcagtgagtgagtatgtggaaaaatttgatgggttaatgcaccaactaatggcctatgattcatcattagttcctgtttattttttcaccaagtttgtggaatgattgaaagatgagataagagtagtggttatggttcagaggccccaggatttagattctgcttgtgccatagccctgctgcaggaggaagctttagaaggtgttaaggccagtcattacaggaggtcagacccaggggttatgctcaaaacaaatagaactggacctattgtgggagttactcagcatactaagaacaatttgaatcaatctgaagacagaaggggcactgaatctgctagagctaaagatgataaggtggctgctctgagggcttataggaggtccaagggactatgctttgtctgtggagaacgatggggtaaagaacataagtgtgcaactacagttcagcttcatgtagtggaacaactgttggcagtgttacaacctgaaattgacagtgattctgataacattgaattgggaacatcaccagaacaacatggcactttattgaccatatctcaacaagctctgtggggaactgaatcaaatcagtctatcaaggtgaatggttgggtgcagggaatggaactgatcatgcttattgactcaggcagcacacattcgtttgtggatgaacaaattgcacttaagttgatgggagctagaaggttgcaacaacccctaactgttagaattgctgatggaggtgtcatgcagtgcactagggaaattgctgactgtcgttggtggatgcagggacagagtttctgcagtaatttccgactgctacccctgggaaattatgatgccatattgggtatggactggctcacaatgcacagcccaatgaaggtagactgggttcaaaaatggatggaattccaatacctgggaagggatgttcgaattcaaggaattactaatcagccagcacagtgttctcatataacacacaaccagttatctggcatgaacaggaagggttcactgttgtattttatccagttacaaaatatggccatacaggagaatagcactatttctgattcagtcaaacctatgttgttagagtttgctgacctctttgaggaaccaactgaattacctccgagaagagcttgtgatcacagcattaacctcattccaggggctaaacccattaatctgagaccttataggcacaatcctgctctcaaggatgaaatagagaggcagatagctgagatgctcaagtctgggg

SEQ ID NO: 8815 - DNA, 3403 bp, Oryza sativa
gtccagattttgagtcacatttgactcatgtcagacaagtcttacaactacttcagcaatatcagtggaaggttaaattaagcaaatgttcttttgcttagtcacagttatcttatttgggccacatcatcggtgcaaatggggttgcaactgatccacaaaaggttcaggatatactcaattgggagattcctaccaatgttaagaagttgagaggatttctgggattggctggttattacagaaaatttgtacaaggctttggtctgaaaagtaaacctctgaccaatcttttgaggaagggtgttccttttgtttggagtacagaagcagattcagccttccaggctcttaagacatctctggcctcagctcctgtcttggctttaccaaattttcaaaaaacctttgtggtggaaactgatgctagtgactatggaatcggtgcagtactatcacaggagaagcacccaattgcctatataagcaaagccctgggtcccaggaccagaggtctgtccacttatgaaaaggagtgcctagcaatgatcatggcagttgatcactggaggtcttacctgcaacatgttgagtttataatactcactgatcaccacagtctcatgcacctatcagaccaaagactccacaccccctggcaacataaggccttcacaaagttactgggtttacaatacaagatttgttacagaaaggggagtactaatgctgctgcagatgctctttctagaaaaccacagcaatctgaggaagagttcaatgctatttctcagtgtgttcctcaatggctgatggaagtttttgcagagctatgatactgatccacatgctactcagttagttgctgccctgacacttaaccctaattctaagcctcatttttcacttcagcatggagtcttgagatataagggaaatatttggataggcaacagtcctgacttgcaacttaaaatcattaatgagatgcatgccagtccagtaggagggcactctggatttccagtgacttacagaagaatcaaacaattatttgcctggaatggaatgaaatcccaaattaaggaaacacttgccaattgtcaaatttgtgctcaagcaaaaccggatagatcaaggtatccaagactattgcagcctttaccagtccctaaaggtgcttggcagactatatcattggatttcattgaagggcttcccaggtccagtcactacaattgcatcttagtagtagtggacaaattttctaaatactcccacttcatacccttgagacatcctttcactgcaattgatgtagcaaaggccttcatgagtaatgtgtacaaactccatggacttccacaaattatcatctctgacagagataaaatttttacaagccaattgtgggagcagttatttctgagatctggcactaaattacattacagttctgcttatcaccctcaatcagatggacaaacagaacgaggaaatcaatgcctggaaatatatttgaaatgctttgtccagtcagcaccttccaaatggccttcttggttgcatttagctgagtactggtataacaactcataccattcaactattgacagaactccatttgaagccctgtatggatatccacctcgccattttgggatcagcatcagggactgtgacaacagtgagttgataacttggatgcaggatagaaaattgatgcaacagttagttcaacaacatctgcatcgtgcacagcaacaaatgaaactttttgctgataagaaaagaagttttcgacagttccaggtgggtgagtgggtctatctcaagttacagccctatgtgcaaagttcagtggcccccagagcgaatcacaagctggctttcaaatattttggaccatttcaaatcctggagaagttgggtactgttgcttacaaacttcagttgccagccacaagttccattcatccagtctttcatgtatcacttttaaaggaagcaaaggggttccagccatcagtgcatacaccattatctccaacttactctgctgtccagtatcctatagcattactggatcatcgtcttaccaaaaaaggtaaccatactgttcaccaggttctaactcattggtctgacactattccagcacaagctacctgggaggatctgcatgacttgaaggccagatttcctaatgctttggcttggggacaagccaaaactcaaggggaagggattgtcagatcgtcatctgacagtgctgaggaagatactgaagaagaactgagcttggaagcagagcaggacgatgatgagaagatgcaagctgaagctgaagatgcagagcagggaggagttatggaccatcaacccgtgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacatcttcttcttgtccgtcttctgcgacgatctctactcgccggctctagtcgtcgtggccttgaccttcaaccacaccaacttcggcccggacgagcagacgaacatcaggcttgaaggcgacgcggccttcagcgccgacgtctccttcagcggcgacggtggcgggtgggttgacatcagcgccaacaggctcgacggcaacatcgaccacagccgtggcagggtgtcgtacgcccttccggtacctctctgggacgccgccaccggcgaggttgccagcttcaccaccggcttctccttcgtcatcaacccgccaaaagaggacggcggcatcaacaacaagggcgccggcatggccttcttcctcgccggcttcccgtcgaggctcccgtccgccggctcctacgcctacaacctcggcctcaccaaccagactgccgactaggtggccgccggcgacgaccggttcgtcgccatggagttcgacaccttcaacgacaccatcgtgcacgaccccgacgccacctacgaccacctcggcgtcgacgtcaactccgtcgtgtccaagaggatcttgaccttgccaagcttcaccctcgtcgggaacatgaccgccgtcgtcgagtacgacaacgtctccagcatcctggccatgaggctgcaccctcggctatgggcttagtggcccccgtcaccggccggattaca

SEQ ID NO: 8816 - DNA, 4368 bp, Oryza sativa
agcactgttcgtcgtgctcctctttgccatggtagcagtcgtcgtactcgtacgacgacgacatcagaggaagaagatgagggaggcggaggaggcgaacgacgacgacgatgacacggaaggcgatcccatcatggagatcgagaacgggatggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccggctgcgccaccgcaatctggttcagctcatcggctggttccatggccgcaacgagctcctcctcgtctacgagctcgtccccaaccgcagccttgacgtccatctctacggcaatggtaccttcctcacatggccaatgaggtaattgatttccctaattcattagaatttttgctaatgtgcaattgacaaatggccatgaactgatcagttattgggtttggatgttgcaggatcaacattgttattgggctcggatccgccctgctctacctccatgaggagtgggagcaatgtgttgtgcaccgtgacatcaagccaagcaatgtcatgctggatgaatccttcaatacgaagctaggtgacttcggcctcgcaaggctcattgaccatgctgatggggtacagacaatgacgcacccctctgggacgcccggctatattgaccccgaatgtgtgatcactggtaaagcaagtgccgaatctgatgtctacagttttggggttgttttattagaagtggtatgtgcaaggagaccaatgagtctactggatgatcaaaataatggtctcttccgactagtcgagtgggtctgggatctatacggccagggagccattcacaacgcagctgacaagcggctcaacaatgactatgatgtggttgagatggagcgtgtcattgctgtcgggctctggtgtgcgcatccagaccgatgccagcggccatcaatcagagctgctatgatggtcctccagtccagtggaccaatgccgatgctaccagccaagatgcccgtggcaacatatgcaccgccggtggcctcatcggaggggcagctctcgtcatcgacgggtatgtcatcatcaagtttgacacaaacagcaatcacacctcgttaggggcataagtttgcccacttgtggtacaaaaataatccatgccattagattataaatgcacttgccttctacttattctcatttcagattgataaactgtaaaccaaatgaattagcatgggtcagccggcggataccttgagcagggatccttttctcagggatgccgctctcggtgaaatctagctagagatttaaattgcaaacaatgtttgactggatttgaatcaatttgaacaaaattcaagaaggacatgctcattgttgatagatgtcatacgataatcggcaaaatggaggcggacaactgcatagaacattacctactaaacttaggttttatccaaatgcatccccatctctgactgacaccaaagtatgtaacctcgaacgatatagaacacatggaacatcatcacaaaaagcatatcagtaattttgtaccacaccactaaaattcagaacaagaggtcacaaaatatattttgatacatggttcgagttgctgctatcattgtcagcatttcgtcaagcaaatagatgaattggaacttccagtgctgtttccagtcttcgttaccatggaagagcgaagtctaatgtttgtttcaagacaaaaaaaaaaggtaaactcaatcagaaaaagaaaaggtagatgaaagagagtacttttatggtacattctactgctagtatatactaccagtatatgaagggtagttttggtattagggaaaaatctgaaaagggctttttggtcatttaaattagagaagtattttcaccgggattaattttccttcggttgtttggatatcatcatccgcgtgataccgcttcttctggatacatctcgcgtcgctgctccttctgcagctccgcctgcccatcgcctcactcaagaactagggttttgggtcgctggaaaagacatgagaggaaaggatgagggaaattgattcgattcccgatggcggcggcgcggcggcgctcgcaagaggaagacatcggcgacgcatgggcggccatggatcagatttgactagtgaggaaacgtgaaatcataaaattacccccacacaattagataaaaagacaaatatacccttttcaatttatactgcagaataattagaagggggatcggatgaattttcgaccgttagattaaatatactggtagtatatactagtagtagaatgtaccataaaaatcctcatgaaagaaggcacctctttcaagttgaaactcctgaaagctataaagagtaaacaagcaccaaaaatggttgctataataattggctgtaactcttttgagtaaaggccgggatgctattttattccattatctaaaaaaatatattttcacatgggaactgaaacacaacagataaatgcgcagctcaaagtcaaatgcaaacaatatgaaacaacaatggtggtgtaaacaacaggaacctcgatataataaaagtggagcatggccactgcctactgtaaacaggatagcctgcaacaatttactactacagagttattcaaatgcaattttctcaaattacggatatttatgttcgacactttggttttgacttcagaatcaaggtcatcgaaagcagaaaaaaaaaacattaacgcacaaaacattagagcacgatagtccacccaaattgtaagatttaagaaatagtcaatcattcagcaagcatgtcacccaggactgatagctctgccacttcacggagtgatcaaactaaatttggaaataaaagagttgattcttatagtgtcagcagtggttctgctgttgcaatttcctcaacaatttctgatcaaaagtgtgaaatcatagtcatgattaatatttgtaatgaataattggctttgcaaaatgatttattcgaagaattggtttgagagtatgtgtgaatgttggtgtgagtgcgtgtgactaatttgggtcaggttgtgatatctgtgcccagaaacggttgttttgtctgattgtgtgcaggtgacttgaggtcagccttggtcaatggtgaggaccgaaactatgctcagggtggagcagaggtctagtgcggtcatgataccatgtgagaaggtgactagagtcaggattcttggtgaacaacttcggtcaacggtggggatctgaaacgctccgcttttcgtgaggcgttaaaaactaactcggcaaaatcctaattgcgaaaattttcgttctctgtgtgagagtctaagttgtgccaaggatcccaatttaatcccgttgttccctctcatcgaaatcaaaaaaatcctccccctcatccaaattcctcttccgattcgagtctttgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcctttccatgacttctccttgagtttcccctgatacatccctaaaccctcgagtttgaatatcaaatttgaattcgaatccaaaccctaaatctctccaattctatccaaatcagttttctctgtaaaaatctactttacctccctatgtttttggatggaccgattctcctcccccggcccatctcccctcccagcccatcatctccccccctcgcacgtgcgttacacgcatgcgagccgagagagagccgtcgctcgctctctctgtttccctctctctctctctcgttcgatctccctctcctcggcgccgatttcccgccgtcgccgcccaaaacctccaccgccttcgcccattcccgcgcgcacctcgcgaggtggccgaccggcctgtcaccgccgacgccatgcgctgccgccttgccctcgctccatgccaaaccgaccgccgccgtcatcgtcgacgtcatccatgacccccccgccgctccacgccgcacccgtccaagagtgggagaagcagctgctctccctctccttctcctcactctccctcccctcattatggcaagggaccaagccccttttttcccttcttttccctttccc

SEQ ID NO: 8817 - DNA, 15864 bp, Oryza sativa
ccctttcccgaccactgccggcgtcaccacctctgcgccgcttgaccgaccgcgccagcccgcgctccagcggttcgatttccgccgctcgatccaccgccttcgccactcaacgcatccacgccgtcgccgctttcgcaccgcccacgaaaccgccactaccgccagccgagcacttgaccgccaaggtcagttctcccctccccaaaccgacctcgtctccgctataaaaccaagccaccccaaaccccttcctctctcgttttcactcgcctcagtcctcacacccgccgcgccattgccgccgaaccaccgtcgccgccttgttgctgctcgtcccgctctcgccgttgccgtccgttgccgaagcaccggaggagccggtgcgtgggtgacgaggagctccgggcaccacctctccctcccttcttccccggccgcgccctctcggtgccgtgccgcctcggcgtcgcgaacacctcgccgcgacaccgaccgcgccgccaatgctgcctcctcttcgattggtgagctccccaccataatcctcctcctgccgcgcgatgcgccgcgcccgccgccgctcgccatagctcgccacgcgctcttgctctgtcccggaggccgcctctcgtcgccagccaatctcggtgccgctccgtccaatccgacgccggaaacggattccttgaaccccggagatgctcccacccctttgaatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttcgctcttctcgcgcgcggccacgtcggcgtgctggcgagcttggtcgccgccgccagccaccgtcatacctcccctctcaaatccgtgccgttaaacggattccccctgacctcctctagctgccggcggtggccgctcgctccggttcgccgtcgctcgccggaacgcctcgcgcgtcgtcggccgtccgatcccgggcacctcctcctcctcctccttccctttcgcccctgcccgcgtggccgaccacgtggcagccacctcagccccgggcccgcttgactgggtcaagtcgcgcccagtcagcctcctccctccgtcttccctcccatgcgcgcggtccacggcaagccgtgcggctgcacgtgggcccgccgccatccgtccacccggcgcgccgcgcccgaactgcgcgcatccgaaaccctagcgcccgcctccgcgtgcaccctccccaccgtgaacccaaccaccgccatctgggtcccgcgcggtggaccgcgcccaccccgacgggcctccctctctccccgcgcgccctcatgggccgcctcctcgcgcccgcgccggcccatttggtttggccgagccgcgttagcctttgggccgcaccaatgccaccgaaacaagtctaatatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccattccacttccaataattccgtaaattgagctctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccatttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggctcgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtttttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgggagccgagaagtaatgaactgacccgggaggtcggtacattaccaaatgagctgttgaaaaacatctcttaaagtcgaatcgagacgcaagtctcttttcgtcccaaacttagaaagaaataaatcacttagtgatttcaaaatgatttcaaacaaaagatttgcaaaacaaccttgcctctctgccaagcttgcattaaacacctaagttcccgtgacttgctgagtacgaaagtactcacccttgctctatataaatatatatatatagttcctccgccctgaagggaagataaagtgaagtgaagatttgggtttcgtcctggttcccagccgtcgcctgtggtgttgggtgttagaccgttggttccgctgctgctgctgctgttggtgttttcctcgtccgcgtcgtcggttgtattctcgggctgtctgagctgcaacctaagttaaggtaaataagtcctctatttattttaaggattgctatgattcatatttgtcaccatgggtaccagcactatgtcctgggactggtaccgagatcgcggtttcgtaggaagcggttcgcgccgttttccctacgacacgctcctgtcaggtgccgttgtacggcggtatcagattggggtgtgacaggatcgggactaaactcagggaggagttgaggtccagacagtcaaggataccgggtgacgaagttggatacgagatggcacacagtgaatggatatcgtgtgggagagatcttcgcaacgggcttcacgagatatgcgtgcaagtaccggtgttggcgaaggagattggagtgagaaattgaggaagagtatatggtgatatagtacacgtggtactgtagcatgcatatgtgtggtattgatcgatgcatgcaagtgtactgtagtggttggcagtacatggatgcatgtatgcatatacatgtgtgttggctcggtgagtccaaggcaggagcggcgctaaggcaggagaccgaggccgaccgggacttcgtatgagacggacatgtgtccatgtcgggtttgctatgacacggattgactgtagtcggttgtgaggctgcaggctttaggagactaatttggatagagtcatagtttgacgagtggtactcctatttcgagtaggagaattttcatgtataaatagagaggaagcgtgaggcttcccggtatcggttttaggaagctgagtttgagagattagatagggtttcgtgagaaacttttgaggggtgctgtggctgcaccttgtgaacaatatacttaagcaataaagatcatattcaatcatcaaggcattaacgatctattccggtttcgtaagttttacgtttatatttggttttggtattaacttgtgattgttcattttgctgcgattttgttcaagttaattcatccaaaacttttctaatacttcaaagatcagatctggaaagtttcgttgattggttctatttgatgatattttgtcacgtgcaaggaaaaattgcagtggccaaagcaagcaaataatgtgatccctatatgggatgttcagattgcatgcagagcagtacgagctgtgagcagcaaaccacaagagatcggccgggcagctggttgtatccatgcatgcaagcccgcacatacgcacgcatgggcttcaattacacctgcgtacactcgcatacgtgaccgtattttctagcaatacggccgcgtatatacatggaaaaacaaggagatgcgaagctacggtgtattttacgctatacggttaagttagctcatgcttgcccggatcaacaaattaaatttatgaagagataaaatttatctgaatgaattcaacacaatccttgcaagccacgcgcatacgaaagacggccttccgccggactctcaccggcccagcaacggaagagtggcaaggaatatcggaaaccgccatgacgcgctccggcggatgcgcacacgtacgagagttaaattctatcctgtaggcccatcagaaattaacagaaccaatatttgacgtcaggcggatcgaagagataagattaacaaaccgatcgattgatcaagtatatccgcacttctccaccgacctcaggcccctatataaggcgtcgacgtactctcggcagcctggaggccatggacgccgatcaatccataaacacccatcgacacacatgatcatccatctgtccatctcctcctggaagacaactatccaccggcgacctagctatccatcgaccggcaacgagcatcaagatgtgatctcggcggccggcgacctcgtccacagcacccctgtgtccggcaagaggcgcacatgaggaggaacaacgacatcttccttgggcagatcaaacgctgcaggagatcgtactcaaaccttcaggaggagagcaagtctctgtcgctttcttttctctcgtttcaggtgggagatgagcctgtacgcgacgccgccggggttatcgtggctgccatgactatttctgaaccatctccgctgccatcgagactcatccgcccgccgtcatccacattcatcaacatctccatctcatctcagatggactcatccattcatctacaaatcattcaagaagcgacaccaaagaaagtcttaatggccactacaggtaaagctaatttagattggttcctttcttttggttccagtgcctacgtgcatgcatggaggacggccgggtgtgctgccatcgccggagtcgtcgcgtagaccaatctgttgacgctgatcgcaagcctccgtcaagatcgatgccgctcgtcctcaagctctgatgttcgagctgccggtgacgatgaccctgctcattgctgcgatctcgcctagatgttggatgacgttgccttgccgaccgctgcctccactcggcgacgccgtggatgtctgctggccatcttcgacgatgctgccaccttcctcacactcatcgtcaaggcgctcgaggagaaggccggtcggagtgccgctacccggcactgcgacaccaccaacacccatctgccggagaagaccatcgtgatgccactccgcccgacgcgacgcgccggagatcgtcggagcagccgcggatgctgcctagtcacgctgatccagaagctcttgttgagaacaacacaacaacacggacgccgctgagctgcccgcgtccgtgaacaacatatcgtcatcacgccggtggccgcccacgccgtcctgatagagcagcgggaggccatctcgtccaccttattggcaacgcacagacgctcgccatccccgtcaagctgctggtgacactgtccgccgagtgccaccctgtcaaaggctgtcgttgtaccgacgccaagctctaaggacgccgccattgtgatctctactgtgtgaggacgtctcaccgagactcaggcgacgccttcacgctcgtcgcggtttcttcggtcaccatcaacgtctactcaatcatcttcgacggtgctaccaccttcctcacgctcatcatgaagccactcgaggagatcgccattcggagtgctgctgcccggtgcctgcacgccgtcttgccggagcgtaccacggatcgtcggagcacccgcggatcgacgttgccgagctgtcctgatccaggaggtctggacggagccgtcggggacgcccgccgagctgctcttgcacttaagctcgttacaattatcatgcaactgaggcactgccatgtagtgttcgttcttgccgatcaaacactgtcacactgcctgccggagcacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtataagggacatgacgggtcaggaggtgcccagccatgtttaatccggttgccgtctacacctactttcttcgtcaattcttcattactttgatcacatctagtcagaaggtgcccatccatgtttattcggctcttgtgtgcaccaactgacttcaccaactcatcttacctttaacaccattccgatgttgttgctatgacgtcgagccgtccaagctaggcgattccatgcgtgtcttcttcaaacaatctacaccgacacgtcgttcaagaccgacgaggctagacgacgagggtgcgcgaagccgacgctaaggctatgtcaccaacactggcgcacggaccgacgaggccgtggatgcgttgccggcgcccacatatatatcacacatcttcaccaacattcatcatccatggagaacgtgaagcaaagacgatgagacgaccacaagcagcttaatcgggggttctcctgcaggcctagacctgcggaggtaattaaccaggagcttctcgaggccctaggaaccagaagacaacatcgctgatgtcagatctgtccaacgacaggcaatggcacgtgtattttctattatacatggaaactgtatcttgataattcaattaataaagatcatgtgtttttgtgtctcttttatgtttattttacatttgtgtatttaggtacactggcacgtccgcacttattttctctctaaacatagagggacatattcgtatttttctaccctaaacaggttcttgttagatttgaatttgcttaagttttaggttttgttcagatttgctgaaattttgatagagctgattttcaagggtattttctcttaaaccgtttattagtttacaaatccctccggtggaattgttctttaggttgtttagtgtcaagtttgcaactcgatccaacggttggtttaagagaaatcgtgtttttaccgaagcgctgtcgtgttgttttcaggctgacggttagaccgcgagaggaccagcggtcagaccggtcaagcttcggtcagaccgaccctagtaggtcggatagaccgccaaacgtgtgttccattggcttttgtgggatgtgttttgatctattaagattcgattatttgacttccgttgacgtaatctaacattcacccctctctggtaggcttggttacttatgtttgattctaaaaaagcaatccgttggaccctatccttacaaaagaaagagcagatctggaaacataatatcacaacacagtagcgtgtaatccattctctttcacatttgtccttagccaggatcagatgcgcttttttaaacctatcaggaagatgattgcgaaaacagtgatgagaatgaattttgacagcaacagctccagttatttatacattccaaatctaaagttacaatagtttcagcaatttttcatccccaaaagtccctgcataaccaattctgaatgtccaagttagttattcaacactactgcagaagtgcagaattgagtcaccctaaagtgaggttgaagcccttaaattcctttattgaaaggggaataaaaaacacgccaaggcaataaatatgaagtaattctcacatagacgtcacaacaatccccatccagccatccttgaattctccatttgcagatagactagaacagctagcgcatgagagtatgtgttcaatggttatggttttgtgggtaaatacaaacatataggcaaagggataaatatgctgttctaaatttgtaaattagagtatcatcaacaaaaaaagcaatgcaatgatctccagggctaacaaacttcatcagacagaggacaagagaaatttaacacaaatcaattatctcaggtcaaagaaggcgatttcaacattagacaagacaaaaggaaagcaatactactgtaaccaacaaccactaaggctatgtacatcctttgggtgcagagtaaggctgggaacatgatcctctgacgtagagcaatctaatctacgtcagagggacgtccgatgccgctacactgctcgatcgccatccaacggaggtaaacaagcatcctcttctgtgagcacggcagccgcacccgagcagcaccaccgctgcgcgcctgcgcccacgccgaggatgccacactcgtgccgcctccacacggcctcaccccgggcgccccatgcgccccatgcgcccccgcacggctgtcgccccgtacggcgatgtgccgtgtgtcgccgcacaatagccgtcagccgcgtcccgcacggcgctgcacggccgtagggccgcaccgcccgaacagccgccgcatcggccacccacgtcgtcgcgctcacgccgcaccgcctgcttcgacccgaccgctgccacgccgcgccgccctggccgcgcgccgccatggccgcgcgccgccatggccgcctccgcgccctgaccgtcctggccacagcagagaagagtgagattcagcagtgctccatctgagcgtgagctcaaggaggcagctaggctgccatggcccatggctccgccagaagcgctggccccaacgacaggaggtcggtgcaggcgaaccacacactcaatgcggacggcaccgccgcaggatgctgcgctgcgggcctgcgacaccgttggtgaagaactcggcggcatatgacgagagaagcggccggccgggagcgagccttccattttcgtgggttgattttggtcggcgtgggctgaaaagaagccagtaggtccgctgtgcttgtttacctccgttggatggcgatcgagcggcatagtggcatcggacgtccctctgacgtagattgctctacgtcagaggatcctattccgtaaggctatgtacatcctttaggtgcagaggccggtttaatccattatctaaaaaaaaccaaacaaccactagcagttttcacattgagtacagaggtaaaggaatgcagagccctgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctcctagggtttcttcaccgccggcgagtgctccagctcccagccctgcgcgtcctcctcgccggacgctgccggtgacgtctgggccaagctaggtgcggccaccctcctcctccccccttcctttttcttgggtttcttccgcctcacgggttcttgattcttgaccttttcgttggtcttgggcccttggccattgcttgcacagcaggtctgtagtgccctccgattccgtgttcccggaggtggagctggccgaggacgacgccgtggtgtgctcccgggtcaccccggatggcggcggggaggtggtcgcgtggtgcaagattaggcgcggcggcgacgtgtcggcggcgacgatttggaatctgaggtatctgttgtgattggtggttggtttatccccttttcgctgctttgctcttctggactgtacatcgtaggcaagatgcgctttttttttttttgcaatcctgttttattggattgggggtacaaatgccattcattgatgatgcatgtttgggcgaaggctataaaatgcagaaaagttcttactgattgcgatggaatgcgagttgttgtcgtttggattatgtgaattgttgcggtgtcgcactatccaaaattaaagaaaggtttcctgtggataaaaaagattcaaatttcctaatgattccaaagtgcctcattttcttatccataagaccataataactcagtttccaaacttttgaacctgattgattttgagtcgtgctgatctgaaatcgatagatgtgagcccctgaagacagggaataggcagagtggccatgggtgagttttttcttttttagggggtggagggaactgtgttgcaaccttccgttaatccttttatcaaattctcgctgatgttagatgcctgtcttgtcatccttgtaatgtatgtttcattcgaccgctatcttacgttaacattatccatgtgccattgagaaagcttggatgcaattattgtcgatggaagagttatccagcaagaagcagttgacatcaaaccggggagtgaaattgttccagggccccagaaagatggtgagacaattatgtattttgagtttggcattttgtgcatagattggttgttatgtttatttagtggtcttgtattttttttaaatagactattttattcctttatgaagccaaatgagtgtttacacatgactctgaatatatgtactcattgagtcatttggaatgtttattgtttcctagacctttctgtttagaaagtgaaacttctatggttgcatgtttgtaattgtgcttctgaaaaatttaccaaattacaaatggttttccttttgtgatttcgttatgttggacaggtgaactgtaccactatgtaatgcatttatgctatccattttcttgcagggtatctgttgtacacctttgatataactggcctgaatgactaggacaaaaataatatcaaggtattttgttgaaatgaatgttgatcaacagcaataacctgggtgcataaaagtcactaacttctatttaaatgacgatgtcagattgtgctaggtattgagaatgcaaagtgcagcatatgcttaaatttgtgggatgatgttgttactgttgcttcatgcctccacaacttctggtacttttgccaattttcctagctacttttgatttatctcaaaattctgattggtgcttattcctgtattccttttaagcaatggctgcttctttgagtggttaagaaggtcttcagctaattcgcgtgataaaagttagagtgctgcctgtccacaatgtaggacgacagtgcaattagttggtgggaatcacttcctacataatattgaagaggtgtgatagttgggtgtgatgacttaactcctcaatactgtttaagtgctacatattgtacagctgagatgtttatttatagttctgcttttgtaggctatactgtaagttttttcatcgctacagcggtctgatgaggagattgcattgttggagtcatatgccccggtcaagacaaatattgtgagttcaaaatcttactaagaaattgttgattcccaccattttctcaatggattgtatcaagtgttgtgccagtctcatatttgccagcactgatatttgtccctgttatctgccataaaatcgaatattgttttaaaatcatcatctttttttcaacttgtaaaccttattttttttcctacaaactttgcccatgttactgtattactgtttaatcaacagctaatcaaggccatctacaccatccgatgtaccacgcggcaacgatccgtcccctcttctgcttctaccctcccgtgagctcgtggttgaaagttacatttgtcatgaatttggattatcattctattttgaagatatccttgattgataaatgcactgccatgtttcagataacattttattctcttatttcccccaattttccttccatttggcaattctcgtggtgttggtttgtctgtactgcactttgacacattatatttaatttacaagacttgccaggtgcctaggattgtctttagtattcaacttttgacaagataatagtggatgaaatgaaaatctgtttacaattagtactggcctcttaataaactaattagtaaaacaaaattccccaaatggtgggctcattccgttagtcgggtacttataattgtagaatttcctttcagtgcaggttgatctagaatcatggttctctctctaagtcctattttgcttatcgaatacttgcctcttaataaactaattagtaaaagaaaattccccaaatggtgggctgattccgttagtcgggtacttataatggcagaatttcctttcagtgcagtttgatctagaatcatggttctctctataggtcctattttgcttgtcgatgatattgttaaatgttgccatggaatgttagcatctgatacatgggcttctcatctatagacatgttgtgcttgtcattacctctaaccatatcatgttatttaatttatatcacatgattgaaaatgcattttagcatgaatgactcataacgatttagaattttctaacttacaattagcaaaccatggcagcacaatatggtatttcaaattttcatttagttgcactacttgagaatgagtttagtggtttggttggattgtctaagtgcaaatgttgctgtcatttgtgggaatcaggaaaatataaaatgccatatataatatcctctatattttagttcatagagagtatagtttccattcactcccaaagaaaatatgggtataatccggagcaaataatctggaagcagatatgaatatggatattttttgctggatatgaatacaaatactatgacgttggcgaaagggcttgtagcctagtggttacaagagcatcagtagcatctgaggtcctgggttcgactccccatgggagcgaattttccagaatttaacggcgttgtgctttcagtagtaggcgacgtacccgtcgacagcgaggctcctgtgtagtcttcgaagatgctcacaggggtagggtttgcgtgcgtgtgtttataggggtaattctaaaaaaaaaagaaaagaaaatactatgacgttgtttccagtggatggggatacaaataaagatgcatgcttattgtttttcaaccacatttgcttaagcaatgattggtctattccagtattactattgttggcccctttggaacatataattgatatgccttttgcatgactcttctcaactaaaatgcattagattgcatcatgtctgtggttcacaatatgttacatatgttatctggaaagaatataattaaatttgctacagttctgtgctattgttatgttatttttgcattgttgcatgtggtgtttgggatccaactaaaactaagttggttattttattatgtaatctcaaccgatatacggaatttatatgttgtgtatattcatggttgttaaattgctacattatgttcagtatatatacagttttttttggcttcaattttatgccgtcctttccagctttcccgccgcaccgcgcggggcaccctctagttatatttgttctctgcacttctgctaggctgcttagctaccactagccttttactacccagctgcagataaactaa

SEQ ID NO: 8818 - DNA, 4649 bp, Oryza sativa
agcgcttctattcctaattaattacttgagcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatagagtagtactcctctatcagaatgtcagggtgcagtcagaaccccttgaatttggacgctacaactagctactacttaattaccgatcgatttggggcaaaaacaactactgtttgccagatcagagagatggtcatccaccatggtgaagaactagcttaacagcggcacaagcacgacctcgtccaagaacccgtgtctagctcgtgtggccggccagccggtcaccatggccgtgcaaatcatatatacaagtcatcgcttgtacaaagttttcattgtttgattaaacaaatctgtacaggacatggtgatacagctggattactcatgatgtacttaaaaaccaacttgcttcaagattgcccatggaacataacatcaaatcacatgccttactttacatttattacctatgaaagtaccttcttgcaatgtttatcagagcataagcccatgttcacatttttacctttgaagtacctccttgtaatgtttatggtagagaaagatccatactatcaaagataagacatatatttttacgtagaaacaatataaatacataattataagtgattgaatttaacatcacatatgctttaaatttctaattaccaggctaattttgcacactccaacatgtccatacatttttcttccaaaacaacttcatgcaggtagcaccctgaactacttctattctcaccctgatcagcactgagatggcctcaggaagtcaggaagcagtgccggcagtagatagggaagccaaacctgccatttgaaattccctggaacttaaggagacagctagtgcacatgaattgcatccaataattaatcagctactacaaaacaatgtgagaattgaagtagaagtacgagaaatataagttaatgaaaggaaactaagtactgtctcacgacatgattcaagataaataagggggataagaaaatcgcaaagaaaaatcggtttggaataaaagattgatttagtagtagcattttgtcaaaacatctttgggcaataggagcatcaccgatttgttatctttctcttttctactgttgcaaatccaacaaagaattgtgaaagcaattataattattttttttttaaaaaaaagatggcgtagagttttctcaaatttttacaagctttacttcacaaagcacatgacttatcagctatagccagaagatcgcatgattgaaactgatttattctagagagtaataggcaatcatagaaccatccatgacatgcaatcggcaaccaacagatgatggtctatcactcctccatatgttcatctccagcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggtcaagctttaaaccaccagtgttatagtactacctatagctaagatataggtatacttcaatagtcctaattaaacttaattcggtaaaaatctacatagaaaaggttgtgtgctaccatctacggaatgtggaaaatcatttagatttcgatacaatggagttctcaagctgctaaataaatgaataaatttgttcaacatatttttcctaaaaaaatgatgcatagagatgaagtgctgattaaattaccaaaaagttggattgtggtcatcactttaaatccaaaattcataatgacttgcttaaatatagttaaaaatcgaatgtcagtatataattaattgattttgttggaagcctttcatgttcctaggaataacgttaaacattatttagtagagtgtgaaaatcatcatttcagctctaatctgattcttgggagtagcatgtgcgtgagtccaaatttcttagtggcaagcacatggcatgttcatttgtatacatatccgcaccagaaaatacatataattgcccacaaattcaaactgtatgtaccatcgctagctgatgagctcacctcgttaacatgtcaatctgcatatcaggcaaataatctacgtcgttataagaaacaagaataaatttatattataagtgacagtaatgagtgcagcttggaaggaggacaggcaggccatagagctggacgcatacttcatcaaacatgtattaattgggcgtttagattttgtttaaagtccaaagctgaattcaccacgcacagcaaaatataaagatcccaaatgttagttctgttgagggtgttcaattcttcggttccacattgcagaagcttagagataataaaagtgaagattcaatcttagacatgatcaaccaaggataacacaatgaatatcaataaaaaatgtattattgtacaaatatgcatgtacaggctccggcctagagatgacaaccagggtttcatttaccgccggggccgcggttatcgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgcaaccctgatgacaacacacctgcttatgatccattcatgcagcaatatgcagtgatagaaaaatgtaattttcgaccatgaacatatatatttattactaaataactcttctctctgctacatgatgcctcatactgagcctagtgttggaatgtgcacacatatgggcattacttcgaacaagaggaggacatacggagaggcgagattgaattctcattcagtctgctccacctacttgcagttcctcttaattgtttgtggttctaggaaaattagggaaaagggggcaagaagaacatgagacacatggacaaaatataaatcaagcagcattttcttttttttttaaaaaaaagaaaagagagaagaaaagggagaaccttttacagggacaagagcaagaagccgacgtttgaggcaatggatggggtcaatctgttggcaccggattagtgagttgcatactcgcattaacgttcaaccgtagttgttgtacgatacgatgggccttcatccctgcagttgacacccttgtctctgactgccggcgccggcacgacgtacggcatgaatggtccatctggcttatgcttacctttccaaaagagaaaaaaaaaacaaaagagttgagtttattttatgtatcgtcccacgcagaacaaacttattcacaacggggtttcatcaagcaccttgaccttgtacaggaataaataaatgacgaatgaatacaaatgaagttgtcggctgaggaataaagctgcagagttagaccctagaagcttcaatctcctaagatggagaggaggcaaagccatgataaaggaagatgaaaatcatctggctggaggagcagatgttgagacttgaggccaaggtcagaaatctcggcgaatggtggaggccgtggcaacgtgaaacactgtggacaaccacgccaaatctagagatggaagtaacaaatactctctccgtccctaaatatttgacaccgttgatttttttagcacatgtttgaccgttcgtcttattcaataacttttgtgaaatatgtaaaactatatgtatacataaaagtatatttaacaatgaatcaaatgatagaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtaaaattagggattagagattagatctgttcccttttgtgattaggaatttagattgtttatttacttttctagaaataaaaagaaaaaaaagagatcggg

SEQ ID NO: 8819 - DNA, 14840 bp, Oryza sativa
gaagatctgcacgccctgttgacgtgccgcctaatttagcctgtaatatggttcatctgcaaaatatatattaaatttgcctatctctcattttatattatttgtcattgtagcaaaatttcacatcaaactaggagatgtgcaaattacactgctatgcttattaactacattatagttttcaaaagcaatattaactttgattaacagttatacatggcattgataaaatgtgaagatagaataccgcgatctaaaataataatttcaaatgtgagaatgaccagtaatattttgaaacatacagagtaatatattaatggaatttaattttatgtttccttagaattatgagaaaaaccaaattaagattgtaattaatgatgaccaatagtttggcaaatagttagatatttccatattggaaagtacgaattaccccccgaactattgcggtagtacgatttacccccaaactataataccagacatttaacaccccaaactctcaaaactggataaattataaccctaaatcgattcgaactggttttcagcctacgtggcacactcgtagcaatacagtcagcaaaaacaacggtagggcccacctttcagcgcttgttgtttctctccttctctgcccctctctctcttggtgaacagaaggcggctgcgagcggcgggtaaggagccgaggccggcggtgggcgggggtggaggcggctgtgggcggcgggtgaggagccgaggacgcggcgtactagacgtcagggtagcgctcggtcagctctgatggcagcggcggcggagagggcgagggcggcgggacgtggagcgagacggtggcaggatcctccttcccaccgtccaggcgctcaagcttcaagcttcagttgctagcagggttgcatttaccgcggtaaaccgcgcggttaccgcggttaccgcgcttaccgcgggggtacggtaaggggtaaaccgcggtaaccgcgtcaaattcaaataaatttaaaaaataatttgaatttttgataaattttgtacggtttgtcgcggtttgtcacggttaccgcggttactgtgcggtaaccgtgcttaccgccggggcgcggtaaccgcggccccggcggtaaatgaaaccctggttgctagctagcctgttacattgctcctcgttgcaaattgcaaacaggcgatggctgatctgatgcgtatgatggcaacgggatcatatcactgtagatgatccgaaaaccaatagtttctctttgtggattttgttggcaactttttgtgacaagtcgacaagcacgatcgcaacacctaaacgccttgcggtgatatggagtcgccaaccacctcgatctagccaaagggccaaatcaagatgggttttgtagaaaagcaactaaaccggctagcagagccgatttagagatcaaaatcagcctctaggccgatttagatcgatatgaggataactacccgtctcgtgggcaaaatggaaggttttcaggacaaacctaaaaagaggtgtcgcactctcgcagcggcggcggacggtttacggcgcaaaccgacaaagatagactaaactagagtaaaatagaaaaacatagtaaaagaacgattcaagtagattgtatttggggggttttacaatgaaccggccttgtcgcttaaataggggttggtcttgccctctacaggcccttctccatgtccaactcgggatagaaaccaaaggaaacacgaaacatgccttcccgagcaaggaaacccgagacccgacgaaaacagactcggactcggaccctgccggtctgaccgcccacatacctgcggtcagaccggccctactagccggtcagaccgcccacacacctgtggtctgaccggccctgtgaaggaaacccgtcactttccaaactttggcaattttcccctatttcgtctataggtgtcaaatttgggtgtaaacagatttcagattcactagcatcaacttttgccctaatttcctcgctccttttgacttgaactgtcttcttaatttatcggagacgttcggttctcagctggatgagagtgaaactgatcaaattacatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaacttaggtgtattttgtcggaacactactactaatagtctcagtttacttgtagtcaactactgttggttgtagcttggtggcatactctacctacctatcagttgttgatgttactcgcggagtatcgttctttatctttggtgctagatgacatgcatgcatgctcattggatatcagctgattcttatattaggtacattgtgcatgaaatgtcttgtaagcaatatgacttattagcgatcggtggatagtggtttgtatgtagaactcgtatacgtggggattagtgaggacatacgattccacatgtggaggggagtatcgtggtgggtatacctgattttttttctttgagatggagatctaatgggtaaaattagtaggtccaccgatttttttttcctaatttattagaacaccatgtggcggtttacgagcgtttgtaggagaccacatggcggcttgggagtttttgtaggaagttaatttaatgaacttttagtatatgatagatagatatagatgtacgtttacaccaggtcacattttctctgctgtttcctaattggttttactttcatgcctagttaattaattatattagctatagggttaaaccaatctgcatgagcacacagacagtaaagtggaggaggggattagctaacagttgcttgcacaagcaggtggacagaaagacatgcattcgctttaatcacactgctctgaatgtgacatttctgtcatgccgctcatgcatgattagtggccggagtaggagtacacgttactagtggaaggagaaaatcttgttgtcggaggctgccgcgaacgggtcatgtgcacacttaattaccgtgtagtcacgtccaaattccaaaaacatagtaagacgttgaagaggatattgagcaaaattcgcatacattatattaattattatactcacgtcacatgggctggagcctatttatacggaggaggagcaaaggatcggatgaaatcgaccaagatgacgaagatagcaggtgttcttattttagttcttgttatctgtccaactattacttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatgatagaaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtttttaagtaaagttagggattagagactagatctgttcccttttgtgattaggaatttagattgtttatttacttttttagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatatttaaataaatcaacggcgtcaaatatttacctcgccaactgccccgaggcttcctccattgtcacggttcaaatcaatagcagccacaaccttccaatttagcgaatgacgagtgaaacgacggccaacaggcaatgtaacagacagagcggccaccggtcgactccaccacaccagcacacgctctcgtgaaaccctaggctcctctcccgcaggccgcagccatgtcacagcactctgttgtctccatgctcatggccacgagtggccttccctgagaccatgccttcacacgacggtggaagagatgacctggccactacttaggggaggatgtgaggcgcatcatggtccggtgttattgctcggtgcgtggggatagcgcggcgcacatccgctcggctggatggggaatcggtgatttcactgtcgcattgttatcacaaagatatctacatccgtttctagccgttggatgaatagatcgaatggctgataaaagagataggaagttttgtgtaggttctcctaggtgcatctagcaaagagaataactcctcctttttatatatattagtaaagatgagtatgtaggtttattagactaacatcataccacttaatatcactgctagacaaatgatctttagtcccgagttgcaaaccgacaccacaaatctaggatatctttagtctccgttggtgttactaaccgagactaaatattatttttttttccttttttcattgttttttttgctgcttgcatattgatcacagatccagaaatcatcacaaaaacagatccacaaaaatcatcgctaatccacaaatcatcagtgatccagatccccaaaaatcatcacaaattatactaccatcacaaatcaaaacagatccgcggacttcgagcactacgactcccacctcagcctcctcctccaccacaacaactgctgccacacccaattccacccgtcaccacacctcggcagctggatcgtcgccgtcggcgctcctctcccgcgaggcagaggcggatcccagcgacgactgtccgcgcgcctaggtcgtcacgcaccgcgacggcgagtgccgccgcctaccccttgtgccaccaccaccccgctcttgccgccgccgctgcagcctcccccctcgtgccaccgtcaccgccttcccccttgtgctgccgccgccgcctccccctccgccggatccagtggaggggagggctctgccaacgcctatcggtcccggctacgatcggagaggaggtgtaggagatcggagagaggaggaaaaggagagatagaaagagagaaagagaaagggttagtggatgagggggagaaagaaataaggacgacgacgcgcgctgctctctccctccccatgtggctcgactgtttttttaatttttcgtcctggttggtttagacaaccgggactaaagatagtgggaggcttgacaatttttgaaccgggacataaaaaatgatctctagtcctgtttgatgttaccaactggaactaaatatcaaaaaattctgttgggcttttgaaccgggactaaacatattctttagtctcggttcctattcgaatcggggctaatgtgatttttgtcatccggacaaatatcaattctccggtagtgtatattgatgtattaaaatggaaggggttggatattggctaccagaaattatttttctagctaggagaaaaagagctgcgatatctaatccattttttcgaccactaaagcatctagaaaccctgcttcactataccgaacaattcttatcaatgggaaagtctgtaatagttatccaagagttctgtgtagaagggctatcatgcaacggatcaaacgtgtggatagcacaccatggcaccacggagatcgatatccacttctgtcattccatgtaaacgacagctccttctcccctttctagagttggttcgatttggagaaggggattgaaaaaaaaaagagtaaattgcatcgccgtacatgaacttgttaggtggtagcaatctagtgtacgaacttataaaacgcttgttctagtgcatgaacttgtcaggtgcgtgtggaggaaggcgaaaagaacactacatggataatcttattgattttgtgattgtagaaaaagattaaaaaaaagagcaatgatataagggtgggaaagatatgaaatatcatcacttccttgatgaaggataaagtagtgatcaaatttataaataattgcagtcttatgcaaacgcactatacatatgcacgtcacaccctaatcaatatcagcttcgtaagattaatattgccaagctattttggctctcgtttgcacgaaactatacaagttcgtgtaccgaaacgagcattttacaagtgatgaggcatcactagattgtctgtacgcatggtttggtataacacacatgcacgtatgcatgtgcctggcagtaggggtgaaaacagtatggaaatttcctagaattctggctaccgtgtccggtttgcaccgaccatttcagtcggtattggtaattgtcggtattggaaatataaacggtaatctcttccggaaatggtagcggaaatgagatgggttttttccgaccgttttgttggtaaccttttttgatcggtaatttccgtcaaatttccgacaaaattccgaagaaggaagcttgggcggctgagcctggctaccaggagcagcccattaggccggaagaaaaaccctagggaatgggcgtcaaccagcgtgtcgcttctcatcctctccctgtctcgtgactctcgtatagctctccgccgcctctacctccgccgaccgccgaccgcccatcgtcgcaaccacttgtcctcgccgccacgccgccgcttgctagtcctagccgtcgcatcctcgcgcctcactgtgtcccttgccggagaagcatgatggcacctgccgaacaaaaatgccgcacccatctgctgtcgtctatcatatccatggcatgtggccgttattaaactatagtctcgtcaacttatcgatattgaagtatcgttgaactttgtttatattgtttgttgaccttattgtcaactcattaatcatcatataacagtgttatgtggcagcgtgatgatgcaagggtgaaattataaggtcatcttcatgcatagttaaatgtgggatgatgtcacagttcgctgtttacgacatgacttttcgacttccgactgatatcggtagattcccgttccggcggttctgtttccaatttacaatattgtgcaatgtcaatctggaatggatatcaaactgtcccaatttcaagaattacatagtagttttagacggtgcataatcacatcacacatatttttagagaaggtaaatctggacagtacatattatcaaaaaaattcgaacgattgttacaacaatctctaactcattcgcagtagtcggcaatgaaaataaacgacaaaccaaggttacaaatcagagcacggagacaagcaatttcttaccccacgactaactcatgccagttacaatctatcgattccaccttgttcctatctcatatcggggacgacggcatccggaggctgccctcggcgtcagcgagaaggggtgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacagtagcccctgagaccttcgcagtcgaaaagataatcttctctcgaaccatattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaaggaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcagcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctaaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggttggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactaatcatagccaccaagcactgggagtcggcctaagcacttcccaaacatgcatatgagtgtcatgagttcgtcattaatggaacaaagtttcacggatcggagtttactactcgggtacttttgcaattattaagagcagaaaataaatttatctcatctctatgcttttgatttattccgaatagtacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaaatatcatataaagaataaaataaatgatgacttagctttgtaatattccccttggtgatggcagaagtggccaatgtgggaacaaagtcgtccatcaataacaatgaagacaccagttggcggcgacgaaggcggtcgacggtgaaagcgaagatgcccactaatggcggcatgataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtagacggaggcaccaatcggcggcgacggaggcaggccggcggtgaagttgtagacgcccaacacggcggcataataggccagccgtgtaggcggaggcaccactcggcggcgacggaggcaggccggcggtgaagtcgtagacgcccaacagcggcggcataataataggccagctgtgtaggcggaggcaccactcggcggcgacggaggcaggccggtggtgaagtcgtagacgcctaacagcggcggcataataggccagccgtgtaggcggaggcaccactcggcggcgacggaggcaggccggcggtgaagtcgtagacgcccaacagcggcggcataataggccagccgtgtaggcagagacaccagtcggcggcggcggaggcaagccggtcggtgaagacgtagacgcccaacaacggcggcttgatatgccagctgtatgttgatctgctgaatcaactcatgcatgcatgaaatttctccgagcaagctataggcggctgctcccatgtgcccgtggtggcgtggtggccgcaacgcatccgtcggcgctgctcccgactgaagatttgagccatcgagattaatctcgccgtttcttctgtagtcgattccatcacacttttcgatgggtaattcgacgcagcccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacaaggggactgcagcagcggcggcggggggtggaacggcgatggcagcaccgccgtgagctatagctgggtgagggcgagagggggatcgcgacaggtggaatggcgatgctgacaagatcgatctagggcaccgccgtgagcaagagccggcgcatctcgatcccctttgtctcactgatctaaagaatgacccaggggcacattggtcacaacactcgcgattcggtgtgttaatccggtgaaattggaaaaacggcgaagcagcgtgttgtgcgagcgtggcgatagcattttagcgaaacaacttggcggaatggcattacagcgaaacccatccttacatgtggctaaatgtcaattttctcggacaatgcaccatgaaaaaagaaaagaaaagccattggttcattcactcgctgtttgttgatgctttttctcttggccaacaaaaatcacctaacgatttgcggtgtaatcgacggtgttgtcaatatcgatagatcaaaa

SEQ ID NO: 8820 - DNA, 4135 bp, Oryza sativa
aagggcaaaagaaagtccgattctgtgaaaaagggcgacaaaaaaaccgccccaaaaaaacggacgagcgagaaaaaaaaccgtaaatgtccgatcccaaaaaaagggcgaaaaaataatccgattccatgttaaaaaagcgaaaaaaaatctctatctctatctctgtctctactacttaaaaaataataaaagatgtttccttcgtctgtaaaaaaaaaagctaaaaaaaaaggtccgactcctatccgattccctctcagaaacaaaaaaaaagtccgactatagatccgattcttaatctataccgtgatatctcacatatcttggtgaaacaaaatgatgtgccggattagagatctgtttaataaaacagaacctacaggtcgagagcattccatttttatatgattttaatttttgggtttgtacttttgcttttgagtccctataatttttatatttatatttgagttcctataatcttgcaataaggtacttggggccgtttttgttaaaaataataataaaagagagaacaaaagcagaaaggtgcataaaaagaaaaaggaaagctgcaaaaaaaaaagaaaaacaacaacaacaaaagttctgtttcccctatgtggcaaaaaaaaaccgtagatccgaacgaaaaaaaatctgattcctataaaaggcaaaaaaaagtgaaaaaaaatactagattcgattccgttaaaaacaggaaaaaaagtcggattcctataaaggtgaaaaaaaacagaaaaaaaatctaaaaaagtttgtccgattccataagaaagtggcgaaaaaaatggttcgtaaaaaataaaacgcttgttcgtataaaataaaaaatgcacacaggaaaaaaatggaaagggcgaaatttctaatcaatatatatctcttctctatctctaatataatctaactattttttaaaaaaaaatgcacgagagaatagaaacggttcaaacaaacgcgtgagaaaaaagtcagaaaaagcgcaaaaaaacacgctaaaaaggttttccatcttccataaataaataaaaaaacgcgcgaggaaaattatttccatcatcggtaacttttttaaaaaataaaacatgcaaggaaaaaactgtcagaaaaaacgcgccattttaacaaatggttttaaaaaaccgcgcaagaaaaaaacaccgtctattaaaaaaatcgctctgagtcggataggatccatcgattttttgccacctactacacggcttttatttcgtctatattctcttgtttttaaaaaaagcaacaaaaataacatttgaaaaaaaacaagcaaaaaaacacgcgagaaaataattggcaaaaaaaggcaaaaaacacacgagaaaagaaaagcaaaaaatagagaaaaatatggttttcattgtaaataaaaaagcaaaaagatcatgttagaaaaatcttttagaaagaaatgcgtcatttctgaatggtttgagaaaatcgcgcaagaaaaaaacaccgttcgtaaaaaacaagccgctcattaaaatacaaacattgccattgacatgattatttatgaaaaacgtatattatcattagaattttttcacccgttgcaacgcacgggcatttttgctagtaaaaataaaaagaggaaaatagtagattgataatattgttcggcggggtcctttctgccgacgccttgactaactttaaagcgccgcaggccgcatcaacgatctccttttttctgctccgtgggcccatccttccttcctatccggactggtataccgcatgcaatcaatcaggttgataatcctctataatctcgtaccgttccatgattccatctgatcatccctgttgcttcatccaaaattccaaatcatgtgcacgctattagtgctgctctccattctgcaccatctgcctgtgatgtgctacaatagaaacctgctcagcggcatccgcatagtccacatacatatatacatatatatattcctagctatttgtttttaatgtataatttaaccgttataatttcatttagcccgcatagtgtctcagccaatttaaaacattggttgctgctatagcatttgcacgttgcactttgctttctcatactaaattagtaataacacaaataggaccaagcagaaataggaaaaatgaaggtaaatctggataagtacgatatcttatggtgaaaaccatattgatatcctgtatttctgtaaaataaataataatcgggaaaaactaaataacaaatatgaagtgaaagattcgatgagaatttgtaatactaagaaccgttttttcaaatatgcactttagtctataactttttggttaatgaaatcgcaacaattttgaggaaacataactttaaattttataatagaatatctaaggaaaaagtatgaattacccccctaaactatcgcggtcgaccgaattaccccctaaatctgaaaaccagacatcactcacctcgaactttcaataccggacgaattacccccactggcacaatccaaagcggttttatcctacgtgacgtacacgtggcaatccagtcagcatttcctttttttttaaaaaaatggtggggcccacctgtcatctcacctcctccttctcctcttcccctctctctctctctctctccccccttctctcggcgagcacggcagctcgcggctctacgccggcctcagctacgcctgctacgcgtcatcggccacctccccgtccaccaacggccacgttcgtcttctcccgcgcggcgccgccgccgacgacctgtacgccacgggctgcttcacctactgcgccgagctcacgccgacggcgcgccgtgcaccgggacgggttgttgccaggtccccatctcgccggacatcccctacctcggcgcggtgttccacaccggcaactggacgaacaccgcgggcggttcacactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacacatgacatgtcatctgtgacgggtgtagtattatgaaccatcacgaaagagaccactcatctctgacgggtcttttaactaacacacgtcacagataacgttatctctgacgggtggtagttatgacccgtcagtgatgagtgaaaattcaaatttttaaattttgcaaaaaaacctcggattgaaacatgtcctatataaaagttgtagctcttaatgatatccacaactttataactaacaacatttctattagagatcatttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttaagtaggtgagttggtaagggagctctatatggaggttgaggtcttgagttcgaatctcacttgtagcatccaagttatattgcgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagtcatcagcgacggacaggtgggtactacgcgacactggtgacttat

SEQ ID NO: 8821 - DNA, 2371 bp, Oryza sativa
acccgtcaaaggtgagggtttgggcccgtcagagatgacctggtccggcgtagtgtcaacccgtgcttctaagccatcggcatgctcgtgtactacaacgagaccttggatgccggccgtggcatccccgtggacgtcgacgtgtgcgctcaggtcgccggcggcgagctagaggtcgtacaccatacggaggaggtgccgaagctcgtagttgtcggcgcgggtgagcacgccgatgagaaggcggaagtcgggcttccgcgacgccgtgtacgcccccggtgtcgccgggccgcacgagctcatcatgagcgcctggacggtgggaaggaggatcctgccgccatctcgctccacgtcccgccgccctcgccctctctgccgccgctgccatcggagccgaccgagcgctaccccgacgtctagtacgccgcgtcctcggctcctcgcccgccgcccacagccgcctccgcccccgcccaccgccggcctcggctccttgcccgccgctcgcagccgccttctgttcactgagagagagaggggcaaaggaggaggagagagaggggcagagaaggagagaaacaacaagcgctgaaaggtgggccccaccattgcttttgctgactgtattgtcatgagtgtgccatgtaggctgaaaaccggttcgaatcgatttagggttgtaatttatccggttttgagagtttgggatgttaaatgtctagtattatggtttagggggtaaatcgtactaccgcaatagttcgaggggtaattcgtactttccaatatggaaatatctaactatttgccaaactattggtcatcattaattacaatcttaatttggttgttctcataattctttggaaacagaaaattaaattccattaatatattactctgtatgtttcaaaatattactggtcattctcacatttaaaattattaatttagatcgtggtcttctatcttcacattttatcaatgccatgtacaactgttaatcaaagttaatattgcttttgagaacgattataatgtagttaataagcatagcagtgtaatttgcacatctcctagtttgatgtgaaattttgctagaatgacaaataatataaaatgagatatatgcaaatttaatatatattttgcagatgagccatattacaggctaaattaggcggcacgtcaacagggcgtgcagatcttctagtatctactaatctaaagctagcacttcttgtgccaacgggacatttaactatttaccactatttggtttgacaattatcaaatacccttcttatatttgcacatgcattggtagtgcataaacttgttagatgggtacaatttagtacataatcttgtaaaatgctcgtttcggtacacgaacttgtctagttttgtgcaaacgagggccaaaatagcttggcaatattaatcttacgaagttgatattgattagggtgtgacatgcatatgtatagtgcgtttgcataagactgcaattatttataaatttgatctctactttatccttcatcaaggaagtgatgatatttcatatctttcccaccctagcttatatcattgctctttttttaatctttttctacaatcacaaaaacaataagattatccatgtagtgttcttttcgccttcctccgcacgcacctgacaagttcatgcactagaacaagcgttttataagttcgtacactagattgctaccacctaacaagttcatgtacggcgatgcaatttactcttttttttttcaatccccttctccaaatcgaaccaactctagaaaggggagaaggagctgtcgtttacatggaatgacagaagtggatatcgatctccgtggtgccatggtgtgctatccacacgtttgatccgttgcatgatagcccttctacacagaactcttggataactattacagactttcccattgataagaattgttcggtatagtgaagcagggtttctagatgctttactggtcgaaaaaatggattagatatcgcagctctttttctccttgctagaaaaataatttctggtagccaatatccaaccccttccattttaatacatcaatatacactaccggagaattgatatttgtccggatgataaaaatcgcattagtctcgattcgaataggaacagagacataagaatgtgtttagtcccggttcaaaagaccaatagaattttttgattctttagttccagttggtaacatcaaccagaactagagatcattttttatgtcctggttcaaaaattgttaggcctcccactatctttagtcccggttgtctaaaccaaccggaacgaaaaattaaaaac

SEQ ID NO: 8822 - DNA, 8203 bp, Oryza sativa
  unsure (1)..(8203): unsure at all n locations
nnnnnnnnnnnnnnnnnnnnnnnnnnnnnnnnnnnnnnnnnnnnnnnnnnnnnnnnnnnnnnnnnnntagttcttccattaatctatttctattgcttacagatcactcgcgctccctcggctgctgcggccgttttttaaatcgattggcgacggcacggcatggcggcgtgctaacagatccacccacgtatcagatcaaagcagagatgatcgcggcgtttcttcatccaagcgcagccgagtagccaatccgttgcactagtcagcgtgcttcgtcccttggtcgtttccaggcgacggtgccagctgctatcggtgccacgccatgctgatggcgatgaagtcgacgatgcactattttctgggatagatactactttttcctcctccttttttcaaacaactatactcctttttccatcaatgataaaagtagtatcataacatactgcttttgttttgaatatatatactatctttttttttgcgggggaatatgtatactatcaatttcatctagtatacttcattttatggctcattatataaaccattcggtgaaaccaagtgatataaatactattttcttaattatttaataagtaccactcggtgaagtattatgtacttcattaattattttgctaataatctaataaaaaggtgcatccatacataccttctatcgacgatcgatgtactacaatactgcatactaggtgccattaaaaaatagtatatactgcttcaatgaggatttcagtatatgctggatacttttaaaaaacagtacatactcattaactaaaaaagacagtacatacttctcattaaccgattgatttagtatatactggaaactaaaaaagacacaacatatttctcattaaccgattgatttagtatatactggaaactaaaaaagacagtacatacttcttaaccgactgagttagtatatactggatacatgataaaaacagtacgtacacctaattaaccgatcgagtactggatacttagaaaagagcagtacatactcatttcaatagatcagtatactaacgttaaagtaaagaaggttatatactgatactaaataataaaaagtatgcattcctacataaaaaatagtatacatatactgtactacctccaaacaaagttgtatatatgtactgctacaactatttaaaaggtactccagtatatacggcaactactactacgtaaactagtatatatactgctacgcattgcttaattttttgacggtgaaaaagtgctgatacagttcattctgaattctcagtatatactcagtgacgacactgttaatttatgaatctcatcagtgacatatactactttttaaacagtacacgaggaaaaacaagtatatacttgcccgctacctcaactatatcaaaatttgaacctaacgtatgtccgtatgtaccggcctaactgcatgcatccagaattcgaaaaatacaaaagtgaacggtaatttattttcccatttaatttaattatttattatcaactaatggatatccactaagaagagggagtacatacacctgggagtacaaaagagtcgtcctatatatatatatatgtatatatatgtatatatatatgtatatatgtatatatatgtatatatatatgtatatatatgtatatatatatgtatatatatgtatatatatatatatatgtatatatatatgtatatatatgtatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaggtaattgaaaaagtttcatactcatttgaattgggtatatactcaatttcaacaatggtgcccgggcaccatggagcaccaaacaaatttactatatatatatgtgtgtgtgtacctgtccccacctcacatgaaggtttcgggtctcaacccactaacggttggagagaaaatatccacaaatccacttttcttgaaaaattggatcactgcgctatatgttctgcatgctgaggcatttgaatgttgtgcatgcatggcttgttgatccgcacgcatgcaaggccgtgcgaccaggagagtagtttgtgtggaggttgctacggagactccatataagtttacggtgatgtagggtagaagaggagtgagcagaagcatcctttggagttgtgagcaagcagatcatttctgcagatatttgatggagcagaaaccctccggtggaaagggcaaaacatcgtcggcgagttctgttccgtcgccttctgcggtgccagaagacgtcaacgcgtgatgtcgagcggcagaagacggtggtagccgtacgcgcatcgtcgcctgtgagttctagcaagcagcacaatccggcggaggcagaagtcggaaccacttcagctaatggtgtcatgcagcagaaacctgcccgcagattggtacatatcggagattattttttgtttatgttctgttgaaaatttttctcttgtttgtttgtttgtttggttctgactatttggtgcgttctttggtcaggaatgattttgtgcattgcatggatactgctgcccggagtaaagagatgaatcactctctccagaaatatgacattcatttggatggatgtcatcctcttcccatgagaaatcctaggaatagatagatgcgcttggtgttcacttcatgatattcgtgcagcttacaacatgaatttcagaagcagcgaaagacctcggcgcagcagtaatggttgcgaacatgtgtccaaggagaacatgtagccagtagtgaaatgatcagaaaatttgtaatatacctcaaaataaaatagcagaacatcaattgaaagaaatcccaggaaaaaaaaattgcatctcaacaagaaaatctactgcttctggccggcagaaaatatatgttagctggtcaatttaaaaaactggcagaacgtcagctaaagaaattggcagaacatcatcgccgttaaaaaattgttggcagaacaaccacctaatttttctctatacccagtttttaatagcagtacatattctgcctattgcaagctaacagaagtacatattctgcctattgaaagataatggaagaaaatcttctgctcagaatttaatcacaaccgcataaaagaagtatgcaagttcgtgtaacagaaagctaattaagcttccgttccaaaatcaacggataggatagcagaatagagtctgtgagctgtgaaaggagcagaacatcggatggaaatggagcagaagattaaattcaaagaagaaccttcagctcctgctcctgcaactgaatcccatcatgtaatatgtgtcagtgtgaacgcaaaatatgatcttgcggctaaacctaaagtcggcaaagagatattttgtttagggcgatcgctacagtgatcgatctctcatgaacatccctgatcgggggataaccgccatatcctagtgtcggttccccctgtgtgcagtggctataaatagaaatcgatacttaagtgcaaaccctaagattcgattgctacccgatcaagcaaaacccactgagaacacggggaagaaccgaaacacatctctctctgtgcttccaaacaagagagaaagagagaagaacaaagacagagaatgggaacctctggagatcaaggtatgactcaatcccatttcaatttgtagttccactttgtgccaaaccgatccaaaacaatccaacaatggtatcagagccaggtttggcctcaaattggaactcaataagtgtttatgttcaagttgttcttcgttttcatgcccaaatccctctgttaaagttgaattgagccaaaatcatgcaatcccaaagcataagaaatggaattaggccttctagggtttcggcttgaagaaattagaagaaggggaaggaaaatttcatgcaaatctcagacaaatccctaagaaccgaaaccctagctgaagtaagaccccaaaaattccccaaatcatggaaccctaaccctaaaatcatggggaaaaggagcgcggcgggcttacctaagggcatggtggccggcggcgacctccgtgtcgccaccgacgcaataagaggcgagcgcgcgcccgaggacttggtccccgagcggcctcgcgacccgccgtgctggcccggctcctcctctttgcgtgctcgtctcgctgacgccgcttcgctgaggtagccgtcgccgcctcgtctcgccgtcgccgccgcggatcttcctcgcgcgagcgaccggcgggtgcttagggcaccgtcgagcaacgctcgacggggatgcgcgccagctatggcggcacgcagccccggcgagcaaggctcggcggcgccatctccaccccgtcgtgcgccgcttcgccgtcgtctcgctcaccgtcgccgcgggcgtgagagaaagaggggaggagagaatggggctagggttttcgcggggggcggccgcgcgccggttttgtcccgcgcgggagcgatcccggccgtccgatgagatggacggctcggatcggctcgctcccgacgcgggctgacgaggccgtgcgggaggcggcaaacgccggcccaggcccaggttgatgggcctggagcccaggcggaaggcggcgcggcaatgacgggccaggccgagtgcggcctggctcgagaaagtggcccagttcaattttgtgtggctgcatagtaacgggctgcatggtaatgggcctaattaaagattgggctaagataatattacaattaattttttccttttaaagaattatgattatgatcattgtgtttaaacattaaagatattttattatgttttaattaatgataataagaataataagtgactttgttatgtgataaaattatctttcatttatttattttatgatagttacattatatttattacttaaagttattattgttttatgcattatgagtttatttccgctacaaataaatattataattaagtgtgacaaataattgtcattctggccaaagctgattgacttttatttgatcacaaaattttattaattcaattcaaatctggccaaagctgttttgattgaattaataaaaggagttttaaacaaattgataaagtgtggtttgtatttattattctggccaaagctgattaataaatacttattcacaaaattttattgttcatttgcttctctggccaaagccgttttggatttgatcaataaaagaaggtacttatttagctgctgataatgggcaatattcagggatttgatcaatattcacaaattgccggaataatgggcaatattgaacaacttaatggaagtaattatgcttcatggaaggagaagctggaaattactctagccctgttggatattgattatgccctccataatgatcctccggttgagcctagaccagaaaatgataattatgagacccataatgaaagatatgacttgcctgctcagaatagtccttattcttgatataattcttgatcaaccttcacctcctggaagttgcaaacgttgcctcacgactaaccgatacacaaggtctataatacgcgagaaaaaccaatattcaacaacaatcaaatatgcacaacaaaatgtactattcgtgtttgctaatggattccaatcatgctaagggctaaagtttcttaatctttctattgtcatcgtggtctatttaggagttaaccaacatagcatttatggtatacatatatatttggctaatcggtggtttagtctatcaaatggctatggaaggattatggctatatatgcatctatctaaatagcacggttacataccagaggttctgttgttagatggatttaggatcaatcaaataacgaatcatttgtattattatttaattgatggaggctttactttaattatgaacatattttacttgtcacaataaattataaaaggttaataattatccatgctttgtatgttagagttgtttaggttaatcatattatgattacagattatcccatcacataattttacaatgaataatcctaatttacagttgaactataattataattatatgaggtcaagatttataactactatttatctactattcatgtttgttatatactccccagtttaatatatgaaaaagataaattaattgtataactataatgggatatacaatatatgtgtgcaacaacgtataaggttttggtcgcctactgtacatgagcttatttagaaagtgtattactcaatgctccaagtgattcctgaatatattatagtttaattatacattagctagtttctatgagtgatattgtatatgtgatgcgacaagtttaagcactggttctattgggtttctaataagtggtaatcaatttaggcatatatatgctattctatatggtattgcatcgattaatttacttagtgattcctccacatctagctctgttattattctcctaaacaggttaaagattcatctatgtgtgtttatattttagttacataatcacaaggctacacttgatttaaataacctataagccataggtttaattatatggccgtcgaatattaaataagtagtagtattttcctatacatccattcatttgagacatcacttaaaattagtttgtgtggttgttacagtggcaagacatgttagagacaaatgttattacatctactctactgtacaatactaattctatttattagcatatttttaagttgaccataacctaatcatatgatattaattatttaataattataaatatattttatttaatagtaaattatataccattggaaagcttatgaatttagatgaatttaggttcgagtttcactcaaatcggagttaaaatgagcgagttatgctagtttaaagattcaatttcgaattaatccgagaatattgtgaaaatgcactgttcataaatgatttatttttaatcggaaacattatccaaaacccactgtggttgacatgtggaaccggtcccggttgacttagggtcaaacccaatttcgatctatatatcctaaactattttgcgggtataaatattttgttatcataagtttttaatttaatctacccgagcattatatccatataataggctagaaatttctatcgcgatctaaatattggatggaaccctaaaattatcttataatattatacgatttaatttagtctatgactaaacgattaaatgtaatatacgtctgaaattcctagtgattaaatccgaatttctaccgtgaatcgattacttatagagattacccaaaaataatctataatagtctataagaattcatctaattgtttagttattaattacatttaaattactaccgcgaattgatttcttatggaaattaccaagaataatctataataatctatgattatagtatcattttgcaaatactacactttagttaatcctataattaattccaaatattttaaatatcctaaatctcctcctaattcctatttatttcccttttcttttcctcactttctttttctttttccttcctttctttttcttttctttttctctttttctctcttctctcttttcctttccttttctctcctccctcccggcttctttctacctctctctctcggctcttgctctcccgggcggtgacggcggtgggcgcgaggtgagggggggggggagggaagacggctcaccggcggcggcggtggcggcgacgacggcgacggcggcgcagtcgcggcacggtgcggcggcggcgcggcggcacgacgacgatggtgcgtggagaaggggaagagggagaggaggagggaatggggtggggtggagaagggggg

SEQ ID NO: 8823 - DNA, 12722 bp, Oryza sativa
agagggcaaggggcggcagcttaatggcgacgcgacggcagcgcacagggctcggagcggcgatgcgacgggtggcggtgcggggctcggggcggcgcggggctcggcgtgcggtggcaggcggtgatggcgacacgcgcgcggcgacgggacgggcggcggcgcgcggcgatgggacggcgacgcggcggcgcgcggcgatgggacggcgacgcggcggcgacgggcgacgcgacgggttggagacggtgcggcgacggcgacggtgcgcggcgggataggacgcgaggaggcgtggcagcggcgcgcgcagggcgatggcgacggcgaacggcgcggcagggcgatggcgatggcgactagacggcgcgcggtggcgcggggcgcaaggcagcagcaggctagggtgctggctagagagggggtagttaggggacaacatcgaacacctagaggcctatgaacagtactagccgatttctttggattttattagatgttttccaatttagagaatggactattgccacctattttgtcacaacgtatttcacacaaaatctgagttattcaaatgtaaatttgtattcacacttaatattgcccacattttatttttattatatatttttctaccttttcctattttcctacttttagggcttttggttgaattataaattgagaaaaattgcaaaataaatttgtatttactcctaagcatttgagtgaccatattatgtgttcaaatgtgaattttcccaaagtttaatattgtccaatatttatcctagatttttataatttcccatatttggggatttcggtatttatttattttgatgcatattggtttatctttttaaattggttttaccacaacatggatttctataatttaatatttgtgattcaatacaaattatataatatcgaattaattattgcaagtaaaactattttatagatagagttccttctaattaaatggtcatcatttcatgtgcatttatattatcgcacccacctacattattcaaatattttaatatttgataaaatagattaatgataacttttattttattttactatcttgtgcataaatatttgtagggctaaacataaataatatactctcgtaaattatatctattgcttgaatgcagctcttttctttactttctttgtgatcatttacggtttggcaagcaatagcgatcataacaaccagcatgacgcaaaagttttaaaaagttcgaaatttttagtgatttttattgttgggaattttcaggatgttacactcttcctagactatacctctctttctcctcaatttgtatccctaaacacttgtattcttcagtggattgcaatatatcggtggcatttgtgtgagagatttggtgtgattgtgacagtatccaggtaacataggttcatatagacacacacgttttagtttctctgtagcttcgtagtaaaggctagtagtagctagcagaagtgcagaaaacaaatgtaatttgatcaatttcactctcatccagctgagaaccaaacgtctccgacaaattaaggagacagttaaagtcaaaaggagggaggaaattagggcaaaagttgatgctagtgaatctgacatccacaaagagaaatgattggtttttggatccatctacagtgatctgatcccgttgccatcaaacgcatcagatcagccatcacctgtttgcaatttgctctggtgcctctttgaggtgaacgttttgtttctctccttctataaataaagtatcctgttattaatacgactgaatcatatgactcacatccgactctaccacatccaccaatcaccatgcttagcttctttatcatgcggagttgttaaggaaggatgcgagcaggaggcgtggtggtctagggcttcgagagagatacataaatgggtctcaaggagcccgcaatcacattctgccccaatatatatgggccgccctgaggtcccaatatagttctggcccaacgaaaaggaccgtcgtggaggaggccccataaactttcctatccagcacatacttttcggcccattgtatgggcctcatggagtccgcatcaacgttctgggccaacttaaatgggccgcaggtaagccgcggcgatcccttcatggccagtaggcctaatgtgaaactaagcgggcccaattttgagggtttttctttttggaaaaagtacaccgaaggttggggactgctaattcacgcatacacgccgttacagtaactcgcgcgcactctcacatgttaggctgcagcccgctcctatcacactaatcatggtgattagcgttaattactgtgattagagttaattacacgctacagtaaattagagaaaactaattcgtgcgcgacgtagagcggttaggtcttttttttttgcgcggtttctttttttttcttttcgggtttttttttgaagacgcgtaactaatccgattagtgtaagattcgtagatttgtctttttttcaaagatttttttaactaacagattaaaaagagatctatatgtgaaattaaaatttgaaaactttcaacccatatttgagtactttcaactcgaaatttatttttttttaagtcaaactttgaaaactttcaacttttcatctcaaatctgaaaaactttcaactcagatttaaaactttcaacccagaattgaaaaatttcaacccaaaatttgaaaactttcaagtcaagatttgaaatctttcatgtcaaaggaataaaagaagaagaaataaaaataaggatacgaggatgacctagactcggataaattagcaaccgttccccggcaacggcgccagaaatgcttgttggtatttcttacgtccacagataaatctgcaagcgcacagaatagcactgtagcacttcaccttcgggtgatcctaaaaggatatcgaactcagggaacgtgtgtaatctacctaaggctaagacaatccaagaacaacaactataggtaggctaggcaggctagagaggactttctatgtgttttagttatctaagctaagcaaaggtaattttctatctgttgcttcgggcaccgacccttgctggtctgccagcgtggttccgactatagctctatgatttatccgaacgtggaggattactaggacgggattcagggctgtcaccacctgccgcctacctctgacaaatccatgggatacacaacaaacaaaggtaatctctaacctagacaccacgtctaagttattaattactactctaatacttgcgcgggaactttcttctttatccagagtcctagtactagagcacttagtatgaatactaaacaatgaacccgcaaagatgaaaatatatcttactcagacaaaattaattaaataacataagaaaggaaaacaaatgcttactttatagaagaagttctccgaacccggattcctcctacgaagctacactcgtcgaggtagaagtttgatggagcgtggggctcctcaccgggagaccgcgcaggcccccctttgctggttcggccgggggccctgggtgagattctaagctcctggtctgtggaaagttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgttttctcccccaaaatctcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccgagggggttaggccacgtgggtgatcgtgtctgcctcaagtctctaagtcatgatactcccggtcccatgtcaccgacaaagtcggatgagcgccaaacttccgggcactcctccagagcttcccctcactctctaccttattctaatgtacaaaagatacaatagagcctcttgtaattcagctcaaagttgtgtgttggaaatgagagtgagctcctccttttataggcaggtatgacggttacagcctatgcgaaatgaccaaactaccctggaaccgccattaggatgtgatcagggccgtccatgcaaaatttgacgatcaacggccagcaaaacggttcgtccgaactggaggttcgaccgaacccgggacggctccgttcggcccttttttcgtcatggacactatttttgaggccctcggcccattggcatgatacttgggcccatttggagttgtttaattgacttatgggacctccaattcgtgtaaatgtgtcctgaaagcgcgggggtgcagtttgtcgcttgacggatgtgttttcttctcaaaatacctgcatacacatatttcacaaatactagtgaaaatgattagtaataatacctaccactaagttggataccatatttaattttattatatgcaggtattgacggttagatattaagatttaaggactgtcaacacatatgtgtccttttacaagctctacaaaccttgtcataaacttagtctcgcagttgggctaggccaccaggtcgacagcaacctagaaatgatttgcacattaatttaagttatagaaatgattaactaaataattttaaatcccaaaaaaaaaatctcatggcctaactcgtcatcgcacgacaatgatatattaagttataaaacacgcctatgcgaaaaatcggaatatacttgcgacacaaaaaagtttagcttaatttgttaaaacatgatacattattttcgttgggcccactatcaaaaggtaaaaaattgttgtggtgaaacatttgtgttgaattgacttagtatggtgttattctttgaggaagaaaagcattgtttcaatcttgcacttggaaactatatttttcaaacctgaaacatcgatattatgttcgtgaaacaacattactaggatttgatcgaaacaacacactcgtgcaacatgtcaaggaagttattgaaacatatgtcgcacgctagaaaaacatgtataatatcgtcattgaggctactggttgcagcaattcagaagcaacatgccttgggattggagaaatagactcatttgcaatcgctcagcgtggccgcacgtattctctttgtctctctcggagcggtaggaatagaaatagatgtatgtgtatcatggtgccgtggtggttgcgttttccgctggcgcatgatcacacgacgtgcgtcggatgcgtgtgggcggaggcaataactacatctatatgttaacattacacgcactctacttacttggatacggaatcatagattaatgagtggtaaaagccaaagcacagccggatatatttaatcaaataaagataacaattgtttctggtaacattggtaagaacaacatatcacatcaaccacatagagttataaacaccaaataatgaagcaaccgaagatgaaaagggaacaacaggacaaatgtgatacaaggacggtccccaggtgagaaccatttatggggattgtcactcgatcatggaagaaggatcagatgtgcagctgctacgcgatcatgcacccgcgggagcaccaatagtgccacctttcgcaaagtattccttggcttccttagacatgacgatgcaggtgtctacacacttcttgctgatggcaggatcctccttaaattccttactacaaccctcatcgcacaaggcgttgaatctttccacggggggatccgtggctcccttataggccctaaaaatctgcttggtcgagatgacgcagaagtctgggcaatgcttgttgtagatggggtctttttgttgctcctctctacacgcatcggcgcaccaaccttgtaataaatccggcggtccggtggctgctactgccgcaaccaccaccacaagggtggaaaggagcagagccaccgaaatggtcttgttttgggccattagcaccgtttatgctgagcagaattggtgtggagctaagatgactttccttaccctaatgctcatgttatatactacgtacgtgatagtacaagagctatatatatatggggccgagagagcttcatggaccaccaatgagactaaatataggcatttatatcatcttcggttgctagagcggagactcattccttccttatgaccagagagtgatgaggttatcttgccatggatgcatgcgtttaaaaattttaaataaaatggctgtcgttcgttgtatgcgttgatcacttgctttttttagatgatggatttgaaaaatatagtttcttatttgtcacatcctgattttttcaggatttataaattatttaataaattattattagaatttatattaaatgttctttaatttacaagtgaagttaaatgtgggaaataaaatttcctaaatttaaagcatggatggatttaatttttattaaattctccatggttaattacactctctgaaattttctcggatttttcagagctcaatttctaaatgatacaaagaacagttcagtaattatttgatcaataatgatctaattataattgttaagagcttttcttgtttaaaaatccttaaattataaattgttgtttaaaaggaattattagaaatgatcttaaaagcctaaaagagaagatctaattttaattaataaattccaatataaaatggggccagataaaatttcattaaatacttctcttgattctatagttcctagatttttctgggatttatttgagccaagaaagtatttttaataaatggaattgcatttcatgaataatttaaattgaaaaaggtttttaaaagtctcttttggctttgggccgaaagtcggcccaaaaacctctctctttctctctcctccccggcccaagtcgacccagtccgccgcgcccctccctcctctctctcagccgctgacaggcgggacccacttgtcggggtcgtcgttctcctcgcgccggccgccgctcgaaaccctagccgagccgcttcgccgccgccgctttccaatccggtcgatcctttctcgatccggtgaaatctttagaggggaaataatcttctcgatctcctcttccttttctcttttggaatcatcgcctaattcggtttggaaactcgtggattcgaggtcgaatcggattcgtttctctctctcgaaccctaacctttccttctcgccgccggttgccgtgggccttcgccgccgcctccttgcccctataaaaggacccccgagctctcctctacccgccgccaccctcgccttcgcctctcgtcgcctgtagcgtcctagcgccgtgagacctcgcgccgccgttgtcgccgccgctccagccgtgcgccgccgtcgctccagtcgtcgccgtcgctcggggaggtcaccgtcgtggtcgccgttgcgtcgccatccccgtccaccgcttcgccgccgccgaagaccgccggagcaccgccgtcaccgttgacccgaagaccgccgccgcttcttcctcatcgccggcgccgtccgttgctcttccgccgccgttttggtcaccggtgagttcgcctcgtcgcccgcatcgttttggtgccctccgttcgcgtcctcgcaccgtcgttcgccggcgagcatgcgccgcccgagccgtcgccggtggtgacgtcaccgctgacgtcatcgggaccgtccgccgtggcccggtcgtggatcggttgatctcggccgttcgttttggataggatcgatctcggccgtccgttcccgtgaaccgctgctgtgcacccggtccaccgtgaactcgagcccgctgacgcaataatcctcttttccttttcaaaaataattcattattgcgtcataattcaattaaaatctatataagtgctttaatccgatttaatctttgaaaattcataactaattctttgtaactcagtttaatgtggttcaagttgcaaaagttgtgtaaaataaagatctacataataaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgccagtgcgccggaagtattcaagaggattaattgaagaccgattattgcaaggcaagtcacacagatcctaaacacaatcctttgagcatgttgatcctatatttaaattctctatttatttcaaccgtgtatttattttcgaatgtcattgggtggtgtgaatctattcctttgttatggccaatttgcattgattactttattctttgatatcttgggttattataatttgactagttaagctttatatattggttcagctagatattaggtatgattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtaggcaacggctttaccttttgtataacatgattcattgcgaagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttatgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcaatgttgattaaaatttctgattaattactccactgttttacttctcctaaatgttttgctaaatgctgattttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttctgggcgtgacattattgcactttctagccataatagaagccatgtcttcaattaagcttagcggcttaaatcttttacctcatttgccgcacacgtatatgttggtatttcttaacgtcattactagaaatatgaattccttgcaatggcgccgaaatacttatggtatactatggttacagatttcatccgcaagcgcacggatataccattgtagtatttcacccgagagtattccaaagtgttgacggaaaacacgaggcctgggagatctgcttaactccagtgcaggtccaaaactcgccttcgggtatgctagcgtgccagttgatttgatcctgcaatcaacaagaaataacgacaaggaaaccgcggttaaacctataaacgatagccgatcggctaagtaccgatgacatatcatttatctttgagccgatgtcatatatatatatatcgatcgacagtcataaataaataagaaagaactaaatctactcgatcagctgtagatattaacgatatatactcctcatatcgatatatatttaaatcaagtgattgggatagatcggtcgccatgccgagacagtataaatcacttagatcgaaatatatattaataataggactatatatgttcatagcatagccaatcagatagatctagcatgtatcggctaatactccgataccgctctatactaagatgttaaagcaagtagaatatatcaaacaaaggcctaatatacttaaatgcaacaagatcttaatataaagggcagatttaacatatcaatgaagcatatagggtgaatatagttaaatcaggtaagatcggctgaaaccccgatactattctaattggcaaccagaaggcaggctagagattgatattctaagcacgacttaatagatcaaactcaactgatgccgcattaagtatgaaaaaaagaacaatatctagacaatcaagccgctggaagtttcatagagtggtagatatcctatataatctaagtcaacatcgatgtttaactataactgccctctaccgacagatgttagccgataataggttaaatagcgataatgccagagattatgtaagatatatgataacttgacgaattacatagacaagattagagtatcataaagatggaagcactaatcccgagaacgcaagccgtcataacaagttttacctcttgttgaggatcgaaaccgatgcagctcaacccgaaagtaagaactcgtcgaaataaaactaaagcaaaagggtggcgatgcgccgagattgtattgaacgtgtgtgttctttgattacatgtggttcggggcctatttatactcgaaaattacaaactatgtccatatcggacacgactcttatctctaacaaactctaagataccataagtcttaacggcagacttttgcccaaacatatatctaaggaaattacataaaatatcataattaatagatacaattgccttcccaggactctatccacgcgtggccatcatcttgaagcatatcaactcaacccgatgtcgtacaccaagtcgtattgtcggaatcggctgtatcaccaaaccaaaagtctgactcgaattcagccgatccaatcgtagccgatcaggactccagccgattcttactctgttctcgcgataatccttatctctgattccacttcgatctaatcttcctttccgatgccgatgttgccaaatttggttgttaacacatgccccccaagtccggaatatttggtaatgtttcagatttgccgtatatcgactccgagcaagtttcgcacttcgctattttccgaccattactcccgtgctttaaatactaatcgtcaccctcgagaaatctcacaccgtcctcttctattttcgccgctgaaacaaactttgccctctctttgcggcgactccaccgacgcaaaaagcgattccaaagcgattccatctccgaccggacctccgcctgcgttgatgtcgtcctccgccagcccgtctaccgcgccatcagccgagtacgctgaggtaaggtctcatcggctagatcccttttcctcgcatgaaatcgatttcccctttcctcatcttgttttcttcttctcgattcttttggatttgcagcacctctccaatctagttgcgattcccagcctgtcgcatgaaaaccattactttcttggtccaatcggcaaccttgaccccactgatttcatcatcggcgaaagcaacagaatcccctttagattagccaaccctaacctaggt

SEQ ID NO: 8824 - DNA, 3155 bp, Oryza sativa
tgcagacctggttaaacctgatggtcttgaaagttgtcaatcggccatctgtgacagaagctgaatttccaaggtttaagttgtgatgtaattcaaattattattgataaccaataatttggtaaattattgattttatttctctttgttaaattacatatctttcaagttattattcatgtgagatccattgggtaccggcgcctgccgggcatgggtatgggtacagagttttgcccgctaactctagtgggtagggtttgggcaggcaatgtcgggtatcgggtcgggcatggttttactctacccgcgcccgacccgacccattgccatcatccctaatgatagatgtaattcatggctctttgatatgtagctctagcactctttaaaccgaaagtcattacaacccactcgaacaagccgattgcaccaggacacctaaaagctgtcttatggatatcttcttcggccataaagatttgattgtatcctgcattaccatccataaaactcaaaattttatgccccgaggcagcatcaaccagctgatcggctaccggcattaggtattcgtctttcggggtagctttatttaagtttcggaaatcaatgcacaccctgaccttgccgttcttcttgataataggaactatactagaaacccactcagcatatcggcaagaacaaataaaaccagcatcatataatcgtttaatttcagtcttgacaggttcaagcatatcggctttacatctcctcggaggttgctggtgtggcctaacccctggtttgataggtagccgatgttcaacaatcgatcggctgagtccaggcatctcataatactcctaagcgaagcaatatctgaattctttcaacagctctatcaacttggttctaaattctgcagataaattcttactaataaatgtcggccttggtcgatcacctagacctatatcaatttcttccaaatcatcggccgacgtaaaaccctgtccttgcttgtcattgagatcatctattgtgtccttgttgtagacatctgaaccctccaagacgccctcaaaataatagcttgggttctctatcttcaattggctatatatcagaatcggacacttttagaaaatctccatctcaaactattccagataaataatcaagaccatccatctcccaaagagctaaatcggcactggcaacattgactgacctgtcagctggcacgatttcaatcttgtcgccttgccactgaatcaagcattgatgcatggttgaaggaatacaacaattagcatgaatccaatcccttccaagcaacaattatgccgcgcagaaggggcgtgcgaggagcgacgccacgtcggattttgctatagtgctcgggtgtgtttttgaaaaaaagccctccggttttctttaattacgtataggcccctcacaaacagtgtttgtataggaaaaatcgtggacatgaatgtaaaaagtgaaaagaataggggctttttcgcaaaaaaacgcccacactacgtaaaagcatctccagcagtcttgctatctcactctccgagcaaaaatttagcaagtttggttcaaaattagacagactccaacagacttgctatttggatggccaagctatcagctggccaaaccggctccctgcctagccaaatttggccagtcaaaaccagcttgccatccgtgggacccacgcgtgcttccccctctctctctccgcacactctaaggcgcgcagcagcatcccggcggcgtcgtcatcccgtcgccaagtgtcgacatcatcgtcgcccctccgccggctccgctccttcgcgccgcccctcctcgccgcctcttcgccggcgccgctcctccgcgtcgcccctccaccggtgctgctcctccgcgccaccgctccgcgccgcccctcgccggcgccgctcctccgcgccgcccctccaccggcgctgctcctcctcgctgcctcttccccggcgccgctcctccgcgtcgcccctccaccggtgccgctcctccgcgccactgctctgcgccgcctctcgccgggaggcgccacccgcgatgcaagccttgtcgaccttctccaggtcgcgacgcgacgcggtcctggaacaccgacttgccgcctccgccaccagcttggcgctcgacgccaggtcgccgctcccgcccccgccagaccgcccgccgtcgccgccgccgtcgtaggaggccattcgcgtgagctgggtagctagctagctagcttagctttggatctgaaggataagaagaaagaaggggagagggggggggggggaagaggagtagaggctgacacgtgggtccgtcccatctagtttgactggctaaattacatggagagttggctatatggctatttggagaggccaattcagagagactgttggagatgctctaactcccaaaaccctatccgccgccgcccccttctccctctcgtctctcgctcgccctctccctcccgctctcccgccgccgtcgccgcctccgtctccgcgttcccctcgcgccgccgcctctgcctccgccgccgcggccgcgtccacctccgtggccgtcgcgtcggcgtctccgagcgccgtcgccgtcggcgaggcgagcagccatctccgcctcggtccccaccgtcgccgagcgccgccgctgcgaggcgcctcctccggccgccggcgtccggatccggactccatgttgtcggggacgcggatctgaccgccgtccatgcgctgggcagcgtctcctcctccgccgtcgccgagcatcgccattttcgcctccacctcgctctggcgctgtcgagcgccgccgccgcagcacccgtcctccgctgccgttgccatcgccgagcgcccctgctgggtccttcgccgccatcgccgacggccgctgctccgtcctccgttgccgctgccatcgaagatacgacgttggtgacggagccggcatcaatgaaggcggtggcagcagcgagaagaggagaaccgtatgtcaccaggctctcgagctcgccccagatcagtgccctctgtccttctgctcgtcgtgaggacccgccaaccatgacgacgcctcattcctcctttcttctgtgctcagccacg

SEQ ID NO: 8825 - DNA, 3764 bp, Oryza sativa
cggcggcggcggtctatagctccatgtcacggtggtcgcgcatatggctccctgcttatgctctgtgcacgacccagtcgtggtggagatatagaccaccgccgccgcctattacatctagggaaattcatctcggatcaatttttatcacttgagagtttgcgtgcagcgtggtctatgttatgcatttgtttgcacataaaaaaacaggtccttatccccttgaaacaagattagctgaacaatgcctcaaaatacttatgaaagtctttcttctttacatcgttgtttttttcggtggaaaattgttatttttcttacataaaaactctatttctacaatcacaagcatgggcttttactattcgtgtagtctgtagatagtgcttctgtcatacaacttgttcaatggaactctgtagtcgctatgccccttactcttaaaaagtgcaataaatagaattttaagagagaagcaaaggccaactgccctgtttgcttgcccttaagtgatgtgttattgtgatatttgaattatttttttctttcgttctggaaatactttcgttagtattattaggtctttccatggtatcatgtctgacctactagcctttcatggcacagtatagtatttttacttgtttggaaccaatatccttcttatgtaccagaacataatattgtccttatattctggcaggactgcttataatctggcacttcacgaacatgggccaaagctctatgacaaactgacagaagacatggaagatcacctgcaagaaatgtgcgtatcgattgaggctgctcaaggtggtttaaaaattatagataggtaaaacagaatgactacaggtgttggttttgcctccaaaataaaataaagctacttcactttgctgacattgaatatttgtttttggtaggttcagtcaagagagtaccttgccctattatttgcttccgtttgtatgggagaacatcttagcttgcgctttaattgttgcagcagagtgaagttataatttcaggtctctattaattgatgccttagtcagaaatctgttactgcagtgctctttctggaagtgcaaaaataatatgattaatagcataatgtaagctggctagattttatggttgggtgatatgggaagagtcaattgcgttttctgtccagctcggtttctatcggtgaatggttgttcgtttttttcctgtgcttttctattgttggaggatggcagggttcaaggttttgtttagtgcgttgtatcatttttatattcattttttaatggttatgtggcgatgtttgggatagggtaatttatggtttatctggtttttaaagactaaaaaggtatttctcggtttgattgcaacaggcttcgttccaaacagctagcgtgtataccacagcactctatggttggtggcagcaaaagatggaaggaaaaaacgtattagcggatgggtgagtggacctacctagatcagtcgcataggccaggattataattatatttagatggtctgattaactttatggtcggtcaatctatttaactggatacatgttgaggccatggttaaaaaaaaactgtttggtgtggttcctcatagtctttgtgtttgatgcttatctaagatgagcaaaccatgtttattatgttaccttttcagttatgattttggcgttaccttttcgttatgtattctggtcctcatttctggctggttggaaactgtatgtgatgtgatatagattttgatattgcgtttgtatattgctctacctaaaagtttgtagttgggccttggggattatgtgtatcacaaatattactttggtattgttattctggttatgattaagtttgtaaaatgatgcttcttatcgtattttctactggatcaatttgaggcaaacgaataaatgagcttcctattgtctccagtgtgatggtgccgtacttgttcatcagagaaaactaacaaggtaatgcgctactcttcttgccacttattgtaagagacatgatgatagacccggccatgctaagattggttcttaaaacttagtgttttgttttatcctatgataatggtcataaatttaagtcgatgaaaaaacatacagattatcgttaattttatacatgactaatgctgtggaagaatgttgagatctggggaaaattgttgcctattaatgttcattaataggaaggtgaaatttgagtttcatgctgctttccatgaaaaactgtgcatgttattattaaaagttgctgctaaatggttgcacatttgattacatgtttttatatctattgatattctgatgtccagaaagcctttttatcataagagtgtggtttatatgatcagatacatgcgattttggaattgagttgcattacgaccagaattatcctgaatgttgtgcatgaaaattacatttcctgttgtttttggttctctttgcgcctgccctacactttgtgcatgctttctttttttttttcagctgctgagctttcaggatgcaatagcctcagttcaaatatatgttccactatacatatgtgtttgctaatgtgctgctttagaataaaaaaagagagttatgaattgttcacttgtttgttttccttctgccccgcatgagctataggtttacctctgcttttatgtcttcaccgtgttttatcagttccatgggaagatctttcgttttcttccagttcctttttttactaattttaggtttatacaggttttgttcacaagaacaacttaggtgctaatttatataaatataatccacatgcacgaacccaggatgtgtttttgtcttgcctgagcgttatatagaactagcttactatatccatgtagataacagacggccatgcataattcatgcctttgtatctatgttataagaacatagattttacatgaagatgttagctgttttgttattttatttacaaaagatgacatgttccaattttagcttctcgttggtcccttatgacattggttacgtataatgtcaatctattgaattatatttatgccgttctattaagcacatttgattatacggtttggtgtttcatgtgttgtgtttagacttttagcatttagactttgttcatcaatatatgtttttatgcatgaggatgcactgctacatagtagtgggatgtgcagttctgaccttctcatccaccttcattatagttaagttcattgtacactttaatttgtttattcttctcagtccacggcgaagctggggatttaactggcattcgtagatttcttggatttgggattggtttgcagcctgattcagactatatggacattggagggtgaagcttggtgagatgctatttatctgtattaggacgtgtgtatttcctgtgtgtttgttactttatataggatttagaataaaaagcgggcagttttatgtgcaggggtgcttttggaggcagatacggtcttcatccacccgacggtagatccgagcatgtgcatttgtggcggtgcgaggcagcaggcagcggccagtagcccgagaaccccgacctcgatgccctaatgggcgtcacgccatatgtgacggagatacgcgacgaattgggggtgagccagggagactgcgcgaaccatgatcttgcgagttgcgagcgctgggcctggccaccgttttcaggccgttgggcaagctaggaggcaag

SEQ ID NO: 8826 - DNA, 1905 bp, Oryza sativa
tttgaacttagggttcgagcccatcctccattctcaacctggatttgccactcatcaagcctcaaggaaatggtggaggttggccaacgtttaccttctactgcagaagcttggtcatcgactgcgtgccttggtgctgtcttgccatagctgcggctgcttgccttgatctgttcacttcttagtttgctaatttcaaacgcgaaattggttattagtggttccgttctaatagctaaatattagagattgatttcaccgagtctacagcttgccatattcatctattatattattaaaacagctttgaaaggaggcaccacattcgttgtgggggctaaaaatttccagtctatgtaggaatacaataaaaaaaatggctgaaattcggaattagaaataagcaatattgaaagaagagtccatataagaacctaatacgagattaatcaaaattcggaataaaaataaaataaaatccgaaattagaaaaaaaaaaagaagaggtccaagtaggaatacaatttaaaaataactgaaatttggaattaaaaataaggaatattgaaagaagagtccatacaagaatccaatacgagattaattaaaattcagaataaaaaataaaaaaagaaaaaagaaaagaaaataatagttcaagtaggaatacaatttaaaattaattggaattcggaattaaatataagcaatattgatatgagagtagatataagaacctaatagtagattaattaaaattcagaataaaaataaaataaaatctgaaattaggcaaattaaaaagagagtgaaagtaggaaaataattttgaaacaactgaaattgaaaataaaaaataaaatatcaaaagaacacaatacgaaaaataaaataaatactgaaattagaaaaataaaaataagatttcaactaggaatacaatttaaaaataattaaaattggtgataaaaaataaagacaactgaaaaataaagaccatctaaaacacatgacgagattaattaagtaacaggcctatacaggagcagagtggtggctgttgatgggacatctgataacttgacgattaaaaggaaaaacaacgggcaggtcgtgaagcaatcggtcaaggcggttggcgggacttgactttagaaagtaaaaaaataaaccttggtgataatcatatttaatttttaaaatctcaattacaataaaaacgagaggcagcgggcctgtataggagtacaatggcagagccattgatggttggtgggtcttatagaaagtaaaaaatgaattccaatgatagttatgatcgatttttacaatcccagtggcaataaagagtatgcggcggacgggtcgtagaagagtatagtggtaatgtttgacgggatttctaaaaattataaaacagatgaaacccaacgagacaataaactctaaaaactataagatctaatttttaaaggttcgggcttctaaataataaaaaaaataaaccccaatgataatcatgtttgattttaaaaactcaatgacaataaagaagagcggcagcgagcgagccatagaggagtatggtgactaagtcgctgatattttggtggaacttctagaaagtaaaaaaaatgaacctaaacaataattatgtacgacttctaaaatagcaatgacaataaagagaagatgcggtggatggtcgtagaggagtataatggcagcgtttgatgggacttctagaaattataaaaaagaagcccaacatgacaataaacctatagtttttagatccaatttttaaaggttccaaggagaatgaatagaaacaatggtaaatcgagcaagcaaataataaagaataatatgacagatgtaagggtagcaacaggtgtgactttt

SEQ ID NO: 8827 - DNA, 3849 bp, Oryza sativa
  unsure (1)..(3849): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagaggtgtccagtaagacagcacagtagctgcgggtgttcaagaagctgggaagcttctagatgtcctctaggacggtggcttcgaatgttcttcttctggaatttgcacctagtatcagctaattatgtgcgctgtattttgcccatgctactgccatatgcaactggtgcctcttatcccccaacagctactgctgcccttttaaaatttgaaagttacggagtaatttcagctgatttttaagtttcttcattagtagtttactttctgtattggttgtcaaatcttaaataaagttctacttataaatatcttggctatactagttcattttccccttgtcttttgtcatggaaggctgcctgttttgtcgtgtggtgacagttctgaacttttcatctatactggagtgctacgtggagtatatacatacaaagtgctccattttgtttgagccgtgccgtgagcgcgtgtccttgaccagggaaaaaaaatgttttgctttcaggttgcagaggacaagaggatgtcggtgccaaagatattttcaaacatactaaccgaaaagggcaccaaaatatcatcatctgaagatcttaacagtatcaagaaagtggttcccagctcatcaaatctaggagtactacgtggtaggagtatcaggctccacctgtacctggtgtcttaattaaggaaaaaagaacagagaaacgctcggagagatgattcagaagcttgacagcgagtatttcaggagtacgggtgtcgcttgctgcgagatttcacaacaggagactgtctgtcacggcgttgctgtaccacctctttaaaatggatcgtgggacaggacagttgacacgtagagtaacactcgtactacccgtttccgctaaatgtcaaaatcttgtacggagtactatctggattaaaattaaagtttatctatgaaaagaaaagatcatctcaaagcatagaaccactacaggtgtacagtacaaaagaaattttactgggcctctcacacataaaaaggagaaggaacaagtccaattaccgtcccttatctttacttcacgtttaattgacatccctaaattacaattggcttgttcggcagaactagccgttgcagcgctgcagcgcaactacagcagccaatcagcaactactcctataggtttgcaacaggacaagcatattaccgcattgctacaatggccatccgctgcaatgcttcagccgttcgactatgactatgctgtacagacgtaaaagcgcaggttggcttgccgaacaggcaaatcttcacccttcatcttagcaaagccgtctaagttaggtccatagcagtatgaagggctggttttgacttatgtggtattctagtcaggaaaagttaataaaaaacgtgtggccccacatgtcagcatccacatgtcgttcgtggggtggtggcgagcgagctcgtccgggcaccgtgtgaggaaggtagaggcgagagagggaggcggaggcggctgacgagcttgtccgaggagaggagagaggcaagtgggcggctagaagaggaggggggtgaccgggtaaggggtcatcgagctcgcattcctcacggcggtgtgcaagctcaacctcggtgacattgggagcctatgcgagagaccgtcttggatggtgcggaggtggaagcggcctcggcctccgcgagaaggtggagacaaaggcgactgtgggtgggcctgccgcgccaccagccaccgccaccacagatagccgcgatgccgaagaagatggtcgtcaactcccatgccaaggcaacccgcgagcgtcactatattgtggaggccgagagatgtcgggactgcctggagagcgccaaggaggagtattgggcgcgaggccgagagctccaagtcccgcgttccgcgccacaaggaggaggatgccgaggagcacatcaaggctgccgcctgcaatgccggcaagcccctccaagatcaagcttgcccagcctccatgcgagggaggcggagatgggaaatatgggggagggcggggacggctccaagcactggggtagggacgattataccatgcgaactcgtcgcgcgtcctccatgtcaacgtagtcgtggttgcctggccttgagcttgaggaaaccgagagcaggccatgcttaggcattgccgctgtcgttgttgactcgtctattgcgtttccccctcccatagctcccaccatcagtcgcgagcatggccgccggcagctcctcgaggcagatggccgtggatctcctgcaaccgctctcctcaatgtcgtctcccctaagctatggcagtcgcgcttgttgtctcccaaagctacgacggttgttctcctcgacaccggctcactctctgtctcccttgccctgtgctcgccgccacctttacggcggctctagaacatgagaaaggaacgagaggggagaagagaaagaggcacttgcacgtgtgtcccacatggtatttttattttcttttgctgactatgacgccacgtcagcgaaaccatctatccatattactagaggacctgagttaaacggttttgtcaagatggaggttgaagatttcgggtattacggttcaattttgctacatatttatcgacaaattttctcccaaaaatttgacagatgtaattacagtacaatcgtactgtaattacactgtaacttgtatataattatactgtaactataatgtaacttatctgtaactttcaaaaatctctccgtaacatgttatttcggtaaaatggaggtcgtgggaatcctttcacatatgtgtagggatgaaaatggttcggatagtttccgtccgtcctgaccaattttcggattcggaaaaattcggtcggaactatccggaatttctcggattcagaaacgaatttggattttttttctcggatacgaaaatgaatacagtaagggtgatatccgacgaaatcggaaaacggtcggaaactacccgggatttttcatccgatatccagtagtttacatgcgagcaaaagggaaatttttcagcaaaaaaaaacccgaaaccctagccggccgcgccagctttgcgccacccaccgccagccgccgaatggccggcgctagatccatgccactgcagccgcccgccgctggccgttgtggggccgaccgccgaacacctccctagggcggcggatccggcccctcacgagggcgccgccgccggatccgccgccctcgccgcctgccgctgccgcccaccgacgccatcgccggctcgccgcccaccgaagccgtcgtggcaatcgagcccgctgccgccgcccgccgcgcgagcccgcccgtcgccgctcgtcgcgtgtcgcgccgctctcggccggccgccgcccgctcggccccgcgtagtgagatagaaagagtaaaaagtgtgtgtctgtgagagagagaccagagcaagagtcaagagaagataaggttgggaaaaaat

SEQ ID NO: 8828 - DNA, 21369 bp, Oryza sativa
ttttttttcaatgtaaaaatcgattttttttacatgtggctctttaaaacgaattttaaggaactaaatcaactcatataaaaaagttgtcaaaaacaaagttgtataacttattgagatttaccatttttcttttggtcatttccccatccgagttttattgaactatataaattttgaattttaaaatataaaaatttaaataattttttgggtagtaaatgatttcaaatgaaaaaattgtcaaaaacaaagttgtataacacatcaatatctacaacttttgttttggtcatttttctatatgactttgtttgaaccgtttgaatttaaatttcaaaatatgacaacttcaaacaacattttgaaatactaaatgatttcaactgaaaaagttatcaacaacaaagtttcataactcatcaagatctataaattttatttgggtcattttttcatccgacaaagtgatagtaactttgttcacaaaatttacatctatctcatctggttctatagactataagagagatatgtaaactttgtgaacaatgttactatcactttctcggatgaagaaatgaccaaaataaaagttctatgtcttgatgagatctacaattcaaaatataaatgtagttttatgttcatgacttttttagctgaaattaattacagcttcaaaatataatttgaagtttttgaaattcaaatttttaattgataaaacaaagtcacacgaaaaaaaagtccaaaataatagcggtaagaatacaataacatgatagagcatgattttggaaacatttaggaaaaagaatcatccaatttggagttcatatgagtgagataaactagttttaaagtttatttttgcatacggcttcttaagacacccttatggaaaaattgatttttccatgcgggtccttaagtggtccacatacaaacaaatgaaaaaaattcaattattaaaaataaccactcaaatttttaaaaactttcatgttcaacccaaaatttaaaatattcaaccaattttcaaaaatttcaatgtgcatgcgaaaatttcagtgatgcacattaatttatttgttttatgataacataaatttgtatggaaagtaaacacaacattttctatctcccccttgcccttataaatagagataaaatttgaaaatggtgatgttttgtttttgaaaactaatggctacagctcttccttgatttaagaagcttattttgaggggtcttaatattttgataattattcgttagcgtattcgtttcaattcgtattcgctccatacctgtattcgataatattcgattccgttttcgtatccaggttttcgattccgagaaaaaaatatgaaaacaaatatgatagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgtattataattatatctgtcaaatttttaggagaaaatttgtctgacaaatgtataggtggtcccttgcggttttaggggtgtgaattaaactcaacgtaaagacgagagacgtcaagtggacttatttccaaaggagaaatttcatacgggacgtgtttctcggcccagcccaaatatctagagtacgtcttctactcatgattacgtaaataatgagagacgctatttactccgctagatcagccaccttctcctcgccacgtacgacacaagcagccactcgcgcgcacatggccacgtcacgcaaaacccgcagaattacgcgattcgctgagcccttttctgcaaaaacacgcagcctccctcttctccccaatctagcccgtgacctcctcgccggggctacttctccatcgccatcgacctcgacctcgccgcctcctcctcctcctcctccccgtgcgaactccgggctcgtgccgagggggtggacgcgccggtggtgagagcggacgcggtgcggtgggccatggcggtggggtggcggccggcgatgctggtggtggtggtggcggtggcggcgtggcgcggggaggcgctgtcggtgacggtgaccgacacggagtgcatccacgagttcgtgccctacgagggggacaccgtgtcggggaacttcgtcgtcgtcgaccacgacatcttctggagctccgaccaccccggcatcgacctcacggtgcccgcccccgatcctcctcgtcttcgttgtgcttttgattttcgatgcaaggatctataactagatgggtttatgggtttgttttttcgtgatctggggcacgctggattggggatcaggtggaatcgtggtcctctttttgcgatctgcgatttcgcggtgcaaaagtttggggaaatttggtgatatgaagatatttcatgaataggtttcgatttgattttagtttatgaactaaattaacttggcgcggtggctgttcttagtcaattcgttggagcgtggtgcaaacttacgaacttttcgatgatgtttcgatggattggcatgctggtctgtagattttgctgcgtgacagggtcataggttcaactacgtgatagtgtgtttggtggctttccactgatctgcttataaaagtcactacttttagtttgggtggttagttttggccagtggcaaggtgttccagatgattttaccttgtcctgtagaaaatttaagcaaggttcttctctattttcttgatcgggtgtagagtcctgtctcttatgttttggtgatcttgttttaaagttcacactttaggcgttttggggaggctgaacatttttcacctccattgatgccagaatcgaattgttcgctgtgaatgcccctttagtttcttattaataccctgatatagaaaggtagatgaacttgatatttcttcccaataactgtagtttaattgaattatggctatctataaatcctcatcagaattcatttataagcaaactttggagaatacttgtgatgcagtgtttcttggagccacttcatttgaaagaaaagataatgtgccaatttttgcaaatgtgttcaaagcgcattctgcactggagtgtgttctgatcatcacacataactaagtatcattgtgttgcactatagcgttattccactaataaccttgtctcacttcctttcgtgatattttgtgctctcgtggaatgtaggtaacttcaccaggtggcaacactgtgtatacattgaaggggaagtctggtgacaaatttgaatttaaagctccaaggggtggaatgtacaagttctgcttccataatccatatggagcacctgaaaccgtttctttctacattcatgttgggcacatacccaacgagcacaatctggcaaaagatggttagtgttctggtcttttaccttgaccttttcgcttgtcacagtctcatatctgcttatcacgtcaatttatttgttttgagcattgaatcacaatcagtttaatatgcgatcataggtttatatttggtatgttcattttatatttgcgtacataagctatatttggttgcttttgcagagcacttggaccctatcaatgtgaaaatagcggagctgaaggaagcattagaatctgtcactgctgagcagaaataccttaaagcccgtgaagctcgtcaccgacacagtaagcttaacaatccttttgcaaatggtcactgaagctttggcagtttcctataatcctgcgtgtgatatgagaatgcataaatttgtatgaattttctgttggtccactcaccaccctttccacatgaagcaagaaaaaactgatccgttattacattttaaacactacaacattatcaccatcagaaagaagagcaaatagggatagaatggctaatatatgtgactggaaattggatattatttaatttggtttgtgtttaacgactttagcctgtccctttcttagagcacaataaagccacagtttgagtgagacaaatttctgtctggtctcccacttttgggctgttcttccattctgtctttgttcatctctgagctacctaactttcctcctttgttcttccatactactttctcaaattctgatcatcaattcttagctatacattttttagggcaaatcttgatattggtaagtgttaagttagaacctagtcaggtgggtcgatgtgttctcagtcaggaaaaggaacttgtcacctgttgctccaaaaagggagaatatcctctttaactaatatatgttcacatttatggtaattgatgtttcacttagcttctttgtaggggaatatatctaaagttgttttctctttggcttaacatatattcccctttatggtaattgatgtgctatatatagctttttcttgctcttgtagcatgacgtttttatgtattctatttttcttatcattatgtgatcgtggagagcttattttgtgttaataaatccagcaaatgagagcacaagaaggcgtgtcatgttctacacaatagcggagtacctagctttcatgggtgcaagcgctttgcaagttgtttacatccgtcgcctattcagcaaaaacgtggcatacaacagggtgtagaacagagtctacttcaaggcagcagaaaatggttggagcaggaaaaaaatatttccaacatattgtgttagcttttgcagccattttttttgggtttagtctaaaacgtggcacttttaaatttattgccttgtactttagaacttcagtgagatatgaagcacatttgttgctgaacaagtgaacacagatccgtaactaatcttcaaagggttgatgtctcaaagcaccacttgtgttattgtgttaatatgacttatgagggtcttcgttctgatataaattgatcaaattttatcctggtctatgcaattcattcaaagcacaacgtttcctcgttatggaatgaaaaggaagtgttctatgtcaccgttccagacaactataacaggttggtccttgtattctgtacatgtaaaactgcattagcagtatgtaaagttgtctggaatcatgttaaacattaccgacctaccatgctcttaactaagttactatactggaaaactgatttaagcttattttctagatgaactcataaagtttgaatccgaagtaaacagcaagaaggtggttaaacacacagagtagcaactagcaaacactaaaacatgaacaattaccatatcaatcacttgttgcacggcagcagaagagggaaacataagcaacagaaaaggcatataaaaagtaaattgtacatgtattgatcaatatctcagtatataaggagatctgtttgtagtatacatttgcacatctggacattttacttcaaattggaaggaaaaaaaatgattcgttcctgatgccattttttcctctttgccagacatgagcatgtagtaaaactgcacacgtgctttcagtttcagttcatcacactcttggccattgaggactaactacctgcagagttgaagttaaaaaccggtcagcaattagaatttttcattctgcttagtgtttgtcgattgagaatgcaatagggtacgaacctctaatgtactgaaaactaattgcatgcgactagctactactgatggctcctctgaactgcccgtgacagccatttgttccagctgcaaagttttcactggtaacctgcaacaacagttttgaccccatgcatatgatcataatcataaaacttgtaaataaaaagagaaacattgctaatttcaaattgtctcaccatgccattcctttggtatagtaagcgttcgctattaaggcacaaaatcctttccactgatgcaaaacgtcagctgacactggtggggtagtagaccatctgatgatcgttggttgtggtgtgcacaggattgtaatgaatactatactgagccacaggatgcattcacggacctaccaaaaaaaggggaaattctcgctaagacgaagaaatgaaagcacaggtcttatcaagtgtgtttgcatggtaaatgtgttctccagcagactacatgataccttacataaagcttcatatcttgccaatgcgacttagtggacttcatctatcgataatcattaacaaattaaaagaaaaagtaaagacatgatgatggaaaatgcacaccaaaactcttccacttgtgtataaagactaaagagcatattgtcaatgaaattagagtataaagcaaaggtaactgtaaactgagcactttatgttgtgctaacctcaaaggagtgaactttgaaggtcaagctggttcctcctccattggaccgcagagcttcaatctcaaggccagaatcttcaatatccataagttccttcctgagcccctcttcagtacagcctagagcatatgcattcaccccagcactaacaaactcctggcaggattgaaagcaccatattgaagaaaagttatgtccagaagagaggagaagaatttcagcgagaaacagtaccttcaggttatctccacctcctcggtcaatgacatttttatatcgcttgaataggctgattgctatattgcgtgatgagcggaagtcctcatccgacgaagcgttaacatgaaaccgatgctacacacagcacaatgattcagagaaaaaccaagagcagccgaattcatcaaaaggaaggactttgggacaaaatctgtaccagccaatgccttgtagttctttcacttaaacttctatagagataatggctcgccctggtaaagttaactttgcagctaggaacgatgtgcggcttctgcacatgatgcccttccactggattataaaacgcactgcaacctaataggttgttatgaggaactatggcatgctttggtgatgacttgacctcttggtaagcactcggcctaatgaacagagcggttccatgtagcgtcagcatgtctggatgctcatcagcctgcaagccgtccacacatttctccaataactggagagtccttcagaacttgccaacagttcaatctgcaacaaataaagctttcatgagtcattcgcaactattagttactccacagatcacacaacctcatattcagcccccgaagcatgtgtatatgtgtatacaagtgtgcaaaatgatcaataacagtgtttctttagggggtcaaaacggcaatgtttcccacacatggtatcaagatgtaaatagacacccaaaaaaaaaagaaaaagggtatgcaaagtgtatgttgcctcagtctgtatggtaccgaacaggccaaaattatgggaattttttttaggaaaaatagtgtagtacttgctatctacagttggtaacataagcaagatatgctaccaacaaatgcatcgcatggtatcagttgatcaaaattatgctctcgaaaccaaaaaaaaaaaaaaaagtgcacagaacaacccacaaggccaccatctcaggaagccaaaaccacacccatcttcctgtactgcctgaaggattgctacctgtatcattccactaattaattaatcgcagcttgttcatctcccataaactatgcggcatcatacatcatgaaatcagtactacctaattctgaaactatcgcttttcccccttccaagattatcggaaccggagaatctacctacaagatcgcgaccaaaacacgcaagaactcacatagcaccacgcggaatcaagaaaccgatcagaaacagcttgcagatgaggagcgggaggggaatacgagcggatctttacccgggaggggagaacagcagcagcagcagcggccggaatccggaggaggaagaaggggatgaagcggttgaagtggaaaatataaatacgtggaggggttccgtgcttaaaaaatataaccccactgtgtgagtgacggagggagaaatgtaattcgccggaaattcaggggccacaataaaaaacgactggatgagtggcgacgggggaacgcgaggagaggaaacgccggcccatcgctctcgctgaatctttgtgttaaatgggccggatgttggggctcgttagaatatgctgtttgggcttctttcttagttgggcctggcccatacacaaaatattatcatttttttggtttgtttatattaacaaaatggcggtgagtggatctagcattgaagccaattctcgacttcatttcggtgaaaagaacatgatttcgggttaaaatctcagccatgacagaaaattgtaagctcaagggtctttagaagaagggggacacttagaacacatgaattctacaagatttttattgatctttagttcagaattcagatcctttaaaattcctctgtatcaaaggtggcctaagcatagaatcggaacttttccctatggaacgaagtttttgaatgaatcaatgcatctaacgaaaccaaaaaaaaaaaaaggaaacctaaccctccttttatgcctgcattttgacccccatcttgaccaaatccctgcaggcgtgtgcaatgctaactcatccgcaaataattaatacaaatgtatcatccttgtacattcctatgatttagtcaaacgtgttaaggagcagaattggtctactggccaagctagattcagatatgaattaagctcaaaaacaaacactccatgacaattccataatcccactgctcctcttgattcccctggtgatatccataccttacaattcctccactactcccttcacacctcaccaatgctgcaatgcatgaaaatgccatgattgagctgtaccattgaatcattgttcttgttcattaggattgtgtttttttctagagaaattagaatgatggtggagtatttatcacctaggtctaatggcatgcatgtcatgtcatgtcatgtcatgtcatctttattttaactcaaaatatcatactccctttaagaaaaatattcacggaatgatgctattaaatgaattagtgaatgagctgattattgagaaatgcatctagtagttgtagatgagaaaagatgtcctgatgggattaattaggaggcttttatgacgccatcacaacaataacaacactgcaacgcccaaaatgcaaaaacatgggagaattgctagcaaacgtgtcaaccaggagattcatctctctcgcgtcgtactcatcaatcatcattcaccaaccagataatccacacagcacacgcacaatgtagaagctaccaacaacttccacctgtgtgatgttgcttgcattggagatgcatgtgcctgatcactgtgatcttacatccctgatgattaccctatctatatgaaggctccgtttggtcttaatttgttttcacctgatgttgtcttgatcattgaaagataaacttagtccaaagctatcttcaaagcaaccgattaagttactctagtttcataccaccatttcatgattaaccatcataatctgcaaaaaagaattcctcaaaaatcttatatttttaaacggataaagtagtgttctctcatcctttggttattagcggtagctgaaatttaaaattttaaaattaatttagaggatctatcgtcataatttatattttagcattaactttaaaccactaactaatggagtaccattttacctataaattgtttcatgatcatacaccctttatctccaaataagtttatttccaatctatctcacacatatcaatacaaaacaaataagccataatactctcgttttctcaaattccaatacaacttttttagaaacacaatacaaatcgtaatttaattttattttattttcaatgtatttttaaaaattttataagctataatctaataattaaaatgttgagaaaaaagaccagggtgtagcctcatagcgcttctgtcagggtaatcccaacccataaactattaattagttttcataatttctatgtcatatagacactatatatataaattatatacccaatggaaggtatctttaattaaattcttatctaatcaccgcttttctctctttttatctacatatcctttgttttaattcctgattcctgtatagagatagtttcttgtataagaaatagtttcatttatctttttacctctctttttattaattctcttataacatcaaatttttatttatgtggcagtggatttaatgctattcatactagctaagacggagggttgagattggccagagggacaccgtctcacaggcggtgctggttttggattgctaaatatgatgttgacttaatcctttgccatttagctgtctcgctttacgctccgcgactcccgctcttgtcctaagactttcccaccttctcccactgaagctgcatttctacatggttgatcgatgctagctagtgtaaaggagttcatcatcctagatggcttagctaatgatttattccacttgcattagttgtgggaccctgcaagcacaaagggatggtggattcaaccaccgttaacgtgtcttaactaaaaatagggactggtttatatgtactaacttatatattccctaaagaaaaactatatatttatgtatttatatatagcaggacatgcaggaaagctagatgctcatctacttgtttagagttgggactttggattctgatgggaacagttacaatattagattcaggtggttaatttaagatcatgtgtatggaggattgggattcggtgacattgccccgtgacattctcggtgacattgagtcactgacatgtggtccagtcacatgtgggtcccatatgtcaatgactcaatgtcatcgagaatgtcacagggaatgtcactgaatctgtgttcgtgtatggataattttgtgttgattagtacaagagatggatgtcatccatggttttcatctgagattttttttcggttttaattgccgtgttaagccaacgaaagatgattcccgtcttgttttaaaaaaaaaaaaatctcgtttcttcttttgtctctgtcatatgaggtgtgcatagtaatgggaagcgggtacaaacaaaacttgcactgcgtagattggtgaaagaaaaatcatcatcgttgaaaattgttagttttcgtgaacacgaatgaatacaagtaattaagctgtttatttcaaaagttcgctatttcgagaggtttggggttaactcccagtcaaaatagtagtaggcactcaataatatagtaagacttggcctggtttgatttaagattgttgagcgggttattgtcatgtattatccacttaattactacctctgtttcagattatcggactttttagcattgtccacatctattatattatcttctattatattattaaaggaatagaaaaaggagcctccacattcgctctcatgccctagaaattctcacattaatcgaagaaaaagaaaaagcatagtccatatagatatacaatttagaaatagctgaaattcggaattaaaaaaaaggaatattagaagagaagactagagtccatatagaaatacaattaggaaataactgaaattcggaattaaaaataaggaatattagaagtagagtatagagtccatatagaaatacaattaggaaataactgaaattcggaattaaaaataaggaatattagaagtaaagtatagagttcatatagaaatacaattaggaaataatagaaatttggaattaaaaataaggaatattagaagtagagtatagagcccatatagaaatacaattaagaaaaaaaataaattcggaattaaaaaataaggaatattagaagtagagtatagagtccatataggaatttaaaactaactaaaatttggaaataaaattaaaagtagagtttagagtccatataaaaatataatttacgaataactaaaatttgaaattaagaaaaacatgggaagaagagtttaaagtcaatataggaatacaatttagaagtaactgaaattcaaaattaaaaattaaagaatattaaaagatgagtttagagtccacatagaaatgcaattagaaataataaaaattcagaaataaaaataaataatattggaagaagaacatagagtctatatagaaatacaatttatagaaaattcggaattaaacaaagaaatattaaaagatgagtctagagtccatataggaatatatataatttacaaataactaaaatttgatattaaaaataattaataactaacacgtatataaaatacaatatgaatattacacattagtagttttgcaaagttatttaaaaatttaaaattatgttatcattttaatatatttgaataatataatgagaaaacatatatgctattatatgagagaaaatataatgatgctacccgctcaatctgcgcgggctactatgctatttcatataaatgttaataaatctaggcacacatatatatctatatttattaagatatatatatgaatgtgggcaatgctagaaagtcttataatataaaatggaggaagtataaaaaatagattgataaataacatttttatgacggttgataaataaacttaataaatagcttcaaacaatgctctttttttttacaatgcaataaaaaatttttataaaaaatgtattgtcttaagtgtgaattgtgtaaagtaatgttaataatactgtctagtgaaaaaattaaaaataacatgagtcgatcatggaagggtaatttttgctcggcctcctctacatacaaccggatatatacaatatttttaattagaaacttagcgctttaaacagagaacttagctctcaaataacctagtctgaaactcactcctacagagatttgaaatcaggatattagggtgcttctcgggctagaaaaaatcattgggagcctaatgctgcgttattttcagctattgcaatttagctactactcgactttcgttagcacacttttcaaatggttaaacaatgtattttatgtaaaaactttatatatataaactgttttaaaaattctaataaatttattcatcaattttttatatattagtacttaatcaatcacatactaatctcgtttctcattttgcgtgtggctaattagctgtttcaaaccttcgaaaagaacgcagccttatatctcatattctcattgtacaatatatattgtggcttttccagcgttttggtcgtggctccgttataggaatactacttagggcttgtttggtacagctccaactcctaaatttagcttcagaaattaggtctagagtggagttatagagctgcctaaacccagctccacaactctagttcattttgtgagagagctccacccagctccactcccagttttggtagagctgaaactgtttagctgggtagagctaaagttggagctgtgctaaacagacctttaattatctggttcatgtgcgtttttatggtggctatgtcatgacattagcaccgttcaaattattgtgaggatacaagtccttgtgtgttgcgacctctgtaaagggaatgacatatcagttcataacctcgtgacagcttaactacaagctgcaggaattggtctatctatcctgcattccgctctctctgcccacatgggttgtgtgcatactcttcctcttttctctctgttttttttttttgacaggttctctccaaacgtgccaattactacaaggaattaatcgcggttggttcgatcgtatcgattctctcttcctttccctttcccctgattggatcaacccattgaccgatcgatcgacctcaaaaaaaaaaaaaaaaaaaacggtcgcacccacgcacgcgcccgcgcaagaaaatctcccggcgtccggcgacggtgacgaccgccacgagtatgatgggtctatttagaagtttaacattcggagtgtttatttgaggagcaattttacaatacctggtatcataagaataagtataaagataaagatcggtatggtctctacgttaattagaggctatcacgttacaatagttaagacaatattgtctttaaactaaaatactttcttactagtcatcttttctttattagactcaatgcaacgaaaaatttcctaataaatactaagagtcgactctatgccgttgtcatgcgtagcaactatctttctatttccttcttcctttctcttccacgtcaccaaatatacttgcatgataataaagagagaccactaataaagaccattatacatgccctaaggtaacactttttctattataaatttagtatctcttggtacctaagtactatgaagaactaaattttacactaattttttattatcttatggtatctcttcaaggaccgtagaattgctcttatttgagagtttaagattaaagcagctgttgatattccaaacaaactggtaaacccaggttctggctttttattcgttttatggattctacgattacataatctcaaaatcagggtagaaactacagccgctataatataggagaaactacagccgctataatctcttaaaaagggttttgagaaacagctgattagtagttaacttctaataacctgaagatattgagtttttagtctctggtttctaattcgttttctagattttacaattatagctttttaaaatctggatgaaataattgtgagagaaactgcagccgtgggaaactccacaaacaaacccgatgtcgagcggtgccgtgaggcgaacctcccaatcgcgcatgcgagatctcaccatctcgtcgccgtatcagcccgacgaaccggtccgtgcggcgcggtgtctctcgcgtgcttccgtggacgtcgtggtctcgcaagactatcgatttatttctacgtacacggtgctaccaatccatcgatgctgactgctcatcagcgtacatcgaaaattcgaacatatatactcccactactgacgacacagcatgttcttcgccgctgtgagcgcattttcatataggtcggtctgaaattgggattaagctaatcaagcgagcaatcgagacggatatcagcacatagtacagctttcagacagattaattatcaaatattagtataactggttttttattagtccatgatgacaattaatcagactagttcgtgtatatatatatggccatgcatgatcgatcagttgcttgattttctaggccggtttaatttggtcgagatggaacatggcatgcatgcattcgcgcctgacggagctagacacgctccgtgcatgcacgtactgcacgaaagctgcctttgctaaatccccttctgattaactaagattccatctcccattttttttcttgaagaaaatattcccaaacctaccaatcaaactaaggcacttaataagttcatccacattcgtcgacatttttatatatccttttggttccatcaccaatatattatatatgcgattcttgatttcgaccaacaaggtagaaatcttattggtccttcattgctcaatccctgtttaagagctactcccccctatcaaaatataagtatttttagaatagtgccaagtcaaattttttaaattttgcctattaatagtaaaaaagttaaaaatattaatcatgtaaatttgatcttactatatttatcattaaacgaaatatcataatatgcaactatttttatttaaaacattctacttttaaaaatatttttagtaaaagtagtatctcgaagaccatgtcaagataaaaaaatacttacattttgggacggagaatgtaccttattattattttctattttctgggtcaagtcatgacctgatcctgcaacctgcatgcatacataagcgtagaccatgtcaagagaactcgataaacgtagaccatgtacatgtaacttgatgagttgtttaatcatcgtgtgattaattatctttatatacactgtcacaatcgtcgacgataatgtcaatactccacctgcagccgcctgcatcaccgttcgctaagctgcgtgcactgcacaacgtgatttcacacggccattttcactttttggtccaagcttagttaggccccgtatagttcacaattttttttcctaaaaacatcacatcgaatctttggacacatacataaagtattaaatataaataaaaacaaaaactaattacgcaattagggagaaaatcgcgaaacgaatcttttaagcctaattagtccatgattagccataaatgctacaataacccacatatgctaatgacggattaattaggctcaaaaaattcgtctcacagttttcaggtgagttatgaaattagttttctcattcttgtccaaaaaccacttccgacattcggtcaaacgtccgatgtgacacccaaaaattttcttttcccaaactaaacagacccttagcttacggcttgaaattaattaactagctctcgtgatataggttttcaaatattttgtttagtactttcactagtccacgatcaattggccacacctaaaaaggttaaactgcgtggtaacttctccggcactgctaattatagccaccatgtgctcggtttaacattcgctaacttactctattaattctaacggacatcgagagtgggtatgtgtcaactgtgaaaagtacacacctcgaaaattagttagaaaataagctgtcaagtactgtaagctctcacgtcatgcctatgccgaaatggaaaaaaaaataaatcgtaaatcccataagcacaaaatactttagagttacatgctaatcacacatctgcttgagatttttgtttagacaagcaaatttgaatttacaagttggtgttatcgactggaatatattccaacgggacgtcaaacatctccatctccatttccctatctaatcccatagcctaaccggtttcggtttagtttaagtttaatttgaaaatttagcagcgcctttgtccctacgcctgctacgtcatcggggcggggatccgcatccgcatccgctgcgcggcgcagagcagcgaacgctcgcgcaccgaccgtcggatagccgcccgcgtgtgcatcgagattcgggctgaggcgctggttcgcggtggatcaggatttggtggggcccggccggccgaggcgcgggggcgtggggcccacctgtccgtgtccggaggcgcgaggcccgcacgtctgcccgggagctgccacgtaggagagagaaagtctgacgtggctcgggcctcatttgcggggaagccctcgtcagtcgtcaaaattgctcgttgtttgtaagcagacacgaaggttagtactaggagccaaagattaataaagaatacatttattagcattcgaagatgacagcaagatttttaataatttggttaattcaaagaatctgctggagttgtccaaatccggataataaatttgaccctatgtattgtacatctccttagttaatcttcatctaattcaggctcgaatgggaccattgttgctttaaaacttgttcggtatctcttaggcagtggtttttgttttacctaaactacacaattttatcctttgcttcctcttacgataaatatgattctttgctagtatatattcagtatgatagcatttcgataactttctttatgaatgaaattccaacgtatatacattttataaaagcctttcgatccctcttatagggacaaagatctaaccatttgattacaaatctaacgcctaatgatgctctcccgtcgtatttactctaaaaacgtcataccccatctatgtttattcggttatagcatcgtcttatcatttcttcaacctcaacatatccccatctcctcctaccttgtaatgctactcagatctacgtgtttagatctgctcattgattttatccacatctccttctcttctcttggtatttgtatcagccgccaccactagtataatcttgcttcactcatattctcatgtgccaaaaacaactttagggtttcgcctcgaagcaaatagagtcatcaaaagcttacttcatcaatatccatcggtgacgaatatagatgagtaggagttgattatgtcatcggattctctaacactcttgttttatccctacatccatcgagggcgcttctcttgattggccaaatggtatgtgtttggtgtttttgccaaataaaatattatacattttctctattaagttatattcctcactctaaatttattattattcctttaactgaatattcaccgaacatatatataaagtatcatactatttatattctctctctgtaacatgttaatttcctgataagtcttacattaaaaagtactccctctgtcttataaaaaaccaacctagtaataaatataacacatcctattacagaatctggatatacatctgtccaaattcattatactagaatatgtcatatccaatcctagatttttttttggacggatggaataggcaccatgctctctagaattttattttttaaaatctatttcaaatacacacatcaagcttgccactttcacaaaggaaaacaaaagataggtgagtcggaacaggcaaaacatttttctcccaattacggtagtgcgaagacgtcaagcaaaagtcacaaaagattttaaagtaaaacgcacacaaagtcagacgaggttagtaaagcctagttaacgatgttacccacaaggccattttcttttcacaataaaagaaaaaaacacaaaaatggacaaggaagctaacaaccaaatcacccaccaaatcgcacagttcacacacaaattacaaaccaaacagagagagaaagacataggggaaggaagagcgcgtcgtcgaggaagacgagatagcgaggaggcgcgtgggagaaaaggaggaaacaaaagggagagaaaaaggaaaaaaatataattattacaagcgagggagagaaaaaacacaagcaaaaataggggcaggaggaggaggagggaggcgaccagaggaggagggaggcaaaaggcccgcgcacccggggaggggaaggaggaggaggcgattttttgttgttgttggtgataggaactaggtgggtgggaggagaggaggagggggggggggggatcgcgtcggaattccggcgaatcggcgggatccggccgggatctgcgcggcggatgaggggtcggcaccatgaaatggtcgacattgctcagtaaggtcgtcttcgccggccagcaggagcaggagcagccgcctccgccgccgccgccgccgccggggtcgtcgtcgtccccgctcaaccgccagaagcagggcgaccccggccaagccaccccgcggctcagcgccgccgacgagggtgggtcggtcggaggtggcggcgtcgcggcggcgtccgggagctcgccctccgccgtctccgcgtcccctgccaggtaggccacgccacgccacgccacgccacgccacgccgtggagtcaaatactgtccctcgcctgaatccgtcgtggtgtaggcagctccgatgcgatcctgtcgcgtgcgttttttcggattgagcaatggcaatcggatttggatttcgagagcgttcgatcgtagatgctttaccttttttttttcctcgttctctgcgtgctttttttccccgtgtttggagatttgataggtagatgcgggattaggcgtttgatatacgctttgacctttgctggttgatacacctgatattgtttttagctcaagcttcccagtaagttccaaatttttttggttttactcatacggttccggggagaaatgatgttggaataagacggtggttggagatgcgttagctgtgtggtcagctcatggatttcaattcgtctgtacgctgcctattgcctgtttcttttggttttgttatgcgtttgcattagaagcgaaatttgtatgagctcttctagagatggtgggagttttacttgtcacggttgatgccaaattggtggagaacttgatgaatctgttgattcagcattcatgtttgcattggctgtgctttagtaataagattggtgcatgccattttaagacactgtttaactttgatagtgttcctgtattgttgcctctgagaagttgcttgctaaatttgtatatccacttagtgaaatttgattgtattactaggattatattcatgtccctattggaaacaagtaagtagtagtaattttatgtgttggaaattttgacatatttaaattcaatggcattattgtttatgttatacatctgagcacaatgtctataataaatgctaattgagcacgcatgttattgttctttatattgataccatgacgtgcctagagtgattaccagtgttagcattctctgtgtcctcttctgttccatggtaataatattgactgtacaaccgttgtaattaaggttcctattgtaatcgatgccatatatgaagaatacgttctatattttactgtagaatggagatttatgagctgttttcatttgtatatgcttgatacctggttctttattcagatgttctcttgtcatttcttcagcattcaataaatatcattaacctaccaagaaagaatagtgacttttgcaattgcattactaatgagatatcgtgagtctcatcctttattcctttgtggctttgtctggactctggactaccactagatattatgttgttaaagttggtaacttcgttgtgtgcgttgtttcaaggtgttctgtaacttaaacttgtattgtatggtaactggcactgggaaagggataatattagagcctgtataatgttatagttctctctcgtacttgttagttggctagttgcccttccaatccttgcatggcagttcatgtatttgtaggtgtcatgtcaggcattcacattatatatgcatcacatggttctgatgcatggattgtactaagaatgacaaaacgaggcatttgatccctttgcttcaattattctccagaattttatctgctgtttcaagtgaatttcctgcaaaaatttctcagtttgtactcccattgttaaataaatgttcttaaccttgtatttgcaggggaaaaaa

SEQ ID NO: 8829 - DNA, 15096 bp, Oryza sativa
aaatctttatccaggtcgagttttgttaacattcttgtgattactacaggttagtagaagcacatgtttttgcttttgttattggaagagctttcgttacagatgtggaaaaactaagaattcacagtaagggaagatctttgcgtgttgctgatgttattggtttcttttcggagatcacagaggtcagcctttataataatgcctataatgcagtttccaaatttcatgtgaccatacattctctgctaacttctattccattatccagcttggcatatgtccaggttcaaatttgttatatgcagttgaagttcttgtgacacaggttcgtgcagtttctcttgttaatatcaaatcattctgttttctgttatatttaatctcccttattatcttatcaggtgttaaatatatataatcgtaaagtcaacaaaactgtggtattcaagttttttgtgattgtgtttgtgtaaatttttactaattataatatgatgaggagggcacatcattgtgataaaagctatacataggccatatatatactccaggtgttatttgaaattccttttgccttcaaagctattatgaacattggactagtgtgttatatttacctctgtaatactgttttcatctttatatttatatccaccttgtcctctctgtaagtatacagtatgagccatctggaggacaaaaatgattctaaacatctgaacaagagcagtatttctactacaaaccttgtcaaaacaatgttagttcttagtgtactatatataatcttgcatatttgtgaatagatgatgattgtcaatgaatgttgcaaagagaatctgtatatcgaagcaattagccattaagtgtttggtgttaattttgggctggttttgcaaccgctaagtcaagttatggtatgaaaaccaattttagttccctgttctttcctttgcaacctttttgcattgacaatgacacatgtaataagacaaaaaaagagaggcatctgctttctgataaaaaaacaaagcttagatatagtaaggaatgtgcaactgacatatggtgtttcaaatcggctaaaacaacatttgccaaatgctcagagtaacatgcttttcatgtttaatttcttggttacagactatcgataagcagcctctgttggattctggtattttgtgctgccttatatatatcctcaattccctattgagtcctgatgaatcctcccaaaaatcctctcctgttggtcaagaagtttcaaccagtgagaagagtaaagattggggtcctatgctatcacggcgccttgaggtaataccagtctcgtggttcttatataaagaggatttcctttgcattattttttaaagaactcgacgcaaggggagagaatcccgaaggcattgcatttaaggtcgagaaaaggccctgaaagctggcacttacctgtatgggaacattgttgtcacaggctgtcttaacacttacttttggggaatacacagagaggtaccttttttttgggtgagaaccaggttttgagccctggttggtagcctcacaactggaggacttaccaccgtccactgtgcataagcacgttctcacctttgcaatatcatatactacctccttttttaataaatagcgccgttgatttttggcatatcgtttgaccattcgtctcatttaaaaattgagtataaatatgcagaaatacaagtcatgcttaagttttctttaatgataaaacaggtcataacaaaataaatgacattgaataagatgaaaggttgaatgtcatgccaaaagtcaatggcatcatctactgaaaaacagagggaggagttgttaacttattctgatgcaaaatcacaacttgttaatactttatccgctgaacttcacatagtgccatgctggagtatccatctgaactaatacaaggcattcgttttatgccaaacctgcattatgtgatatgttaaaccttcttaatttctttgcctggttaatttgagttttgatttttttccccttgttttttgctctatggagatcgaggcaagtgtagtacatacaatgaaggcactagcgagccatccatctgctgcaccaagcctaattgaagatgatgctctacaagttctattccacatggttgcaaatggttccctgaccgtgttctctcaatttagggagggtcttgttccaattcacacaattcagcttcatcgccacgcaatgcaggtaagttgatatgatgcaacattttttgtggatacctgacttcctgccacaccgtaagttcctaatatatttattccttaactgagcaggttcttggtctccttcttgcgaatgacaatgggacttcagcaaactatataaggaagcatcagttggtacattctttatctcttcttcattgtgggttgaaatattttgatcttgttcttctgtttttagcaattgtatcttagtagttattagggctccttgacaccatactcaatgtaaaaatgtgtctgtactgagctttcttggcaaataatagaactcctgtagagcaattaatacctttttattgaattatctagagtatttcattttggtatagttatctctctctctctctctctctctctctctctctctctctctcttttgtgtgtttggaacatctactcttttgcactattgctaataagtcctatgccttttagattaaagttctccttatggccgtgaaagatttcaatccgcagaatggtgatgctgcttacaccatgggcattgtggatctcttacttgaatgtgttgagctatcttacaggcctggtaaacatggacagacttttgccattcagatacatttcatcttgatattttttcaatgtgtacataattcatggtcagctactcagctatagcgtttgctaatatttcaatatatggttaatattgcagaagctggatccgttaggctcagggaagatatacataatgctcatggctatcagttccttgttcagtttgctcttacactatgtagcttacataagaaccaggttctccaatcttcgcccaagttagcatctgaggatggagtgaatcctcctcacagatcagaacaagatacattcacatccgatctttcaccacagctatcaagattgcttgatgttcttgtaaatttgtcgcaaactggactgtctgaaaattatgttggtaaaagtatgaaatcttctcatgggaagggaacaggccacaacagaagccggactccatctgttgacaagttcgcagatgagattttggagattaacagtcccaaagtaaaagatcttgaggccattcagatgctacaggatatatttctgaaggcagacaacttggaagtgcaagctgaagttttaaatagaatgttcaagattttctcaagtcatcttgagaattacaagctatgtcaacaactgcgaactgtgcctctttttatcctaaacatgggtggcttccctccagcacttcaagaggtcatcttaaaaattttagaatatgcggtcactgttgtaaactgcatcccagagcaggagttgttatcactctgttgcttactgcagcaaccaatttctaccagtcttaagcatacaatactctctttctttgtgaagctcctttcctttgatcagcagtacaaaaaggttctcagggaagtaggtgtacttggagcgttgttagatgacctgaaacagaacaagcttttttttggagaggagccacaaaacaggacccctaagtctgcacagaggatgtccagtgcaagtagttttcgaaaaaccatggataacaaagatgcgattctttctccgaagctaatggcttctggttccaccaaatttcccatgtttgaagatgaagggacaataactgttgcttgggattgtcttttttatctgctgaagagagctgagcctaatcaacaaactttcagatcttctaatggcgttaatacgattcttcctttcttggtatctgaaagccacagatctggggtattacggctattgtcttgcctgataatcgaagattctcttcaggtttgtgttagaacctgactcccatgaaatacatagtcatttttaatcacgaatcatcttagtttagggcataaaatgccaagttcatgggagtgaatgacttgtaaaaaccttaagggtctatttcccctatgatttgttaattttaatgatgcttaaaaattgaatttcacgagcaccatgtgagctatgactcctttgacattgttttcaggctcatccagaggaaatagggtccctgatagaaatcttgaagagtgggatggtatcaacttcgtcaggttctcaacagaaacttgacaatgatgcgaagtgtgacacttttggcgctttgtggcgtattcttggggcaaacagttcagctcgaagagtttttggagaaaccactgggttttccctgctactaacaacgcttcacagtttccagaatgacagtgaaaacgaggagactgaatcatctttgcttactcatatgaagatctttggttttctaatgcgagctatgacagctgcagtatacagcaatcctgttaataggataagactgcatacaatcctgtcttccaacactttctatgatcttctgtctgaatctgggttgctctgtgtggattgtgagaagcatgttatcattggacattgcttgagcttgcacttgaggttgttcttcctcccactagtaacctgcaggtagagagcatttcatctgaaaacccacaggatgaatcaggtttcttgtctgcaacctcatttggactatcaaggcttgacaaggagcgtatatataatgctagtgctgtagttgttttgatccgctctttgctagtatttacacctaaagttcaactcgagctgctgagattcattgagaagctagcaaatgctggtcccttcaaccaggagaatttaacttctgtaggtatggacagcaattgttttgtcacctctgtttcctttactttagctggcgagtttgccttatgttattcttgccctttttgttatacaggatgtgttggtcttctacttgagacaatcaacccatttttggagggctcatctcctatccttaatcacgctttgagaattgttgaagttctgggtgcttataggttagttatatttgatggttaattttatatagaagcttgccttgttagttgtggtacatgttatgttttttctttgtcaggctgtcttcttctgaactaagacttctggtgaggtatatacttcagctgaaagtgaagtgttctggtcatctttttgttaatatgatggacaagttaatccaaattgaagatgtcagacaaggaagtatttctctagcccctttcattgagttggacatgagcaaagctggtcattcatctattcaagtttcattaggagagaggacatggccacctgtttctggatactctttcgtttgctggttccaatttcagaacttctttagaagccatcctaaagaagcagaaaaaacatcaaaagggtcttatagtaaaaggaatggacaagttatgcgcatcttttctgtaggtgcagttgatgatgccaacactctgtatgcagaactttatctccatgacaatggtgtttttaccattgcaacaagcaattcaagttcattatcatttccaggcattgagatggaagaagggaaatggcatcatcttgcagttgtacatagcaaaccaaatgcattagctggcctctttcaatcaagtgtggccagtctatatcttgatggaaagttgaggcacaccggcaaacttggatactctccatccccatttggtaaatccttgcaagtaacacttggtacacctgctatccgagccaaagtttcagacctatcatggcggcttcggtgttgttatctttttgaggaagtcttaacacctggcagcatttgcttcatgtatattcttggacaaggttacaggggattgttccaggacactgatcttctgagatttgtccctaactgggcctgtggtggggaggtgatggcaattcttgattcattggaattggaagtaattgcaccttcaggcagccagcgtgttgatagcgcaatgaaacaagggaactctagacttgagagcagtggaatcgtttgggatatggaaaggttaagaaatctttccttacaactgtccgggaagaagctaatatttgcatttgatgggacttcatcagatgcttttcgagcatctgggactttgtccttgctgaaccttgttgatccaacttctgctgctgcatccccaataggaggtgattgaacttctagctatttttatttaaacttttttctcttggaagatgtcaatattcactatgttctttgaaatgacaggtataccgcggtatgggcgcctaagtggggatgtttatgtgtgtaaccagtgcacaattggtgacactgttcaaacagttggtgggattcctgttgttcttgctcttgtggaagccgctgaaactagggatatgctgcacatggcactagaactgcttgcactatctcttcaacagagccatcaaaatgtgaaggacatgcagtccttgaggggttatcatcttcttgcactttttctgcataggagaatgtcattatttgacatgcagtctcttgatatctttttccgtattgctgcttgtggagcttcatttcctgagccacaaaagtcaaatatgaaccgaacagcaagctatgcatctggaatctccccagagtccagtcttgatgatcttacattacccaagtttggtgatgatatgtcttctattggatcacatggagatctagatgatttttcagcacaaaaggattcttttagccatctgtctgagcttgagaatgccgacttagctggggagacttctgagtttatagtcttgtcaaatgctgatatggtcgaacatgttctattggattggaccatttgggttactgctcctatatcagtacaaataactctccttggatttcttgagaggatggtatcaatgcattggtttagaaatcataacctcacaatactgcggcgaattaatcttgtacaacatcttcttgtcactttacaacgtggtgatgttgaaattcctgtcctggaaaagctagttgttctgcttggtgtcatcttggaggatggttttctagcttctgagttggagcttgttgtaagattcgtaatcatgacatttgatcctccagaacttacaccaaaccgccagattgttcgggaggccatgggaaagcatgtcattgtgaggaacatgttactagaaatgcttattgatctacaagtaaccataaatgctgaagatatgctggagcaatggcacaaagttgtttcgtccagattagtcacatatttccttgatgaagctgtgcacccaacaagtatgagatggatcatgactctcttaggagtttgccttacatcctctgccacttttgctctaaagttccgtacaagtggaggtttccaagggttgaatcatgtgcttccaagcttctatgattcccctgaaatatattatatactcttctgtctgatttttggaaagcctgtttttcctcgagtaccagaggtccgcatgcttgatttccattctcttatgcctagtgatgaaaactgcggagaattgaagtttgtagatctattggatactatcattgcaatggcaaaagctacatttgattcattgattatgaagtctatgcttgcacatcagaataataatctttcacaccttaatggcaccttagttgcggatcttgtggaatcgacaccagacatgggaggtgatcttcagggagaagccttgatgcataagacatatgcagctaggttaatgggtggtgaagctgcagcacctgctgttgctacttcaatactgcggttcatggttgatttgacaaaaatgtgcccaccattctctgctgtttgcaggcggcatgatttcctagagagctgtgttgacctatatttctcttgtgtaaggttcgtatggtgtgcatatgttaagttatgtgatgctctagatgtttaggctaaaacctttttattctgcaggtctgattgtgccgtgaagatggcgaaggacctaacatctgcggcaacagatgagaagtgtatgcatgatgatgacaacgaaagtctaaaagatactttttcgaatttgccacaggatcaggaacaatctgccaaaacttttagtattgcaagttttccccaggagcagaaaagttcgagctcaggaagtagtggcatgcataactctttcgaaactgctgaagtaaaagcagacgactcttccaatcaggcatcgagcaccacgtttttgaatggacaagcaaaccaagtggttcagagtgctcatgatcaaggacagatgtcagccccaagttcaaatggcattgctgattcccaccaaccagctgattcacccacttcagcttctatgaacaatattgggtctcctgttttatctgagagatcagctcacaaagcagcaagtacccctactgcatctccgatggctccatttgcatcttggcctggcagtgcaggatcatacagcgatggtaggcagctaacagcctctccatccatgtcttcaactatatctgggattgacctcgattcatcccctgatctgaagacaaacattcaggggtcacctgcagtgaacacacttttcccaattaattcgaagcttttgcttgacatagatgatttaggttatgggggtggtccttgctctgcaggagctactgctgttcttgatttcattgctcaaatccttgctgatattatctcagaacagctcaaagcaacactctttattgagagcatcctggagtgtgtgcctctgtttgtagatatcgattctgctttggtttttcaaggtttgtgtctaagcagactgatgaacttccttgaaagaaaactcttacttgatgatgaagaagatgggaagaaacttgacaagagccgctggtctgcaaatttggacccactttgctggatgattgttgatcgtgtatacatgggctgctttccaaccccagtcggtgtgctacgtacgctagaatttttaatgtccatgttgcagctttctaataaagatggccgtattgaagatgcagtaccttcaggtaaaggtattctatccattgctcgaggaggcaggcaacttgatccttacatccacgccatattgaagaacactaaccggatggtaatgtattgtttcttgccaacattccttaagaatatgggggaggatgacttgcttgcaaatctggctttcctaacagaaactggaagaagtttaggtatttttaaaccttcccaggaagattatactgttgatatctgtactgttcttcagcttctgattgccaacaagaggctggtgctgtgtccaagcaatgttgataatgatctaatgtgttgtttctgcataaatttaatggcacttcttcgtgacaagaggttaactgcacaaaatttagcagtggatttacttaaatacttggtagtgcatcggcgtccgtctcttgaggacctcctagttagtaagcctaaccaagggcaacagatggatatcttgcatggagggctcgacaaactactgactggaagtacaacagcgttttttgaatggctccagagttctcagcaaacaataagtaaagtgttagaccagtgcgctttaataatgtgggttcaatatattactggctcagcaaaatttcctggggtgagaataaaaggcatggaggtcaggcgcaagaaagatatgggacgaaaattacgtgaaattgcaaaactagattcaaggcactgggagcagataaatgaacggaggtacaatcttgatttggttcgtgatgtaatgtctacagagctaagagcgattcgtcaagacaaatatggatggatactgcatggagaaagtgagtggcaaagccagctccaacagcttgtacatgaaagaggcattttccctgtgcggcaattatcgacagagcctgcatggcagctgtgcgctgttgaaggaccgtatagaatgcggaagaaacttgaaccgtccaaatttaagatagatactattcataatgttctagccagcaaccttgggttagatgatgttaagattaccaagaaagaggatgggcacatggtgatgacatctggatcagatacaatgtcaggcttgaatcttttgacctatgacacagaacggaaggatcttgatgctgctgattttgcatcgttcaaagatgaagatgacatattcaaaggaggaagcacagtgtcacctccaattggctggactgatgataaaagcagcattaacgaacaaagtcttcactctgcaacagaacatggagcgaaatcaagttccttttcttatcacatgacagagagtgtccacggtaaatctgaatttaattcacctagacgggcaccttcagttaagggcaccgatacaagaacctcagaggataaatcggaaaaggagttgcttgacaatggagagtatcttatcagaccttatctggaaccttccgaaaaaataaggcataagtacaattgtgaacgggttgctggtcttgacaagcatgatggaatatttttaattggagaacttagcttatacatcattgagaacttctacattgatgattccaattgcatttacgaaaaaggcaatgaagatgagctctctgtcatcgatcaagctttaggtgtaaaaaaggatgtattgggaagctgcgattctcaccaaaaatcaccatctacgtggggtgcaacagcaaaagttttgcttggtggcagagcatgggcatacaatggaggtgcttggggtaaggagaagctttgcagtagcagcaatttgcctcatccatggcatatgtggaagcttgatagcgtccatgagctcctaaagcgtgattatcagcttcgccctgttgcaattgagattttcagtatggacgggtgtaacgagcttttagttttccacaaaaaggagagggaggatgttttcaaaaatctgaccgccatgaacctcccacgaaatagcatgtttgtattcttaactctttgcaaatacatacactcagtaattaccatgcatgttcagtcatttctttagtataagatctgaatgtcaggtcctactatcaaggctatgtagttttcagagttgaaaccatctagatatgatcccttggcataggttcacaacaggtttatgtgtttctttgtctatcctgataggtttatcacaaccgctgaacaagattagactggaaactgtctgcttacgtccatcgagtaccgctcaatgtcatttttttaaagaaaaatcttagcaacaaaatagagtagtttttttttggactaacaccacaagaaacgggcataattctgttaaaactagcgaaactgccagaaatatatgtaaatttgcaatatctttgtttttttttattagtcaattctcacccttccctacttaatctggtaattagcaagttctaagtgatttatcatctatggtgggaacatattgtgagtgcaagtatgaattgatagacagacacatgaaattaagtcctaaggcctttattgtatgctggaggtttctaattgctctcatgttcttcctgcacatgcacagtcaaattttaagttgcacaactaggcattattttttaatgatttttacaatacactttttttgacattgaagtatacttttacctatcattaacaggttggacacaacaatatcagcatcctcaaaacaggatagcggtgaggggagccgtcttttcaaaataatggcaaaatcattttctaaaagatggcagagtggagaaattaccaacttccaatatctcatgcatctaaatacacttgctggtcgaggatacagtgaccttacgcaatacccagtatttccatgggttcttgcagattatgagagtgatactttagatctgagaaacccacagacgttccgtaagcttgacaaaccaatgggatgtcaaactgaagggggagaagaggaattccgtaagaggttcgttcatctaacatcaatggatatacttattttgtttatttcttaatataaaagactatgcctttaggctgtagtattgctgtacataagataagaatttgtgcatctaacattatctgaaataccttcttctgtttacttcagatatgatagctgggatgaccctgaagtaccaaagttccattatggttctcattattcaagtgctgggattgtccttttctatcttttaagactgcctccctttagtatggaaaatcagaaattacagggtggacaatttgaccatgcagaccgtttattcaatagtgttaaagatacatgggtaagtgctgctggcaagagcaacacatcagatgtcaaagaattgattccggagttctattatttgcctgaatttttggagaaccaatttaatctggacttgggggagaaacagtccggagagaaggtatgctacttacacaaaagtgcactgaacttttaactggatgtaaatatgtaatggcaatactcttaaccaaacctattcaagctgcatgtaatctgtaaaataatgatttcaggttggtgatgttgttttgccgccttgggctaaaggtagctccagagagttcatcaggaagcatcgagaagccttggagtcagactatgtatccgagaatctgcatcactggatagatcttatttttggatataagcagagaggaaaggtataggccatctcatgtttgtgcattctttattgttcctaatggtggtgatattgccgtcatcatgacaacataaatatgtttgtcttaaaaacaagggtgttatcttctgttatagattcgtattccttcatttctgtggtcctagtggtggtgacgttgccatcgtcatgagtccatgacaattcagacatgtttgtagttttttacaaaggaaaatgaattgtgtttttttatagattgataaattttgtcctttatagcatcttacccattcaaaacctctcaatagttttttctaggtcttgttcagcatgctaaatttgtatcattttttactttctcatggtctttcaactctgagcattgatttctacactgttagccagaagtattttacatttgtgaatgtaaaccagagtgacttgtaaaattgtgacacgaaacaggggaagttttctgctaatcatatttattaacttgttctaattgttatttcttttgtatatggcaggcagctgaagatgctgtaaatgtcttctatcactacacgtatgaaggcaatgttgacatagattccgtatcagatcctaccatgaaagcttcgatactggcacaaatcaatcattttggtcagacccccaaacaattattccaaaaaccacatcctcagagacggactgacaggaaggtccttcctcatcctctacggtacagcgcgtatcttacacatcaagagattcggaagacaacatcatcagtttcccagattgtgacctacaatgataagatcctaattgctgcagcgaacagctttctcaagccagtaaattatagtgaatatatttcctggggatttcctgaccgcagtttgagaatattgacctatgatcaggataaacttgtatcaacacatgaaaaccttcatggtggtagtcagattcagtgcactggagttagccatgacggcaacattctcacaacaggtggtgatgatggtgtagttgcagtatggagatttttcaaagatggcactcgtcgtctcctgagaatggagaaagctctgtgcgctcacactgccaagataacatgtatctatgtgagccagccttactcattaattgtctctggctccgatgactgttcagtgatcttgtgggacctgacaagcctggcctttgtgaagcagctgccaaggttcccagcatcagtgtctgcgttacatgtgaacaatctcactggtgagatcctgactggtgccggtgttctttttgctgtttggagcgtcaacggagactgtcttgctgtggttaatacctctcagcttccttcggatctcatcttgtctgtggcaagcactacaaactcggactggcaggacacaaactggtacgtgacaggtcatcaaagcggtgctgtgaaggtatggaagatggtgcactacacgtctgatgaggcagcaaacagcaagagcaaatctccaccgtccacccttggagggatgagcttgaatggccagactcaggagtacaggctacttcttcagaaggtgctcaaggctcacaagcacccggtcactgccctttgtcttccacccgacctgaagcagcttctgagcggggatgccagtggccacttgttctcatggtcactaaaagatgatagctttaaggtttcatagcaacagctcaacagaggatagtcaggattcacctgcacatatagagagccttagttaagttatatacctctggttcctttctcacccagaatctgacaagcacctgcttgtgctgccaaagaaagaactcagagttggcctcggcatgcagaaacattctacaatatggttggcccaggccccagcccattcagcaaaatctggggtgaagacacagtacaacagaaacacactggaagggataaaatggagatggcgttgtgctgacattacaatcttattatactgtgaattatctaccggttctacctcatcttcttgttttttcatgagaggattcgtgcggggtagcaaccagcgtgtgtaaagtttgtataggatgcttttggttagtagtggtgaggggacgatggtgatgatgttgtacggtgaagatgttatttttcgtcttggggatgtaaggaaaggggtg

SEQ ID NO: 8830 - DNA, 43839 bp, Oryza sativa
caccaatctccttgggacacgtttgtgtcggtgaccactgtagtacatggcgaacagcaaactactagtactagcgatctagaaaatcctaaatcatgtggttcctgtacagtttattggtgagaaagcacgataaggataatgacgaatccgtgatgaatcctgagacgtagactttgaccattaagctttgaaatgatggctttctttgatttcctttgctagcttacttagctggcaaagcttaatctaggccaatctgccggatattcgcagccatttacgctttccacgtcagtgcatgatggagtattctacgcacgggatgtattaaaattggataagcataactgataatttgtttgttctccgaaattaccaaactgtcctttttaacgcaatttgataaacaccctagtgccgtataagcgcccatatatctaatttttgaacaaatcacagttttttcacttcttatttctgaatatatttcactctgtatttcttcctcaaaaatcatgatgtgcacatgttttttcataaataatatttttagtacatataaaagtgaactcccacttgcatttgcatctagaaagcatgacaaaaaccatcggcggcacaacaaaaatcaacccaatttatctgaccggaaaaataaaaaagcttccaaaaaaaaatctgaccaaaccgaccaaagggcaaaatgggaacccaaaaaaactctctataaatgttgactccaggcaatcagcgtggccgcgtcacagcacacagacatcggcgaagcaaagcgcaccacgcacacggaaagagaggagaggtcacatcgcggcggcggcggcgaggatgttggcggtgtttgatccgacggtggccaagtgcccggagggcctccggagcccgccggtggccggcggcgccgtggcggccggcggcgcgggcgcgctgatgaagggcttcgccggagcgcacgccgacgcggtcaccgtcagcctgggccccgccggcgccctcgcctactcggcggccaaccagagccccctcgtccccaggtgtttgctctgttcttggctcctctcgctgattagctggggtaagccgatgctttgtagcgcgttcttgggatgcaaaaaaaaagcgtgctcttttttggctgttcggcacttaagcccgagatttggtgatgcggctgtttcgtctgaggttggaacgatgaaattttgggagatctccgtttcttttggtttcttggggctaagccagtgtaggcagtagccatggattttttttttcttggggtttcctatggggattttatcttatgggaaaaaaatcatgctattttagttcgaccttgagttttgcgaaaatttaggggctctttgtaaggatcaaaatgaattgagtttgatttgatgttctttttggtgtcggccgcgtggtcgatcggcatgtccgcatgtggtgtgatctcgagtctttcttggataaagttgggagatttctgcaccttaaagttaggtgaggctcgtcgatctaatagttgcttagatctgcacgaaaagttaggggataggaccattatgatgagcggaacgggtatatggtcaaccattctttcgtaccattccatcctgcaagatttagacaatatttttatttttttagtcgagttcgtttcttcatgtggatgcattttgttcatggctatactgtaattttatttgatcagttgagtaccgagtacgttgtgaatcaatggcatattagccgatcaaacaatttagtgaattccgcataaaacttgatgaaaatttagtaagatcaagcttgttcatgctaatctgaaactaccatgatatgggagccttggctgaaccttttcatagacagatatgtccattcctatccacccaattctttgtgtagcatcggatgtttcaacatttttatacatgtcgctatagcttagatattcaacagaagaaaaagaaacaatccagaatgtgtggtaccacatgtccattgtccattgttgacatgtttgtattacatgtcaatttggtacttgttaaacaattgttccttgtcatccaacagggatgatggtgatcagttatgttttttattgggtagtaacacgtcatttacagcaaagagcaaacgtggacgtttgtggagtagtctgcagttgagttttgagcccccctaaaataacccaaagtgcatggcaaattgtctttatatagatagcgattttaacttaaaataacatttggccggttgcacttgggtaacctattagacttctctgttgcaaatttgtaagattccagcatcatggttttgtggtgttcgaaccttgaagcatttctctgttgctgttgtgaaataaaaacattgtgttagaggaaatatttcagatgacagtgtgtatttgtttggcatgtggtcattctaataaatagcagtaacatggacttccttttcaccatgagaatggtgcatcgcaattcgtaattattgttactggcaactcttctgttttccgcaactctacaatttcatgaattatgtttagtaactctggatttgtgctcctacccaggttgtttggtgctgtgaatgacatattctgcctgttccaaggacacattgagaacattgccagtctgaagcaacactatggtctgagcaagacagcaactgaggttaccatcctgattgaggcctacaggaccctcagggacaggggccctctcccagctagtcaggtcgtgagagatctcagcgggaagttcacgttcatcctgtatgacactctgtcaaaatccaccttcgttgctgcagtaagtacatcatctctctttcctgaggcatatacttctgctctgaaggctgtggttctgatcccatttctctgctcaggatgctgatggtagcattcctttcttctggggcgttgactccgagaaccaccttgtgttctctgacaatgttgaccttctcaaggcatcctgcgggaactcgtttgcgccattccccaaaggtaaactgcgatgaccgatatcagtatcgggcctttcttctcattgtttcaccagaattcagctgaagtgctccactctctcacaccgtcatttgcgattgttcgtcaggctgcttctacaccacctctggagggctgcagagcttcgagcacccgctgaacgagctgaagcctgtgccgcgggtcgacagccagggccagatgtgcggctccaactacaaggtcgacagcgaggccaagaaggactccgggatccctcgggtcggcagcgccgcagactggtccaaccatttctgaggcaaagataccattgagatggcttccattttaccatttcggcatttccagttgtggactctgccctgtatgtctgatgctgaagtactcaagaaccactcctgagacgacgcgctaggttttactttcaggcgtccgtaaaactcttctgcaaacattcagagcattgctatctttctacgtcatagtactgaatactgatacttatgtaatctgatgataccacgttgtggttgaggtctatctctcgtgttctgataaataaagctcaatgaaagcttcagatatgtggtactgttggcattctacgtggcgtattgtgatgattgatgatagcctccaagaattttatgcagcactctacctgaagtttgtaaagaaagcacacggtttttgttgattttcaagaattcaacttcaccgtacagcagatcacactagagggagtatctatagatcacccgaccgattttaaacgaaaaacactcagatttttaatacttacataatacacatgaaaatagcatgtataacttacacgtatcataacacagaattcactattaaagataagcttattgttaaaagtaaagtgtaacttacaagcggtgaaaaatagaaaaaaaataaatcatacaaatctaatagaaattgcatttgtaatttactctgactcccaatgtaactactacaaattacactctaaaagtactatatttacactgtaattttttttcctcaacctatctcctctctttatcccctatacacttttgggcgaggtgaagttgacaggaaacaatgcactacacaactaacaacaacttaaactatttaattagtgagtgacaaaataatcaaccatatgaatggatgtactgtaccaggtagtcaagcactcccgagttaagtgtttcgtgggcgcgctgacacaataagggcacggatctcaaggttagattaacagctgaaaattcgacaaatttattgacagatttttagcatagtcgggcctaaatgggccacatatgcagacataagacatgtttaaatgggcctaaattccggcccatataagagagagctaaagtacgagatgggcctaaacttggtcggcccataccggcccaccaacctcgtcttctcggactccgcgtccacaccaacaacgcgctcttctcttcttcacttcttctcccccatttggaataagttcatctgaggtcccttaacttgtcaacgaatccgatttttgcccctcaatccgaaaaccagacacaaagggtccctcaactatcaacaccggtacagattaggtcccttggcggtttcgagggtggttttggctgacgtggcgcctacatgtctaatttgactcggtcttcatctgacgtggcacatacgtggcaattagatccagaaaaataataaacttcgtgggacccacatgtcagtctcacgcacaaattaattaaaaaatgatagggcccacgtgtcattcttagtgtctccctctcttcaactctctccccctcttcttcttcctctctcccctctcccatcccagaggcggcgcacggtgccgggggaggagggaggcggccgggcgaggaggggcagctcgctgtagccgcgcgaggagaggcgacgcgcggcggccgggcgaggagggaggccgagctcgtcggcgacctcctcctctgcctcttcctccttcggccaccttccccgctcgctgtccggcctccttgctgtgctcatgctgcactggctcacggcggcctacgacgggtgatacatcagcatcgccgggagtcgcgggttgggcgggggcgacggcgcagaggaggaggtggtcgagggtggctcggaggcccgccgcgatgacctcgttctacgggcgaggccgcaccacgcctggctctcggcggtggcctgacggagccgctcatccagctcgacggcgtggcgtcgggtgacgtcgagctcgacctccttctcccgcagccgccatgccgcggcgaccgacacgacgacaccgagcgaaccagcgcttgacattgctcgagcccgacgcacatccgctcgcactccatccgcacaacagcgtcgatcttcgcgctctacatgcacagctccgacaccagcgcatcccccaccgccgcagccgacaccatcgaccgcccacttgtcgacgtcattgtcgactccaccaaccggctcactggtgcaaccaccttcaccatcccgggaatcggcagtgaagaggaggcgagaatggcgtggctggaggaagacgagggagagggagacgcgcgtcggctatataaagcaacgccttgtcgtcggcggtggcggtgattgggggaacgacgacaatggcggcggcggtagccatgaggcggcgccacggcgcgaggagaagcacccgaatacggccacagccttgtgctatcgcgcactcgcttcgcctgccgtgggcgcgcgaggggggagaaagccgacgatgaggaagatgagggataagggagagggatcatcggcggccaggaccgagggccggaagctcgtagtgagggccagagaaggtgaggccgagctagatgaggtggagcatatcgacgttggccttgagcgtgtggagtggggcatcggcagcggaggcgaggagccggtggagatccgtgaggtgtggacggacaaccttgaggtggagctcgcgttgatccgcgacgtcgtcgacgagttccccttcgtcgccatggacacagagttccctggcatcgtgtgctacccacgccgccgctccgctctgtgcgccgctgttgacagaaaacacgaggcctgggagatctgcttaactccagtgcaggtccaaagcttgccttcgggtgtgctagcgtgccagttgatttgatcctgtaaccaacaagaagtagaagcaaagaaatcgcggttaaatctataaatgatagccgattggctaagtgccgatgacatatcatttatctttgagccgatgtcatatgtgtatcgatcggcaatcttgaataagtaagaaagaactaaatctacttgatcggctatagatgttaacgatatatactccttatatcgatatatacttaaatcaagtgattggaatagatcgatcgccatgccgagacagtataaatcacttagaccgaaatatatattaataacaggactatatatgtttacagcatagccgatcagatagatctagcatgtattggctaatactccgatactactttatatcaggatattaaaacagcaatatcttggcataaagagcagatttaacatgtcaataaagcatatagagcaaatatagttaaatcagataagatcggctgaaactccgatgctaccctaatcggcaaccagaagacaggctagaggttgatattctaagcacgacttaatagatcaaacttaactgatgcagcattaagtatgaaaagaagaacaatatctagacaatcaaaccactggaagtttcataaagtggtaaatatcttatataatttaggtcaacttcgctatttaacctggtcggctgccttctaccgaccggtgttagctgattgtagattagatagcggtattgccggagattatgtaagatatatgatagctcggcgaattatataaacgagatcagagtatcataaagatggaagcactaatcccgaaaacacaagtcgtcataataagttttacctctcgttgaagatcaaaaccgatgcagctcaacccgaaagcaagaactagtcgaaacaaaattaaagtaaaagggtggcgatgcgccgagattgtattgaatgtgtgttaaaagttacatagggctcaggtctatttatacccgagaattataagatatgtccataacggacacgactactatctctaataaactctaagatactatatgtctttgcggcagacttttgcccaatcatatctctaaggataaaacataaaacatcctaattaatagatataattgcctcctcaggactctatccatgtgcggcaatcaccttgaagcacctcaatccaaccagacatcacacatatagattggctacatcggcttacctagtccgactcagactcagccgatcttatcgtagccgatctggactccagccgatccctgctctgtttccgaactcgatctctgcctccgacttcgcttcaatctaatcttctttcccaatgccgatattaccaaatttggttgttaacagccgttgcccccatttatctgcttgcccagcgctcccgccgccggccaccgccaccatcgcatcctccagcgctgccgacctgtacgggctccaggtgctcaccgacggcatccaggacgacgacatccagcgcaagagagagatgaagagagggagatggggagagaggaggaagaagaggaggggtgaggatgacatgtggggcccacgtgggccccaccattttttaattaatttgtgcgtgagactgacatctgggtcccacggattttattatttttccggatctaattgccacgtaagcgccacgtcaataccacgtcagatgaagaccgagtcaaattagccacataggcgccacatcagccaaaaccgccctcaaaaccgccgggggacctaatttataccggttttgatagttgagggaccctttgtgtctggttttctggttgagggacgaaaatcagattcgttgacaagttaagggacctcaaatgaacttattcccccatttccattcacaaccaaaacaagcctaaaaaattgaagttttttcacattaactttattattccccccctcccccttctccttccatccccttcctcccgtgtacgaaaccctaggtggcgacgcggccgcccaaaaccccgccgcgtcggcccccggatggcccccgccgcggcggaccccgacgccgacgacccccccgcgcgcagatccgacgccaccgacgtcgccggcaacacctgggacctcgccgcgctgccgcccccgccgcccgcggcgaggggcggcggcggcgaggtctacatctaccgcaacacgtacaacctcgtcccccgctccatcggcgggtgccgcgggagcgtcaggtcgctcaagttcttcggcaacgacgtggaggtgctcccgccggaggctggcgagctggaccagctcgagagcctgcaggtgaaggtgtccgcgcccagggtttccggggcgccgctccgccggatgcgggcgctcaaggagctcgagctctccattgtcccgcccaggccgtccgcgtgctccatactggtcgaggtcgccgcgctcaagtgcctcaccaagctaacaatctgccatttctccattaggtatgttcaggccagtggcctaattggtccgggcagtgttcttttcagcaaagttcttcaatttgttcataacggtgtcttctatgtaattgagcaacgctatgcaatgtaaatgtggttcctttcttctgtatttacatggcattttttttgtcagtaacgcgtaacaacagattaaatggataggaataacatagatatgaactagcctctaactggccatgacctttttatttggtgtggattttccatgctgactatctctgatggttatgattgcctttgccaaatttaaatcagaattagaggaggaacattagctttgttaggctgttacaaaatctattaattcctctactggtaaatacacattttgtagtatactccctccctccacatatctagggaatattcctttgctgctcaaaggccaagagttcacctaaaatgaccaaacagttctttacatgcactagctgggcccccctttgcgggtatgatgggttggcatggctgcttgatgccatattccttcatccattcacacttgcactagttgaatgctcaatgcctgcatgcacattcagtacagtgtgcggagtagtgaagggtacatgagaccaaaaaccaagaagagattcttcaggtgtagtgtgcacccttcattcctggtcaagagctcaaatcaaaaggcaccctacataagtggatggagagagtgcgtgctgtacagcatctggttacccagagtggtagttagaccaactattggaaattatacaatatttctgataatgtttctattttaggctatattaagttaatcattttctctcactccttcaaatagaagaaatgatgatttctcaacccctttttttacattctataggtacctccctcctgaaattggctccctaaggaagctgcaagaacttgatctttcgttcaacaagttgaagaacttgcctaactgtataactgagttgggtgccctaaagttcctcaaagtgactaataataagttggtggatctaccatcaggaatctcttctttgagatgtcttgaaagccttgatttatcaaacaacagattgacttcccttggatcagttaaactcatttctatgcttacactacagtatttaaatcttcaggtatatcttattatttattaacataatttattttttcctacctgtttattttgtataaatggcatctttttttgctgtgaattgagctgtcatggttaaacatgatactgtctcaatttatttgatatccttcctagtcttgtccagtaatttctgattttttagatctcaattatctagtttctgtagccttttctgattctatggattgattcactttgtggatcaaaacctcaacatttttaagaacattattaactgttgtatttgaagagagatgtttgtcacttttgagtaaaggaactatcgatgggttaatgatctttgtccaattttttctgttgccattgaaattcaatgaaagtgcaagtacaagagtttatctggaactagaaaaacatctatagaaatgtctagccaaaaagaaatatctcgcagctagtggagtggatttataagataaataatgtggcactgtggttctctctcttttttttgacaagagttttgatcttttcttttaatgcttgcagtgattgtactgtggaacttttgcattgtgttatggtatttaggatttatataccagactgactttttttttctctgtctcaagtttaataggatctccaattcttgtgttattcctgcatgggtatgttgtgacatgagaggaaatggtgaaaacaatatgaagcctggcaaactaaaatctatagctgttgtgagcaacacttcagcagaatctagaagtatgaatcatacttgcaatgcttcacgtttatgttcacatccagaagcttccgcaaatttaaaagttcatcccacacagaaaacaaagaaaggttggaagcggcgggattgcctgcaacaacaagctcgtcaagagcgtttggaatcaagcaggagcaagttcaatgatgattatgttgatgaaatggctgtgaatatgacagaagatgagagcccgttgcatgatatggaaaacaagtcagagatgaaaggcattgatgaagaagcttcattacaggatttgccaaaagaaacaagttctatatctgaggacttgtcatgtatagttgatgatgactcctatgggcatattaaagatagtggcatgatgttacaggaccataatgaagaagaaaagcctggattaagtatgaaaagccatggcaactgttcttgtatcagcggtaacactgatattttgagcaggagaaggatccgcagtgttgaaaacgaactagaggattctgcatcatcagtccatgatgctgctgtggttgttgaagagaatccttcagaaacatctaagcattcatggaaatctaaaaggcaccctgatatggactgcaatcctaaacctagcaaatgccctagaccatttgatgaatgctcaaagttatcctataagtacagtgtgcaatcgttctgcagcattgatgatcatctaccagatggcttctatgatgcaggacgagatatgcctttcatgccattagaggagtatgagcggagtattggactatatgcacgtgaagttattctcttggaccggttagtgcacactcctatctatacttaggctctctctattttgcatagtgtgcatgttttgacttccttttttttcgttcagagaacaagatgaagagttggatgcaatcgcgtcttcagcacaaatattgctgtctaatttgaaaatgccaagctgttttgtagctgatgaagatgcaggccaggacttactaagggcatctgtgcttgctttgtttgtttctgactgctttggaggttgtgatagaagtgcttctctcagtagaacacggagagctattgttagcttgagaaaggagcaaccttttgtttgcacttgttctgctgggagcatatgtgacagcactgaagcatctaagcggatcaataatctttacggccactttgattttactggcctgtgcgataaatcaatacatatcatcaaagaaaggagaaattcaggaattgtaccgataggagcactgcaatttggtgtttgtaggcaccgagctgtcctaatgaaggtaactcctcgtttctttggcctgagctcattctatatttgctctttaacattgcaaccatatccactgcagtacttgtgcgatcgagcagaccctccaattccttgtgagcttgtgcgggggcatcttgactacacacctcatgcttggaatgttgttcctgttagaaaagggaatacatgggtaaggatgatagtggatgcatgctacccaaccaatataaaggaagagacagatccagagtacttttgcaggtaaacacactgtgatcctaaaatctgtctgtgctacatgtttttgctttgtgtgtaatttatgttgttttaacctactatgatgtttttgtaataatttttagaccgaagatgtttttataatattttcactatttgaactgtttcaatgtgtggtattgtcatgttagcaaaaagagatgacaacatgacattttcctaatgttgccaatagctaacatcattttttggtccttatttatatcataagtaatctatatatgattgaagttagaaaacataagaactcctgtccatctgccatactatcatcattttttagttagttctgaagttcagaagctatattcactcttaacaaagataacctattcatcaatcatcctttttttttgtgtttctaatagatagatatccatttgatctactgttattttgttcacttgatggtaagtaatctcatccgctgatctagttgcatgcatcttacccatcttatttcagttagttattggaaacaagtatacattttacatatatattcttttgaatccaacattctaacttactgagtccctaggtttcgaaaataatgtaatggaaaaggaagtgtttccagtaattgctatttgacttgaacctgttctgagaatttaccctttgttgcatattgttttaggtatgttccactcagtcggcttcagatcatacttgatgatcagggttatactccacggtctccctttccttctgtctcactgtgcaaagaaatagaaactacagcttctagttcagtctactactgcaaaattggtgctgttgatgcggcagcaaaggtttgttatttttttatttatttgtcacgcctttgtctttttgtttggagttagttgatgttgctattaaatgcaggtaagatatctagacactcgatgtgcttctagtgatgaagttaaaaattttgaatacaagcttctcgcggaagtaagaatgctgggtgccctaaggaagcaccaatccatagtggaaatatatggtcatcagctttattctaaatgggttcaagctgatgatgataaggaatacaagatattacagtccacaattatgatggagcatgtgaaaggagggtctctgaaggtatgcatatgactccttatgtaatcaccttcagtgttcagatattttcgttaacttaaggcctttgttttctcttgttagggttatttgacaaaattgctgaaagagggcaagaagcatgcacctattgacctggcattctacattgtacgagaagttgcttgtgcattgttggagctgcacaaaaagctagttattcatcgggacataaaaagtgagaatgttttggttgatctggatttagagagaagtgatggcacaccagtagtcaaactctctgatttcgacaacgcaattcctttgcattctctctcccacacatgctgtatagctcaccttgggacatatccacccaatgtttgtgttggtacaccatgctggatggctccagaggttcttcgtgccatgcgagacaaaaaccaatatggactggtatgcttttattccacagttctgtcttgttgctatcaatgctagtttaattgttctgcattctggctgaggaaaccaaatgctgcaccattgttattattatgtttttgtagttgaggcggttatcataatattttgacatctgagcgaatgattttttattagcatgtgctatccaaatttgaaccagtttagttattttcatttttcttaaagcatcactttttttttggtgaaaactcttcctttttcttttgtactcggccattagagttactccctacatttcagtttacttgtcattctagcaaatctcacaccaaacaaggaggtgtggcaaattacatggttaccctcaataagtacatcccaatcaattttcccaaaagcaagcattaaaagtccttgtgtggagtactagtattgatgaagggtaggaagtaacctctaaaaatgttttggaatgtgagaatgacactttgataaacaaattgaatgctagatgacaagtaaagtgaaatggatgtagtatcacttatgttgatatccagtgtacatccacttctttaaattattatgtgaatatcaacaatatgctcctaggtaccttctagcatgtagtcaaatcaacactccatataattgcttgatgtttatatatatatatatatatatattgcaggaagttgatatctggtcatttggctgttttttattggagatgcttacacttcggataccctaccagggcctacctgattcagaaatatatgatctcataatggtaggtccattacatcacaatcaattacctgtctctgtgtacatcaggattaacaatgatctgaattttctataatcagaggaagaagcaaagaccaagactaactcaagaactagaagcgttctggacgttagacaagccaattacgaggctggagttgggtatcacatctgatgctcatgcagaaaaactaagactgttgatagatctcttctaccagtgcactaaaggaattgcatctgagcgcccaaaagctgaggcggtttacaatttactgtgctctctacccacatgctatgacatgaggtgaaagtgtggatcttaaatcagtatgacataaggtgaaaatgtggatcttgaatcaggaacctgttgatgagacagccagccagatcggcctgcgccaggatggcaagttatgctgggtggttttagcaggtcaacagatctggcctcgcttggtttgaacttctgaccagcatgccgcttattctttgagtgctggcgatgcggaacacgagaaatccaaccaaaaccaaagccggtggcagcattgttctgagttctctggagttcatcctgtgtcagttttgtagcagccagccccgtttcccgcctcttgtgttgctgcggtgttggcctgaccatgtgttgcttgtcgtgtcatttgtttttgtttttcattattgcgttaatttattgatttaggccattcacaaccccaaggcgtctgtctgctgcacatgacccattctgtatttgtatctgtatctgtatgtacaagtgtcggtccatccgtgatccatgtaaccctctactgttgagtcatgtaacaataacagatactgttttgaggttatttatcatgagggattgtttttccatttaaagtttcaacaatagtactcatggcagtttatcatttgtgttagtatcacatagcatgcactgtgtatgagtgtatccctccctccagaggaacaatgtactattctcattaaaacagtttccctgcatcagttaataatattcgttgtgcgtgaactgtactccagtgtaataaagtggtgatcttatatttggacgcatgctgattgaccatgctttacgcatgaactgatttatgctgaattgcattctcagcctggagtgtgaagccaatgatatacttagggtccttttgaatcacaggattgataaaacataggaatagaaaaaacgtaggattttgataggaatgtaagtgcaaaacggaggattacaaaacgcagaaaaaacacaggaatgaccgtttaattgaaccgcagaaaaaaacacaggaattggatgagagagatagactcaaagaaaagttatcaagaggttgaagctcttgctaaatttcctccaaaatctctataatattattcattccacaggaatttcaaaggattggatatgattcaatcctttgtttcaaagggctccatagaaaatttttctataggattaaaattctctaaaatttctatatttttcctccaaattaacctgtgtagtatttctgcagcagctcgttggaaatccattgccctgacaatgtaacaggctcgatgtaacactcacaggtcgacagctatttccttagagatcagtatatacaatactgttcactgtattctagtgtagcagtagtagctgctacagctcccattttcaacaccggtctgttgaaaggcaaacatcgacaatgcacgcacaataaaatttgcagtgtgctaacttctttgaccaccgttctgccatgctccaagcataagccgtggcagcaacgaataaataaatacttcacctgtcttagactttcattattgttcacattcattaacatttatatttatgtgggccaatgcttattttaaaataaaaaaggtacatattaatatatatattttttaaaaatagcatacctttactttattaaatttcaatacaagtattccttaccttatttatttttaatgtaattattctttgtttttataaaccctaagggtatgtttagttcacactaaaattagaagtttaatgtaattattctttgtttttataaaccctaagggtatgtttagttcacagtaaaattagaagtttggttgaaattaaaacgatctgacggaaaagttggaaatttatatgtaggaaagttttgatgtgatgaaaaagttgaaagtttgaaaaaaaaaatttgcaactaaacacaccgtgttattttagataaatggcataaccttaaaaagcctaaccgaaggagtaccactaggcggctgctgctgttgttgcagtaaaccaaaaaaaaaaaaaaatttgtttacaaaatgcggtttggcttctcgagacagaaaagacgggcagttaattcctgccggggaggaagcccgagaggacaccacgttctcctcctccacgtcgcgccacgacacgccccactcccactgtcgcatgtgcccaccccgccctttgacttgccgctcattggcgacacacccgcacccgcacgctgccatcgcctctcggattcctcctcctcctcctggccagcgacatggccgcgataaactacgccgccgatcgatcgatccatccatctgcccccccatgtgcatgtcaccgctcgatcccctcctcctcctcctcctcctcgtcttcttcttcgtcgatggattcgccgtctttataaacgagcagctagctgggtgcgcgagagagtgtcaatgtcgatcgaatcgaatcgatcctccggtgcccaagagaaagcgtgaagctgccagcatgatctaacttgcagacaagaaatcagctcagctcgctggtttcgaacaggaaggcggctagctgaggcttcttctgagtacgtgatggttagatcatgctgtgacagtttcactccttccctgttgggcacacaaagctatggaacacaccacgaacagagtcagtacgtacccagctaatatagccagtgcaagagatcgaggaatgcgagagggaaatgcagctattttgttgatcaggtgcgtacgtatacccgtctctctgataatatgatctcaatcgacagtgtgtttagatttctaagaattaatttatatgagtgttatttagtttgtaggattgtaagcacaggagaatatctacgagttgtagagagaagacataaagaaatttttatccacttaaatcttttggaaaattcatgcatgcatttctatttctatattttccctttttctatggatggaaattccttcaaaccgaataagtcctaagctctcttgatatcagctaatttgtatgcgtactcgaactaaacttggaacacattcacacacacaatccgggtttacctttccgttttcgagtagaaaatcgctcctcatcgggttatcgaaaaccaactgaaaaccaatagaagccaacaattttcaatcaatgtcgtacgaaaaccagataaaattgattggattggttttcacaaaccgactagttttcgtgaaaactaatcggttttgtgaaccctgtgcacaatgtgacttactgactgatagagacacagtgctcttcctcgcaaccaaacaccgatatcacaatgacagacatttttgtgtggtttcaacttcgagatgttcgatccacatctttttgtcaaactcacatttccttcttgaatattggacacaagtttcttcttggtgcgcgtcgcccctgcccactgggcattgcatgtcagtgcaagcagaatccaaccttgcgcttccaatggcgtcaggaaggccaattagccgccgctgttcgccgccggtgcggcggcgacggcgagcggagcggcaggaagacgagaggcaatccaaggattaaaatgtaaatcgatcataatctgtggcaggggcgagctccgtgaatggcccatgttccaaaaactaggcccatccaacccaaaagcgctccaaatcgtttcctgtggaggcacattaattaattattatcatgatccatttgccgatttcgttgtggaagcatcgatccaatttctacctctatgacaattctatgacctcgggggtaactattattgtcaccgattattatttggttcatatgggaatatctatatctataactaatataaatatttggatttttccggttgtcacataatgcttccgatcaatttttttcgtccgtcgtccgtgtttgaatccgagaccgtcttgaaatttttttttcccgagcggactcaaaagaagccgaaaaagaaaacaaatatatatcaatcggcattggagtgaaaataaaagaagccaactcgatcaatcggctaatcgagtcaattgctcccaatcccattgcccctaattcccaaaatacatgaataacaaaattactcaattgcaatcccaaaccaaaataaaaaatctccacaaaatcaacatcccaaatcaaaccggcgtcgtactgtggttactatatcaacattccaaatcacaaaatcctcaaaatattcacaaataaaaaaatcaaaccaccgtcggctccacgtcggggaggtgaggggcagccagggaggcggggagttgctgccaacaccaggggagggaagcagctgtcggccgccactccggggaggggggagcagcagccaccggataactgctagaggagccgctgccctcgaatccgccgcaggaggaagctgctgccacccgatccactctcagccagcgccaccgccaccggatccacacgcggtcgccgtccccgctgtcagatccaccgtgggagggaggagagagggggcagagggagccgtcgccgctggatccgtcctcatccgccgccggatccacccgcggccgccgccgacgccgccatcgatgccggatctaccgcgggagggaggcgagatggagaggaggagatggcgagcgaggcgaatccatccgtggctcactcggcctccccgtctccgaccactctctccgcctcaagctgctcgcctccgaataccaccaccgcctccacgtcttcgccctccaggaggacctccatggtgatggcatcgtggatctggccggcaactcgagggaaaaagaaggcctgcgacgatgttgtggataggccgtcgacgatgtggtggatcggccggcaacgttgagggagaggaataaacggagaaagtgaggagggagagaggcggagaaagacgggaagagagaggaaaaaagagggagctgcagtctagatatttttactggtagtacatagtgtacgtgcttgagactttagataattacagtcaagtggcattgtgctctatattgtggtaaccacaagattgaatttcgctgaaaacaaactatttttgacatacacgtaccaactttacagacaagtaatattttattttattattactagcaaaatacacgtgcttcgttatgggtaaaagaaaccgttaaatagtataaaatgcaaacaattaaaatacttgcacgttaatatttgtttgagataaaaattatcgattgtaaaaaaaatttaaaattttccacgagacaacatattagagacactagcggcaatagacactagtggtggagctattgtgagcctctgactcatttcatgcataggataggataattattactgagatgtgcacgagatgcgcagcgaggttcttagtgtcaatcaaagcgatcgcctcagccgtacgacgcggcgtcgtgcatgccatgtcgcatatgacggcgagccgcctagcccggttaaggaatctcatagcggtgagcgacatgtcagggaaagatggcgaggttgacctgcgaggtggcgccgcggccaagactggatgggcggaacccgcccgtgccgcggcggaccgcatgatgggagtatctgcagagctagctgtccggtggcggcaataacaagagagtgggacggcagcggtggctccaaaggtggagcacgatagtcagtaggagcagaaggagtagcatggctatggcggtggccgtggcaatgatgaggaggtggtggctgtggttgttctcaaggataaacttgtcttttataaaataataaaataatacgtcgggtatcaaataactaattaccatgtaggacattgactcacaagttgtaggaaaaaaaatccgtcgccgatgccgctaccgctgccgtatccgctacaagagggaggcgagagggagaggaggagatggcgagcgaagcatgagggggcggagggagaggaggggcgggggagagtgagagtgagagagattttgtgtagggtggggagcgagtatggacaaggacgggacgcgtttggctcgtctaagtttttctggtgtcatttattttttaaaaaaacccaatatttatagtataggtatcagttttgtttaaaatcggtacctataattcctgaaatgtgctgattctgtatttttccaccccccgcttaggtgggaaaagttgtacttgtgatggttttaactgtttcgacacttatagtaccgtcatctatatgtctttttagtggtgttattaggtatatatttatcctcatgcgatttataaatcgaaaacaatactcccttagaaaaaaacaattacattggtttctatgatttttacgtgccacgatttagacgtgtcatcagttcaagtccatactttttttcacatagcaacgcacgagattatttccacaattacattaaaaatatagtttctatatgtcgctattcggacgtgtcgtcggttcaacttcatgcattttattcatgagtatattcaacaattacattatacatattataagaaaataaaatttctatgtgtcgcgattcggatattgcatcagctcatttccactcattttcttcatgtaaatagttcagaagtgtcattatccggtgcaacgcacgggcattttgctagtatgttaatatattcaaattacatactcaaacacctaatctattaacttattggagtaataattaaaaaaaaagagaaacatacatgtttgctctcagggcctagatattctcatattaattggagaaaaataaaaaaaatcatatggaaatataatttaaaaatagctgaaattcagaacttaaaaaaaaggaatatcagaagagaagactagagtccatacggtacacttcctacattccaaaatataaggctcaaccctttttttttcaaatatttcattatataaggtgtgcatgcatgaaaacaattatctagcatgtcttatccactaaattattgttttttaaacccttcattctcaagttctctaattctaatgggtgcatgcactatatttattatatttattaggggtgatccaaatggtgaggtgataataattgtttcttattctttgggttaaggatgattgtgccttatattttggaattgagggagtacaatttagagctaattgaaattgagaatttaaaaaaagagaaaaattaaaagtagaggttagagttcatatataaatacaatttaaaaatagctaaaattcgaaattaaaatataaggaatacttgaagaagagtatagaatccatataggaatacaatctagaaataactgaattcggaattaaaaataagaaatattaaaagatgagtttagagtccatataaaatataattagaaacaatagaaatttagaattaaaaaattattggaagaagagcatagagtccatgtagaaatttagaactaactgaaagttgaattaaaaaaaagaatattaaaatagagtttggagtacatattttaaatacaattaaaataaactaaaattaaaaattaaaaaataagaaatattgggagaagagtctagattccttacaagaatacaattttttaaaaaattaaaatcgaaataaaaataaggaatattgcaagaagtgtctagagtccatatagaagtacaatttagaaataattaaaatttggaatttcaaaataacaatattgaaagaagagtgtagagtccatatagaaatataatttacaaataacagaaatttagagttaaaaaaatagggaatattgtaagagaagtatagagtccatatgtgaatacaatttagaaataactaagattcgatatttaaaaataagttatattgaaaggaggtttagagtccacatataaatataatttataaataacggaacttcaaaattaaaaaacaaggaatattggaagatgggtctaagtccatataggaatacaatttagaaataactaaaattaggtattaaaaactaattgataattatcatgtatatacaatacaatatgcatattacatatttgttattttggtcaacttagtatagaatctaaattatattaccattttaatatattttaataataaaatatgaaaataaatatgttattatgtaaaaaaaaacaatgctagccacaaaacctgctcaggtcaccatgctagttgtagtaatagtagtggaaacatacaaagggcggctaaggttgaagcactatggctagcttggctagggctgaagccctatgtatagcgctacaatcttcaatataattttataaagtgccatgtaatttgtgaaaaaaagttacgttcttattagtttagcattataggtgaaagttttatcatggctcaccactgagtggggacgaatatatgttgttcacatctgatagtaatagttggtggtgtatatctatctttgtccttataccacgcatatcacattgtacactaacagctcaattgtcaccttgctgatgggacacagcgaattgatcgttgtatttatagtgtatttatagtgtgtaagatcaaattgattttgtggttatacatatatagctcccttctgccagcacatgccgtaccatgcatattagtattatgacaaacccaccttgatggctagaaaacctcaactaataaatgtacatatgtaacttttgtaattatctttttaatatacgttgtaggatgctctcctacaatagggatggaaacggatcggaaacggacggaaactaactttatcatgtttttaagattttttttacatgttcttctttgaaaaaactgtttttatgtggcatatgaaagaggaatcacgataacttgaacggaaaataattattgtgtagcatactaaggataatttaaataaaagagcatcaatacaagggtattctattagcatatgaaacataaattatactttttttagaaaaataaatacatccaaaatgtaaatataaagtaggatatgtaaaatattttatatttttcaatacttctattggtcaatcaattatcatccatcgtaggttttaaagggcattttaggtcttttttagaaaagtgtccaccctaacggtatattataaaaaaaatcaaccatgtattataaagagagacaaattctatgataaatttttgaactagagtaaactcattgatatactccctccgatccgtctaaaaaaagtctaattctaaagatgaatctgaacacagggatataatagattctcccgaaaattacatcaacagaattacagtggatccgtacggaattatagctgttctaggattaatccattgcagcggaaagctaaattaatgatgggtacaatgaacagttcttacattctgcccttgtttgaagctgtttaccggtagtgtattccctgctgtcgagccacacgttgttgacgccattagcatctagctaagcgacacgtactattgtaagagcgaatagtactgtagaagtcttaatacttatcccgaaataccacgtaagctcatatatgataatatgatgagaagagaagaaagaaaggattgtgaaccacctctcatacaagagataaccttcacatttaaaacttttaagaaaaaaaaattaagtgtggatcgaacaaacaaattaaaataaaaatattgaattcagtgagctagagtacatcagattagaagtggtgattagctcttctgtaaaacttgctcttagtgtagctaggactagcataagtacagttggtccttttcaccactaaacaatgttaattacagctaaaaaaattactatatctacttaaatgaacacgcccatagagattatgatgaggaaaggaacaaaagcagagacttgacacttgtatatattatattgttcttgccactctaaaagccgccaataattcaaacaactatatgggattctctgcggctaaaactatgacacaccttataggattatttggggtcgcaaaccttctgtataaatttcacgtataaagcagacgtgaacattcgggagccttttgttccctcggaaaaaaaaacattcgggatctttttggctgcgtttgttcgggagggttagaaaatgaaaacggttccttttcagcccgtaaaacaaagcaatgaattagcatatgattaattaaatattagctaaaataaattaaaactagatcaatatgatttttctttttaagaaacctttccatataatttagaaaaacacacaccatttattacaccatttattagtttgagaaacgtatgtgaaaaataagaagatataatgaatacaaccttagcttctactccctcccctctatcccaaataagtttatttttcactcatcccaaactatgaatacagagataaataagactataaacctctattttattaaatcacaatacaattattctccactttatctactcccaacacaattattctttactttcataaacttcgatgcaatgattaaaaaagcttaacttattttaggaataaataagtagagccaaaaataaacttattataagatggagagagtagagatttcctggaccacttgagctataatttttgtagatggaaatcaaaattaaggggctcggatgaataccgtgggccttttgatttgatgatcattgataatatgagccccaggtacgtagatgcaaattaagtaagatatcaatatcatcaccgtgttccacactcctgtataaaattggagatgtgtccttttattagttaattaaatgaacagagtaaaatttctcgatataatcacaatatcacgctcacgcactgttttaaagttattgcagggaccaacaaggatggttactgaccggaagactatgaattcatgtgcaaaattcaaaaaactgtacccgaaactcaaatatgtttttttaccagttggcaacaggccgattggttatcggacaaaaaaaatctttttggttctgaacttttgcctgataaaatcatttcataggatttcaccattggcatttgtcgatgggctgcacccatctaggatatttgagtatggggatcgttgaaatctgggtatacgtgagattgagataaagagacgggagatagatttttatataggttaggccccttaattgacaggtaataaccctactcggctactcctattggccgaagctggtgttgtctttatatatcagtatcatatgagtacaatatttgcgataaactaatctagtctttgtcggcttggcggcatggagctttcacacgtagtcgatagctagtatagtcttcttactcgaatataattttggtcatgttagtctttgtggctccacgttgggtttgtgtagatctatattggcttgtcttatgttggcctacccctctcctcctaggagttcttgtatatatttatagtgatgatcgtcttcctccccaagtataactcaaaaacttaggataagatatggattaaagagatattatgtttcctgactagaagtctgacatcttctattttggaaagataacttccttctagatatgtagtactatttccctaatcaaaggatacattcttgtatatctcattaggtatatggtattttcgtatactataaacccatgtatagtaggtatgtcttatccttaacactgacaaaattacattaattttgaagatagcggcattataatttcaacaacatctgattatagcattgccaacccaacaacattgcactcatacattagtgtgaaattattgacacaatattttggatatggcggcattataatcctggtaagcttcaacgaacattatattatcacattgccatcaaaaacagcaatacagcatcacactcataaacactgttgtaatatatgttaatgtgacaatctcgccacatttatcacacgcatcacactcatatacattttagcaccacttacattggcgctaagatattgtccgatgtggcaagattgtgacaatgtgatatcggtgagataatataatgtgcttcagcgaacatttgcaggtatgggtgtatatatgggcccagaaagccaggcaaggaccaacaaagggtggttattggttacccacatgaatgctatggattcatttgaaaatttcaaaatgtatatctcaaactcaaatgtggattttgttttttcatccgataactagcaggctaccggtaataaaaaaatcatcaattactatcattttaatatgatttcaccaaaggccgtaattttggaaatagtagaattacggtcatgggaagcttcaacttcagtatgaaatatttatcaaaaggaactgataagaatatacttgaataaatatttatctcctgttggagttattagtttttgcatcgtcaatttttagattttacgtgctctctattaagcgaattacgtaataaatgattgtaaaattaaaggccatacttcattccgttatcgatgagaagccagcgaaggcggtttatttagtacctttacttggtaaagcatgagaggtgtgccatcttttgccgaaagtgaagaactcgagcgcttgcgagcttttattttagacatttttaataaataattttattaatagatatcccaagaacttatttctaaaatgaaccattttgccacgccactggaactggcgtggccaaactactatgccactctaggacaggtggcgtggtaacaaatgccccgtgacgatcattgcctttggcaaggtcaagcgggtgctgacgtggcagggggctgaggctgggcttgccacgccaggcttggtggcgtaataccgccatgccatcccgcctagcatggctagggaatagccgccgatgtcgtccctttctgccttcttcctctcttcttctcctctccgttgctctctctctctctctccccgcatgaagcaaccaatgccccctcctcaaatccctcgaaatccattcaaaatccgatattcttactccgattttaagcccttttgagtaggagcccatcccataggtatatttccttttttaggttttttctcgtgtttgcatttagttatttccatccttctaaattgcagtgaaaacatgtaacaaggaatcgaatatacttgaaccattcatatcttcaacacataaatcaagtccatcaaaaccattctaaaatggattcatccaaaccattcattactatgtagttttctaataataccatagatattttatccgatctttatccgtttagtaccaattttctaaatacaaacttgttatattcatcataaaccacaatagtcatgaaattaataaaacaataatcctaacacatgaaattttcttatcgaacacttgaaattatttcttaaaaggcatgaaataaatagggctagctgcattgtcaagccaatgagccggacatttcagctgccacgccatggaccctgacgtggcaataagttctacgttggcgctgcttgactttgtccacgccaactactgccatggggcacctttgccacgttaagaccgatggcatgacagagtaatttggccatgcaggttatactggtgtgaaaaaaaaggtttatttttaaaaataagttcatatgaagtctattattaaaattatttattaaaaagtaaaaaaaaaacacatacacacgccctagctcactccagctgatccaaaatactactccacccaaacaaaccaaaaaaaaaactcaagttcgcagaagatccaaaccttaaacatgacacacaagttcatacgcctgcttggcagtagaccagtccaaatccaaccctgtcccccaaattaacaaaccccagaaatgcccccaaaagacaacaaagcactcaccacccccccaaccctaatcagcatttgattttgatccatcctcatcaacccccactattaatcctcttccccttccccccgctctccgtccatgttcaccccgcccccatgccccgcaatcccatccaggttcatccgcctcccgtcttctttttttttaattcatccgcaaccactgcgaacttgcgaaggccgcgggtacaagaaaagaagagaaaaataaaaaggagccgcattataagtaggtagtggtggtggtggaggaggaggagagcaaatcgaggtagccatggcgatgcaggccgccttcgccgcctcgatgttcccgcagctggcgcagcggaggggaagcgatcgcgcggtggtggtggcgccgccggcgccggcgccggtgagggtggcgatgaggagcggtggggcggcggcggcggcggcgagaggggtgaggtgcagggcgagcctgatcgagcccgacggggggaggctggtggagctggtggtgccggaggagggagggcggcgggaggcggcgcggcgggaggcggcggcgctggcgcaccgggtgaggctggggcgggtggagacggagtggctgcacgtgctgagcgaagggtgggcgagcccgctgcgagggttcatgcgcgaggccgagttcctccaagcacttcatttcaacgccatccgcggcggagacggggccatggtcaacatgtccgtgcccatcgtcctccccctcggtgacgcccagcgccgcgccatcgaggcgtccggcgcccgccgcgtcgcgctcgtcgacgccgccgaccgccccctcgccgtcctcagcgagtgagacatcccccctaccccacctcttcttgtttcccttgtttagttagttgcatttccctgttcagacgcttaattgcaattatttggttactaggagtgcttgctagaagagtaaaattactaattacatgagtggatggaatgtagatatattgattgttcgtgttggttggttgattctcacagttgtgggatgcctttggacctccaaaagccgtaatttttgtgcttgggttggaaattggaattgtgggggttgtagcctgaatggttcagagaagttcataggtggtttcttcaattggaaacataatatgcagaaatacagattatgagtgtttctgtgcagttcccacatttcgtgagcttatccctcacaaacttgtgctctggttatattttagactttaatgctagtaaacaatttgtttcacagcaacctggtcaatgatatatcattcatggcggaggttttatcttgggcgttaaactaattttaaggttgtggcattcctcttttgtcgattagactacaatatcgtcatgcggataacctttgtcatgctatatcaggaactcaggacatctttatacatctcggtcgttttcaggtcatatttttttgagtcgtatatatataatacgatgatcggtaataccattggtagtccttataaatacatgttccgtagttcttttgccgtgttctctaggtattttagttttatctatattaaactgacaagtgatattatatttgtttcgttgttttttcgccgcgttctatgggtattttagtttaagcaactgacacatgatatgatttacatcagaaagattattttttattcaccatttgtttataagggtttgtacacatccagctattgtaagatgttgttatagaggtgacgtaacaacgtcaaccgtttacatctgtgtctaggaactcctcaagtcatgtgtgttcaaaacaatccgacttgatttagcatggttttagttctttttaattagttataccatggcattccctgacatatttttcttctttgttgtcagcattgagatctacaagcataacaaagaagaaaggattgcacggacatggggaacaactgcacctgggctgccttatgttgatgaggcgattacaaatgctggtgattggttaattggtggtgacttggaggttatagaaccaatcaagtacaatgatggtcttgatcagtatcgcttgtctccagcccagctgcgtgaagagtttgccagacgcaatgctgatgcggtattcgcgtttcagcttcgcaatcctgtacacaatggacatgctttgctcatgactgatacacgcaaacgccttcttgagatgggttacaaaaatcctgttcttctgcttcatccattgggaggattcacaaaagcagatgatgtgcctcttagttggagaatgaagcagcatgaaaaggtacgctttaagagtagcaatcgtactgtcaaatctttttagcaaatgcatgttggtgccttgttgttgatgaaaccatttgatttaattacactactgtaaggcccaattcatgcacaattttgatgcgtgtttattttggtaggttcttgaggaaggtgtcctcaacccagaatcaactgtcgttgcaatcttcccctctccaatgcattatgcagggccaactgaagtgcaatggcatgctaaggctcgtataaatgctggtgcaaacttctacatagttggaagagatcctgctggtatgggccacccaactgaaaagagggacctgtatgatgctgatcatgggaaaaaggtgttgagcatggctcctgggcttgagaagctcaatatccttcctttcaaggtatgtcatcctaccagaccagatatcacattttttggatgcactagattgtgtagttcgctagcttactgtccatcttgtacatttgaatttggatgtcaagcaacatattttagttttcagataaaccttgttgtattctttttcttggcatgactcctgatttgttttatcaggtggctgcatatgacacaaagcaaaagaaaatggactttttcgatccatcaaggaaagatgatttcctgttcatctctggcacaaaggtaacatccatttcaatcctgttttggtacaccagttaattttgagcaccaatgtttttttccagcccagtcctaacaacattgcctgtgttatatagatgcgtactcttgccaagaactgccagagcccccctgacggattcatgtgcccgggtggctggaaggtccttgttgaatactacgacagcttgacgccatcagcggacagcagcaaactgcgcgaggcggttgcggcctagaaagctgaaactacctcaaataagcaagaacattgcatcttgcaactgtaaaatggttctttcagagagagaaccaatggtatatgtgtatactactggtcgcaaggcctaaacatttgggtttgattggaagcgcattctggtgtgatttgtatgtgccctatcatctggtaatgctacattggaagctcatcatgttgttggtgttaataaggatgagcctttgtgtgctctgctagatatgtacatatacaatgtggtggtatttatatagtgcttggtgtgtttgctattatagaagagcaggtttcatcttctattgtcgcatctggtcattggacagggctcgaggacatgagggatggtcagcaatatttttgttaacactggaatctcatcaaggtttctgtatggtatgggcaattgctttaggctagagtgaacttcatattctggggcaacgattattttcagagacagaatcaggggcagaataattattgacaattacttataggagagaattagatattattatgaagtaaaaatagtttgaaaaaagttatctaaacaatgctaataaaaaaagcttttaacatagtctcggaagaatggcatgaataattcggttgatagtctgcctccgaaagcgttgacgtataaagaatggggaatctgaagttctgaacccttcccctaatctgaattctgcatttgtataatacgagtagcaaactctaataaatctacgtctcctgaatgcccttgaggagtttgaatatacacacaaacttcagcctctatgatttgatcatttgatgttgaaagctctgttgacaacgagctaatcatgccggtgcacctacagattttgtgtcgatctaccaacgcttattcaaatgaacttgtgtcgatctaccaacgcttattcaaatgaactggtggtatatcgccaccatcttgtatcaacctaaacaagagtaggagcagcaacaagaagccacgcaaagaacttgttgcttgtaatatttcgcttgcatcgttcatttacactgaaaagcaggtaaagataggcccggcgaaaagcaggtaaagatacacaaagtgtatatacatacagaaaagggaaagccgtggagatatttgagtcgaacgctatctaacaattgcaacgtaccaagaatccagtttccatctcaagaaatgaacaagttccatagaatacctggggacaaagctatctccatctcgattctcgaagatcaatcccctccagcatccttgacatcgacggcgaactcgtactcctggtcgcagcccagataggaatcagacatcaagtaaaccatgtaatcttttctccctgcttctggcaggggcagcgaactcgagcttcactcgagccctcttctggagcttgaccctcttgattgccagcaactggtcggtggagcgatcaccaatcaccagccaccatccttcttccttgggctttgggaacctgggggcatggactggaccagcctcagattgcagcaggtctgccatctcgcgctctagcgtcacctgcacggtcacactgccaccatcgccttcaagaacttggaaagccatgtcgatgtttgggaaccgcctgaggaatccgacgatgtcctgcagctgggagcttggtagctgcagcagatcctgcatctcatgcgtgctcatctcagccagatcgaagatggtctcgatggccttgccttcgttctcctggcatctccgggctaactcctcggtgaagtgtggaagctgaagcagcacggaatcgcgatcccacatgccctgtgtcaccatctggctcagctccattgcgttgagagcgagggtgagccatccgttgctggagatgacatcgatcagtgcctggagcaatctatgagcaggaaggagaatctcccgctggtcagctgcaaggtcaccttccaccgtgcgccttgagaaatggcattgcagcagtgcgttggccttgacatgtggatcgtcatacctgactttcttctcgacagaaaatctctggtgatgaacaagcctctcaatggatttttgctcaccagggcgactggggagatctgcatattctgaggcagaagctagaatctccaggaggcctttcaacttggtcttctgagttagcatagaactgaatcgctcaatagtcgtgtaggtgacgtagtaatacgaggcaatgagaccaaggttgagggtcttcaggtaaatattttcctcgatagccaaacaattggttgattccaggtcgttcagcactgtctcaaccagctcagagagatgttctgatacatgcctgtggctcacatcctgcagattgtagtagttagggttcttcgcaagccgtcggtacatgaaggtccaagtaagataatccacggcatcttgcttgttttctataagaccagctaccacctcggcattcatatgatcatgcaagaagtgctggagatggctctcaacagggaaggcctcaaaaaggaacttcttgtagtattccttgcgaggcgcatagcacaatataacacatttcccagagtcatcttgaagaggcctgttggcatggcccatcatttgcaacagatcagtgactggataatcagtatggctgttcccccggccatcataatactgggttcccatcacaacaaccagatgagagggcaatgatcttccccagcacattttgctgcttgcaacacacacttggatcctcccaccaagaaagagctgagttacaagttcctgatcgaagtcgctcaggccctcatgcaagtagcctacaccacatttcagagtgtatttaagtgcttcatcattgacaccactagtgaaagtatccatctcgtcttctgacccaagaaggaaaggtgttccaccactctcagcacttgagtgtgcacacaaatccactgcggtcaaccttgcatgcttatgtgttggtacaaacaccagggcaggcttaccatgctttgcatgctgggttatagcagtgtatgttggctttgacattgcctgcatccttgcctcaaaaattgctacatcccaaccctgaatgtgaatttctaacggcagtggtcgcactgctggagggaagttgaaaaggctatgagaggaggtgccaatccattctccaagatctttaccatttgcaagggatgctgaaagcgctacaatccgaatgttactaccaatatgattcgccatatgcctcatcctagagatgatgatttccagaatatgcccattttcagatccaatcagatggagctcgtcaaaaataaataaactgacctgttgcacattctttcgctgtttccatcggcgtgagagtgcatcccacttctcagcagtactgattataatctcccctttatcaagaagcttcaaatcagctgctgtttcgcctgttagctcaactacccgcgccaattctccaaatttgctctcccaatccttatatctttcttttgcaagagcttcaataggagctacatacacaacacgcatgttgctgtcaccagatacagccttctgatggtttcttagaatagcaaactctgcacatatggtctttccactgcctgttggcgccgcaaccaacacgctgtcatcactgttgtacgaggcagtgaacacttgagtctggatggggttgaaatgtttaaaagcacagtaaaggctttcatatcgtgcatttctcagggcagtaacaggtagtggctgcagatcaatcaattcagttggtggagcatatttttctggaagagttaaatgcctaaaactgacaggaagaattgtctgagaaccaagccacttatcagatactacgcgtataaagtactgagggggcagtggctcatatattggcactgtgaagttaagtgtatgatcttcatccacgtattgtttcttaagcatgaagtactcatggtgaagaatgttatcgccaccgttgtcctcaacaataagccagaagggctccacatatccatgcaattcatcatcccattggaaatcagctgttatagtcagttcaaaacccaaaaccgtaggagtaataggttgaacatgggctgaaaggttcagctttggtaattggtggatgcacttgtgcagctgcatccccatcttcgggttacgaattagctcaccaatttcctgtgatgataggtcaaagtacctctcccaagccaattcttttttctccagtttcattaagatttcctttggaatacttggaaactggtgcaggggaatttggacgttccatatatgcttatcaatcatcttgcaaagattcaacgctttctccgctagttgggcccatcctctcttcaaaactatctcaaacagcgctcgtaggagacggccagcattctgcatcataaagtagaaaatgctacgtaagattaatagaccaaataagcataccataattcaggaagtgcattcagcagagataacacgtttttacctgtctgatgtagaccatatctgaactaagggaaagaccctccagttccagcctagaaatatatgcttgcagtagaacattgatctttgcactgggctcgtccaagctctctttcacaggaataggcacacaattgaaaagctttgccaactccattttctcatcctgtctaacactgacatacttaaattcttcactcagtgaaaagagtcgacacagctcaatatcacccattgtaggcttcaggcactcattgtatgttgagatagtcctgtgactaacatagtaataactagcaatccttcccaggtcagttacctgaaaatatcctgttttcctgtcatactttatcaaattgttccaatccagtatatttgcagcagcgtgtacctgcaacagcacatacaggaatcagagtgtgccgggcagggaacagaaggggtgagacaaacatattaaacatggaatgatgaaaaatcaaggcagcatctatataaacactaacaatacaatgatagatcatgatacttcttcaaaatcttgtgacagtagttattacaaaatgatgacatgcaatgaagcaagacaacggaaatcatcagacaaatagctctgaatcttttttctcccttttataaaataattgattatctgataggatttcaattcttcttccttattctacgtaactgtatagataattcaaatcaaatgtcccacgcaataatttcagatgatatctggattgcagcaaatagtctgttctgattttgtatatattattttacatgataagtaataacacaatgttttatattcataggaagtacatgtgctacattttacatgtaccacagttacatgtgctacattttcataaaatgctatatatatacattactccctccgtcccataatataacaatctagtaccggatgtgacacttcatagtacaatgaatctggacatgtttcctatccagattcgttgtaccatgaaatgtccaatccggtcctaggtttctatattatgggacagagggagtatgtattaacaatgaagagacatgaacatgaatagtttgtttcctgttactattattatactaagaaagcaagcactaatgtaaggagcaagcagcatagatttatacttcctttctagatgtatttgctgtcttttttaaatgaacctcgcaatattttgtatggttcgtttaaaaaagacagccagcacatctggaatggaagtataaatctatgctgcaaataagcaggtaaacaaaaatatccaagagcactgtacactatccattctagattccaacatgcaagtatgatgcaagtggtgaagtggaggaattcattccaggtttcttcactacctcataaacatcaaaggactgccctattgcagtttatgaccgcctagtcaatactgaacagtgatcatctcagtaaatgctaagaaaaaaattttacgagaaatatttatgctcacgcaattcctgaacattcagaaagcctaagaaaaaacttggacagttcataccacaatggacctaagagagcatagtgggattgtggaaatgcaagcataaagtgtgaacaaatattggaaagtaaaacaccagaatgaaaggactaatataaaagaacctaaaaaaaggataggacataagtttttacttaccaagtcaactctcctttcatctagagtattgtctgtttccataatatctgctggtaaaccgtacaacgttggattccggagcatcctgatgtagaggtaggtgtagccaagccaggtgcatgcctcccgaacattctgaatagtccccagaacgatctcagcattcagatgatcagccaatctggatatgaactgactctcaataggcagttgctgattcatcagagacaggtagtactgcaattcactttgttcagttagtattattccctctccatgtgtatcatactgaggtctgcccgcgcgaccaagcatctgcatgacatccagagggctcagttctgtccaagcacctttttccggattgtaaacctgggtaccctttattattacagtgtgcgcaggcaaattgacaccccatgcaagggtcgctgtcgaaacgagcgcctgtaaatgtttatcagcaaaaagcccctcaatgagctcacggtctacccttgtcaacccagcatgatgaataccaaacccatacggcaaaagatctttaagatcattgcttttcacatgatttgcatgatcggcaagaatctctaggctcgcgctctcaacctttggaaagcaggtcagtttgttattagataatgcaatatctttgatggcacgagcagttttggctgtctccttcctcgagtgcacaaatataagcacttgatgctttccagcagcagccataaccttctcatagcaaatctgattcatcaactgaaacctctggaagggcttcttcacagtgatcccaatgtattgttgagcaagagggcaaggtcggtagctgttatcaaaatggaagagaccaccagagtgaacacgcaagaaaactgcaacatcttgatagtttggaagagttgctgagagaccaactagacggatatgttccttggttgtttcagtctgcctgactgatctaaacaatgctctccagaacaggccctctgttgtcatgaagtagatgaatctcatcaattattagaagcttcaccatttgagtatagattctgtcacctgattttcttgtgacaatatcccatttctcaggtgtagtgacaataatctgtgtttcatcaatctgttgtttggttaagttctggtctccactgagttcccttacagtgatattgtactctttcagccgtgctgacaaatttccaacaacttcagcaaccaaagctttcattggggctacatacacaattttgtatttggtattgtcaaactctccatctttcatgtgcaagccaatctgctgaaggattgtaagcacagccacgttggttttcccagcacctgttggtgcacagagaataatattatctggtttgaaaagggcagtatcataaaccttgctttgaatcctattcagctgtgtcatcccagcaaaagctggttgagcccagtctggcatatcagatatcttgacaaccttctctccattttcatatggcttagctttcagtgctggcacatggacttcctcatacccgttatgaggggttctaaatgatcctggtggaagttcacatttcttgttaaccatcaagagaccaccttggtggaaggttaggttctcaagatcaagcagctgcttctggcctttcaaccatccactctccatatcccgcttaactaccctttgatccctcgcaccattaatgccagcattttgtttttcggtaagcctcttggcctcatccctgatgcttttctccatattcttcagcctatcttttgcagacaccctcgttgcatgcagctgctccaatattggacttaatgttgggtcactcagcatattctcttctatcatcttccgcttttcctgaccttcagcccttgccaaacaagtacaccagaatatcttgagtcggttccgcaccagcaatttgatgaaatcaaaattgtcatagcccaatagcgtgacaagccgattctcaacatccttgtcgtcactctcagaaagaaaactcatgatctccaaagaaagctcctggctaacctgcggatcaatatcttcatatgcctgtgataccttcctctgaagccagtaagcatcaatgtcttgtgcgtttatggccagctcctcattggagttatgcatatcatcatcgtctaactcatcaccaatttgcatggcaccagcagcattcagcatggtgtcgccgtcgtcctcatccaaatcatctagtacctgatatagacaaacgttgaagggcattacacattaggaattaggatatgatctatcagtacacgcagatagaagggagagcaagagattgtaaacagaaggatcatttgaatgtatgtacctgatcagaatcacttccctcatcgtcttcgttctgttcaaactcaacagcaacgccgaaattttcatccagttcactagctgaatcacaaactgcagtatcatgaaaatctgtgatgagcttaccgatggagacgaactggtggaacatctggtcggagatggggtcgaggaacttgtcgatccccctcttcttctcagggctcttgatcttgtcattgttgaggatggcaagcacctcgtcggcggcgctgccaagcacgtcaggaggctggccgccgagctgccgctggatgacgctgagcagggcctcgtaggcggctcgcgtctccttggtccggggcctgtacacgacgtcgtcgatgagcgtgagcacgctgacctcgcgctgcgcggtacaggcggaggcggcgcggcgcctgcgcttggcgtcgaggcggtggccgatgtcgtggtccgcggcgtcgcgcgccttcctcctgcgcggcggctcgacggggggcttggcctggacggcgcggtcgccgaagctcctcgggtcgatcctgccccggagcgtctcgggctcgccggtgtgctcgtccgcgccgccacgggggcgcgagccggagccggagccgagcacgaggttcgagttctcgacgtagtcgtacttcctcgaacgcgcgtgcgcctcggcgccaccgccgctacccggcttggccatggctgcagatcaaagtcaatcaaaagtcaaaaaaaaacaaaccgaatcgaatcaccacgcggccgagacggtgggggtaggtttttggccgaatcgatggatcggctggtggattacctttggcagggcgagccgaacgaagccggcgacctctcgccgagttgtccgccgccgccgccgccgccgccgcgtcgagtcgcggcgattctcctctcttctcgtcgtacgtcgcggcggagaagggaggaggagggtttggtttggagggaagacggcgttgaaacccgcgctgattttgcggggatcttttttttttcttctttatttttgcgggtatttattttgtgggggagacaggtcggtttgatggacgaaccgactttggaaacgtgtactacagtgaaaggaagcccacgtaacctcaggcccacaaggcccatctattttgacggttttgctgacgtcaaattttcttcttagatcgatttttctaacgaaaggcgtagtgtgcggttcgttacgtacgcggcattggactcgatgatgaccaagtgagggtcttgcatacatattttttcccttttcactgtataaactgaagtgattagatgataactctacttaaatgcatatgggagagatatgtgaccttcgaaaattacatactaattacgtgcaagttatattatagttacaatataattatattgcaaacgtaccatatttaatttgacaatagctaaatgtacaaataatatctgaatgtgataatttaacgctatttcacgaggggataggggttggcttttagtccgtgtgtctatgtatataatttgtatacatgtatatcaagtttatacgtatatgtataagtgcatacttttaatgtataaaatttttatatatatataaacaaaactttgtatatatacatacaaactttatacatatgcttacagagtttattcatatacgtacaaactttgtacgtatatataaaaatttgtatatacacgtacacatatatgtacaacaagtactccgtaccatatagaaactaactacgtgcaagggggccgcgcatggccgatcgttaattagcaatcttggtttcaacgtggtctacttttatccactaagatagtcttatatgtcatcctcaagtgtcgattaaaataaattggtaaaaaaaaagagtcaaattatcaaaattctcaaggttaccatatctataaatttcaagaaagggtttgtaagccacttacagaaattgaattctagaaattaatttttagggtttttcaattattatgttctactttttcagttttgtcttttgaaccattattaccaatataggtcttaccttaattttttattactttgtttatttttgtacgcaaattttgaaatagaatcacaaccttagaattgcattgaggaaaatcattacaagctgcaactatatcatgagcaggttatgcgcacagtggaaacattgcgtccaatctgggaactagtggttgcacccgtatgatttcttactagcatactttcactcaatttttttttttgaagcgaaaatttcactcaaatatttttttttctgttcaacatttttcatcatgagcacaaatagtttggaaatggtcttctccccaagattggtcatcatcagtatcctcgaatgcacacgcgaacaaggtggccagcaatggtgcaaaatagtttgatctactgtatattcgccaaaactccatttttttcccctagagaagaaagggttcagacttctgaatttacctgctatgtttcatttttatctgaccatttgatagatgccaacataaggaaggaaaatgaaatattcaaggtccataagaaatgaaattttcagagaatgactaaggacagcatgaaagcttgttaacatgattcccaaaaaaaggaaaacaagtctgactatctctttagacgcccggtcgctctgcctcgggggcgatgcgggcggcgaaacaagccgcgtcgcccccgtccctctcctcccctcccacgcctcgccgccgccggcaaagctgggcggctgcaaggacggcggcggcagggctctctctctccaccgctcgcagtggagttggacggggcgccggcaaggcgccgacgacgaggaagaaccgacgacggcgaccagatccggcgccgggatgcacggatccggtacccccatggccggatctgctgctccgggcggcggcgagccgggtcggcaagtcgcagcatcggcggcgtggaggtggtgccttcggcggccggagggccgcgtcgacggccggagggcggcctcggtggcgtggagttggcagcggggcggaggacgcggcggcatgaccgtggctgcggcgacaaacggcgagcgtggccagatctggccggacggctggcggcggcgctcgcgg

SEQ ID NO: 8831 - DNA, 2337 bp, Oryza sativa
ccgtggatgagggggaggaggcacggcggcctcggacagctagccgagggcgtggcagatgactgcatctggccggcgcagcagcgtttggaggaagggtcggagaccggcttggcgcagagaggcgcagccaatggcagcggaggccggctcggcgcgagaagcgcggccggcggtggaggaggcgaccttggtgagtggaggagctgccagtgggtgtggcgcggtcttcggcgcacgaaggctagccggcggagggcgccggtgcaggggtcccacatgtcgacagaggttgattggcagtggagcatcggtgtgtcagccgtggtttcgcaggtggtgagcggcaggtgaaaacccagcccggccttggccggaccgacaacaatggttaattccccctcctgagggcgttgtcgtgctgtctcgcccctcaagggtggttgccgggcgaaagcccagtcctggctcctttgatccttgacggacggcggcggcggttttccgtcgcttctcttcttgaaaacgtcgttttggcaccctcttgcttgacgatctcgtctgtgttcctttgttggtctagcggcggtcggtcacgcttagcggcggccggtatggtgctagccttctcccggacttgtgtttaggcgttgtcggtgtgtgggtggtggtttattttttctttttcctggttacgaccctccagggttgcaatcttataattttttcctgctctatcaatagaacttcgcaccgtctgtgcgagtcattcaaaaaaaattcccaaaaaaaataaaaaacatggatagacgcccttctaagtatatgtcaatttctaatacatagttcgcaaaagcgaacaacttttgaaataaaaccacaaccttagtatagttttaaatcacaatcttacaagctgcaattacccatagctgaagtccaaattttgtggttcaaatacagtaattgagagaatggaatttacagtggaaaagatgctcccaaatttggggatcagtggttcacacttatgatctatgaacggcatcttttcacccagatatcttccgttcagcgtttttcatcattatcacaaattcatcgtagttcacctgcccgtcgccatcggtatccgcctcccttatcatctgctcaacctcctcgtctgtcatcttctccccaagattggtcatcactgtcctcagctgcacacatgaacaagaacatggtcagaaatgatggataacagcttgaaaattaatggtctgaactgcttgaggtactaaaccacctcagttggggagataaaaccattctgatccttgtctaggacctcgaaagcttctttcagctcttcgtcgccatccccatcctgcgatacgcatggaatgcaattgcagagacagatattggaaatctagtttggcaaaggggaaacagatactgtagatcatcaaattaaagtatccatcaaagttcaagcttcaccttcatcttcctggcaatgaggctcaggaactcctgaaaatctatgatcccattgccatctgtatcaacttccctcatcatgtcgttgagctcctgatcggtcggctcaaggccaagagaacgagtcaccgcagccagctcttccaaggtgatgcatcctacatatatgacaaaggttccaatatcaaatgtcaattaggatatcatagacgcatagacctgaaggctgtaaatattagcaggatttcattgttgtgtaactgaagataatagccgtgaaaacatgcctccaatgctattgctatttgcttactagcacatagtaggtttttgtgcatatccaaaacgaagaccaagaccacaccatgtgcaaaacacggtcagaatcattgaccaagatagagacgtcaagggccaatgaatggtttaactactatttaataataactatgtgtatatcatagagttaatggcaagtagtggtagcacaaatatcagaaaagcagttttggaggacatattacggattacttaaggaacttgaccactagataagcatgtctcaacaactttttctaaacaaattaggtaggttacacattgcaaagattaaagggccctcactagtcaagaaaacgagtgagccaataacaagcacctttctgtcacaaactgaatgattctttgaccaaaggaagctctcaaactagtcgtgcagcaagcaaatccctgtcattgggcagcgtagaaacttcagggaaacgtttcctaagaacacagaaattccaattccatctacagctccagcacacaaattaaaacaagatgtaatacatatatataaaaaat

SEQ ID NO: 8832 - DNA, 22259 bp, Oryza sativa
  unsure (1)..(22259): unsure at all n locations
tcctaatcatttcctgcgctttccctgccattctactcaggaaagcgaccacaattcagcgctggaacatatattacactcggtataactcacagcttttctcgttaaacaactgtataaaaactagagtataagagcaaattttgtaatactaatatatagccagacgagaagcgtatgcgagtgtacgacctgtgccacgcaatgccttgtcggtctgatggtggcgaaaacgacgtgaaacacaacaggagaaattgagatgagatgagatgataccggtgttgtgaagatcctccaggattattccagcgatgtagagtacctgaatgacagccaagggtgaaagtaaagggtaagtaagtttctggggataaacagcaggggggcaacttgtattggttattgatgcaagaattgacttggaacagaatgataacctttcattagggttagtagctttagctcggatttgagtagtagaccatcctgcagtgatcaaacgaatcagaataaagtagcaataaactgacctccacgtaccgtatatctatgctggatccagtcagcctggagtgtaaaataatgaaaagtgacaaagaaaacaaagctcttgaccactgagaaagtcaccggaaaaatgctcgaggagcagtcagatggagaactactgcataatcaggcatacatcaaggaacaagccgtagaaatgcaacagcatcaacaacagtcacagcacagaacacaagtttaccaaccgacaggactacatcataactgcagagaccaggcaggccatgtactacgaaatcgactactctaaaagaaagcaagaaaagagtgtaccatgacatcggcagattgccacaaattaagcaaagggaaccaagtttgcattaaggtttagtactcaatcaaagttaacaaccgaccacaaatacagtgttccaatgactgaagcagtacgaggaaaccattacacagatggattgctgatatatgaaaagcttgactaaaacctacacggtaactaggactcatcacacaaaagtccagtttaaactaaggatgctcctgtcctaatcttcactctttggaggacttgttgatcagggacttgtggatgtgaggaatgacacctccaccagcgatggtacccttgatgagagtgtcgagctcctcatctccacggatggcaagctgcagatggcgaggggtgatacgcttgaccttcagatccttgctagcgttcccagccagttccagaacctcagctgttaagtactccagaatagcagcagagtaaactgcggcagtagcaccaacacgtccatttgcctgagtcctttgcttcaactggcgatggatacggccaacagggaactgaaaatatgaacaggaaaaattatcagagtccaaattccacaattcaatatagtgaactctataccaacactaatagtagaaccattaatatcacattgacaaccaaagttgttttctttatatcacagaaacataaaatatagcaacgccatacaagcagtagcacataaagttgatttcataaatctgaaaaatactagtatatcatggaccaattgactcgctgacatgctcacggtggactgaaggatgtgacaccagatagcacgtacaaagaagtcagcctcaattcacagaccatgaaatatattgtacatatgttaacaaatgatgtcaacagacataattaacacatgatgacaaacaagccgctgtttcacataatctgacaagtgacaacaatataacaaagcaacataacgttctagatgctggaaatagtttgcacgaaaaaaaataatgtgtataaatcaggtgcatgtttatcttatctatcaagaggtaataagtcaggtgcttgattgtcattgtatccccatcccctcaggaaaaaagaatcaacaagaaaaactactttgaaaggcacacacatgcaacataccgcagtggcagacccagaggaaaaactaaaaagcaaaatcaaacccagtatcctctgccagtggtgtgtagcccgacatagatttgcccctgcctaccagagtcctatcatggttggcttccatggtagctgaaaccaccacagttggtgccactggcatactaccaccttcctagatgcacaaattacacatctactccctctgtcctagaaaaaaaacaattcctaactttaaatctgaacaattgtttatccaaatgcaaagctaggaattgtttttttctgggatagagggagtaaatgtgtaaattgcactaatcttgtttgctacctcaacagccacctcaaattgtccacactatggccacatgcatctagtttccattttccaaccatccatcacgaccagaatagcaaaaaaataaaatgtatcatcacataaactaaaatctccaaacgtatattgttctctcatttaactaaaatctccaaacgtatattgttctctcctctttattaaaaaagaaagagaatcccccagcttcaattcttattgaaacaaagtatcagtacactctagatcgtttaggcaatacaaacaaacgatgtcctgcaatcatcctcttctgtaatgttagcatgttagcatcacgaattctaaagcatatctccacagcaaaatcagccaatcttcattgtgctaacaccgcctgaccaaacaaactaaatcgtataaaccaatcaacataacacaaccagatagaccaaatgcttccatagatctaccaaaacctcctccgaacacgacgagtttccaaacatctaaaacccaacctcgctagcgtgcaaaaccttctacaaaatactaacaacacgcgccatacctacacaaatctaatcaatgcatgtatatcaaaactaaactaaacacacatactggcagaagaagcaacctctcgatacaaacgtgtctaaacctgacctatccatcgctcccccacgaagcgaacaaagcgaaagcagaggaagacgagagatcacctggagaccagcgcgggacgagcgggagacgggggccttcttccccttgtccttctccgccgacttggcggccgtcgtcttcgcggcgagcaagcccttacctccttttcccgccatcgctctctctccctctccctctccctctcctgtctcctccccttccgctccgctcgaacgcccgcgcgaccccggcggcggaaaccctgcaaaacgggggccgaatccggcgaggcgagcgccgggtcagagcagatcggggcgcgaatcgtgcggatctcgccgcccggcggcgaaatccgcgcgggaagcggaggaatttgggggcggattcgggattcggataaggcggaaacccttacctttcgcgagctcgcggagcctcggcttcctcctctcctaccccctgacgcgacgcggacgaaagcgagattttttttttcctcttctcttcctttctttactcccacgaaagggctagctaggatgatataggaaaaagtgcgctttttcacttaacccctcagataataatgatattattattacatataatctggggcgttggggagagagagactctgtgtatagggagtttttgtgggatttgtgaatagggtagggtggtatgtgggaaactaccagccgtgcgccacttggcgaaatatttcgaaatggcgtgccggtttccatatatgccctcnnnnnnnnnnnnnnnnnnnnngatgggtgggagaaatcagcagctgagacgggagacggaggggcatctcggtgagggtatttttgggaaggtggagcggtggcgggatgccgggatgtcgtgcgttttggggtgcagttaccaaactgcccttgccagaggggtcgttgacctgtaacttgaaggactccagtcgagttgtgccggtgtgactggtgtggtggtgcaaatggccaaatgctttttggatggcacgccgccacgcttttcttttgtcttttatattttcaccttgtagtacaaattcgtacaaaattactctattcgtatgatcaaattgttatcttaggctgtgtttagattcatgggtgtaaagttttgacgtgtcacatcaaatatacggatacatattttaagtattaaacgtagactaataacaaaacaaattacataatatgtctgtaaccccgcatgtaacaaaaacaaattacataatccgcatgtaaactgcaagacaaatttataagcctaattaatccgtcattagcaaatgtttactgtagcaccacattgtcagatctggagcaattagacttaaaagattcgtctcgcaatttacacgcaatatgtcttattagttatttttttcgtttatatttaatactccatacatatgttcaaacattcgatgtgataggatgaaaaaatttgcagaaaatctaaacagggccttacacatgttcttttatgattaagatgtagatttgcctcagttttcgttagcttagttttcaaaatgctaaacgatatattttgtgcgaaaactttctgtataaaaattattttaaaatatcagataaaactatttttctcaagtttggaataactgaaacttaattaatcgtatctaactagtaatatgcccgtgctaaacgctacggtacaattctatttctctttaataacttttaaaatcttgatttttctattcgtcacataagacacacgccgaccgctaccctttgatcacatagcatgatggcgtgaatataaacccaaataacagtttaataagaagtagatataaaattaatagttttaccatgtataacaagataacaagtggttgtcatctcgctaacatcttctttcatgacccgaatactaaaaagatatctgtactgaaatttattgatggcaaaagtatatgttcagaaagacgtgttaacgtatagtcatgttatcagcctggtgtaaactgaagcatgtatcatggtatggtatggagaacataattacacgatattccaactgaatggtgatgtcgtgttgtacaaagtaagtggacattggtgagtaacattcggatcatcaatttactatcttctagattatgttttcgaattaattttaatcatgagaacctacctttgctcaccagtcgagaacgtctttatacacgatattttattgccaggtcccataaccaacactacaatctataagcaaaactaattccgacacactgcgggagagatgagaaattgaggaattttatggactgatgcatttgttgctattaattattatacttgcccatgattttttcattaaagtatgtgtctgtttttcattagtatcataaggtcattacatcacaacttttatattacgtgtcgactgtaccatgtaacgaatagtgttcccatagaccctttgtctaataagatgtacactcccctgaatatgttagctatagcatgtgacaatccaattattgtggactgtgtaagtttattttggtcatagattcagaaaataaaatgagtttgaatgaatattgtttacttaaattgctcctaagttggttcaactgtctccaaaaagatgtgaggcaatgactccagttagttagttctgtatacagagtgtatttgccaccctttgaggggcaatacttttatgaagcttaaaaaatgaatttcaatacatctgccctggcttgaaagtaaacatgattttattttcaagattgcattttagtttacagtagatgtacactgtagctaggtctgtcatttttatttgtaaaactcaataggtgtaaccgctggtccgctgctattttaatgcagatttcaaaaccatgtataccacaattggtactgttaagcagttctgcatcaacactggttattattatacaataccactatgttaattagtgtggaatcacttacccatgtcctcttaataatttatcctctgattgcactaataaaattagggtgctatatggcataagttatgcacgcaatacttcttatcaagatattctaaagtaaaacgtctcaaatacagctacaaacattgacaagcgggcatattacatccacacaacagtgtattgtttcaggtccctagaaatatacctaatgctatgagagctattcattcctaatttagatggtgaaactttcttgaaaacaagaattaatcattccatatgtgcttaccttttactttggagcaattaggcacaggcaaggtgattctttctgttccctcaaggcattctgtttataccccttggaattggttgggcttgaatccaaaaatccagagcataaaacaatatataaataaactcccaatgaaatgttgcaaaactcccgatcacaatagattcattggtctactttataatatcttcctccttgccctctaccacatgcaaatgtagtaggaccagcctagttgaaacaaaaatgaaattaggaactacatgaacaatctatttaaatccatggctatgaaagtaccgtaggttaggctcgtataaaagggttaactcaaatacatcactcttcagttatttgccatatgggtggcatgctaacgctacatacaccacaatttagtaaagcagtgttcttttaaaatttgacagcatctttttagagtaaatgtgacacacatgcagaaatagatcatgtgtgaaacagagatgtatacaattgagtaaccggagtatctctagagtaactttgatagcttgaataactggagtgaagtagtcaacagcagagcagatttttcctgattcatgcaaaactgttaacgtcggatacaaggaagtggacataaactattttcataagataagacgcatagattattttcagtttattggcctgatctcttgcagttaagtgccatatatattttagtatttgacatgtggaactatagccacgaatccgcttactgacagatcaaatcctcctagcataattgactataataaagaacacattggatttgaatccaaggaaacatatcacacatgcacgccatcaatcacgggtgcatgtactccaaatatacaagggtctaaatatacatttcactgatatagtacacaataaattttatttgtaaatatacatgtgtcaatcaattggacaatatcaaagacatttatttctttggagcatgtatattgtacctgattggagccggcctatgtaacctgacgaatgagtttgaaccggcaacggcgcttccaatggaaggggaggttggccacgatgaggctgcgtccctgactggacggcgatgaggctttgctcgataccgcgacaggaatcagggaatgcggcagcggctgagaggccggatgagagtgatggcacctatagaaccatcttctcaatagagtaacataacaatgtatagtagtcaataaaatcagtttaggcaatacatcagtgcttgcacataaccaatgcagcacattttacatattcaggtgtcattatttgaaaagcaatattatgacgtaactcattgaatccactgccacacggataatagacccaccctggatatttctttaaacaaatagacaaaagcattatggaattttcagaaagtacatagtttagctcatgtaaattttatgtggctggaattagctcaaggaaagaacgaatcccatcatcatgacatcataccatctcattgtcatgttacattttcaagggaaaaaattatcactgcacaaagcagaacttggatataacctaaaagtaccagaagccactctgaaagttggattaattccattgttgcagcagttgaacgatataatacttgaaggttgtatatgcacgctactaattaaagcgcttcatctgaattacagacataaacatcctgatcataagagaaattaaatcatttgcattatataaaaagttgcagatgctaatcaaattgtttaaaacatgacgtcatcattgataatttagtgggatatgtgcacacacatcagaaacatggcactgtcaatccgcaagtaaatgaattgccattgcttattaaattttggaccaatcgaggaaaaatcaagaagaggaaagagcaaatgaaataagagaaaaggatctccatgtaccaggcagagagggccgatgacactgatcaggtagaccgccggtgaatcgggtagatgatggacgcaacctagcggcagtgaatcagcgacggagctacggccgagtcggcgctttgtgtggcagcggcggcgacagtgtgagtcaatttggaggcaggaatcgaatgagaaacacatgcagataataactttttgtgtcataaacgcacataataatttaatttcaattatctcactgatgtattctatagtgggagggaggaaaattaaacagcaagtacatattcatttgtattcactattttatctctatttcagtaactttgaacagatgcataatagccattgataatttaatattaggatgattcatagtagaacggagccgctccctaatgatgaagctcgccacgttgatccaatgaaaaaaaataaaaaaaatagaactaaacaatcaggcctgaaatgttcagactgttcatgcttatgctctaccaactgctatacaattaaagaagaagatccaagaaaacatatgcgtaaaatttgagtttccacctcacagcaagtttcttctctgacaaataaaattatctaaactcatatcacagtaataaaaagaccacaaccaatatcaaatcttaaatactgaaggacctaaaactaacttatatctggattggatcgtaactgctgaaggcaatactattcaacacaacggtagaaaatgtacattatcgttaaaatgcctgctcatgatagtgtaacctataaagagatggggatttcagtgcattcgcgtttgggaggggaggaaccggaatatagatttggattttgctgtgaataaagatgtactaattatttgacgaggcattaccatcgatccatccaatctgcaaggtgctctctaccattgtgacgttctcgctcccgctgtcctgcacacacacgcaaataacaaagaaaaaaaatcagagaagggggattggagtcaaggaatggagataaaaaaaaaaagaaaggaccaggaagtctgggcttctccgttaaaattcaaagagttagggataggaatttaggagatcggggatggagaccttcaagtgtacgatgcaggcaaggaggcggtctacgtggtgggacgggcgtagaggagacggccgacagcgacggggatggcggatgtagggttggcgcgatggtgtcttggcggcacggacctcggtgactcatgtgcagggtatggcgacggggacggagatcccgaccagcgtaggagaacgtgcggagcggatgaggactgcggcgacggcggcgtcggcgtggatcgtgggtggctgggtgtggctgctgttgagggggagcggctgaggaagaggcgttggaccatcggcggtggcagaagggctgaggcgcgatgggagagaggggagcgatcctgcaaagagatgggagtgaggggaaatcgcgaaatcacggatgaggagatcacgcgaggggggaggtgggagcgacgggatggggaggagatcgcgattggcgtgaggcagcgtagtggttggcgtggcggcgtccggtttttgggggcagcggcatggtggcggcggcggcgtccgtgtgcgagagagaagtgagagggttgcgcgcaggttgggggcggcgaatcagagtggggcccacgcaatcacgcgattgatggaggtgggaggcgggggatcgatctagaccgttcgattttacacacagatgatctggaccgttccatgaggaatgaaagaacgagtgaatgagtgaaaccatttgttacaactataggatagataactttctcgttttacatgtctataattaatctttattttcatcaaattcaaatggggcgtatgtccaaaataatccatgtgtgaagcgctagaactactggtggaaacacaagatacatgagaaacttacggtgattagctgacgagaatctaatatattgacgtgcaatccttttgcgtgttcgcgaaaaaaaaatagccgacgagaatataggaaagatacattttctaacctttcactttcaatttattttctaaattctgtaacttgtataaaagtatagaatatttgaaaagttgcagtttcctgaaactcctcgagcaagggctatgtgtacatacactgagtggacccatcgtattcataccaagctcgtacaattatacgggtagcagttaatcgcagccccgtcctcatcaatataggtgaacagaacttctattgttttgcattggcatggcaatacttccaggggctcccggcgcacatgtttcaggctttcagcagtaaagcagtttctcctaaccttggaagttggcacctttgaagtactgtcaatttctagaactcttggttttgtccaatcagggccctgagagaatcctcctctacaaatataaagcaattatagcgtttgaaatttgtccagctacccctcgttcaatttcctcacctactccccatcccaaacaatcaggtgatggttgagggattcaaccggaggcatgaaaatatttttatcccaaccataatttatcttaaaactttcaggagtgcttgtatttgtcgaggatggagggagtggtatgcaaagaatgaaaattcagcaggacatccgttttttcaactgcacggatgcatttcccaagaggcgatgccagcatgatgatacctgcaacagacagaggaacatgttggaacataaatcagctaccccacccaagcaacagcatactgtgaagtaattccaccctcaaaatgcagcttacatgcactgttaataatctggcattgatgtttgtggtgcctactgtacatgtgtgagctcagcaaggctggggatgagtgtgcactagttgtcatggcacaagaatgtgcacagttggtgcagtggacctgtggttaaaaatggataatccgaaacaaggattgtgtgtaaatgcttgaatcggggaaaccattgactatggggtgcagccgtgcaggcactcctttcatatgccatatggtgaagcgtggtgaacgagaagggatggcatggctcaaggaggaaatgaggtaacaattaaatattgttattcataatattagcgaatggtgaaactatacttacagatggtgagagcagaaatgcatttaatatgctcaggtggtgatgaaaaataggggaaattggtgaccattgacaattctgcttaaatataataaaatagcagcaggaaaaaaaatcatctatgagagctggaataaatttgcttgtatggaattcttgttctgaaaaaaaaatactggaacaaataaacactacctgaaacctgatggacagttaccagcacattatccattgctgcactgggactagtaatcttgctgattgtagcttgataagaatgtggtattgttgccggccattgtcacccaatcacccccaatcttgtcaacgttcatgaaactgcacctgccaaaagatgcatttacacgttacataagttgcaaggtttgtttgtagtaaaaacatcattagtttattttactatgcaagaagagaaaattcctgaatcttctagttcggtatcttcaattttgcactgctgaggaagattcccacttaagacaaccccctcaggcatctacaagattttgtttccagttccgaaccttcgggcatttagaaaattccgtttgcagtttctcaaaataaggtttacgagtatactttctttgttgccgtacttgatcagcatctaacaaagatatggggcttcctatcgaatttattctgggccaattggctagctacagttcaaagagttaagagattttatcagagaaagcttggatatcatggctatacattatattcgtgttaaacattgtgtggaatttcttccatacttttacctttgtactttgcagtctcagtgtctggtagaatcataataacatttgaaatcaaaagactcaatgggattatgggattatctcatagatctggtagattttgatatcaagtttcttttgatcagtaaacacttaaatgctagtgcaaacattgcaggcttcactcaaataattagcgatgactcacttataaaaaaataataaccagcgataattgtagaagcaatctctagtgcatacagaatttatgactagaggtatagcttacatagaagtgcaggattttttttttactggagaagtgcaaaattgttcttaatgaatctagatcatgccctgaaatttgatcttttatgaataaaaatgtctgcttcaattcctgcatgctggaagaagagaaaaatcaatatgtattcagaatatgttgtgtgaataaagaattagaagaaatcaattaaagggagcgggtaagcccagatactgttttagcatcaaagttttcaccaataacttatagctagtggtttatgaataatactttattccccagattgaaaactgcattcttccaggttagaagaggatgagtaaatgacatgtgcaccagtaaatgtgtttattgggagaaagaagtgtgcaattgaaaattagtactgcctacacaattgaaacatactcctacctagcatatgaagcaacagaatcagctgccaaaagtactagcacctgctgattttctcactcctttcctttccatattctcccttacttcattgctgtagttccactgaccttcagcagcatacatgttggaaagcaaaacatatccaccctcctctgcgggttcaagacagaggagttcctttgaagcaatctctgctacttcagtattctgacaagctgaactcgcacttaaaatggaaccccatatagaccgacttggcttcattggcatcctcctggccaaatctactgcatcagacagcctacctgatcgtgcaaggagatcaaccatacagccaaagtgttctactcctggttcaatgttgaacctttgcttcaaggtatcaaaaatcttgcacccttcatcaaacaggccagcatgactacaagcactgagaacagcaaccaaagttaccccattaggttctgtaccctcagcttgcatcttccaaaaaagatccaatgctacatctccatggccatggaatgcaaggccagatatcatagctgtccataaggtaacatctttgtccacggccttctcaaatacggcatacgctagcttgatacttccacatttgcaatacatatcaacaagagcggatgctaagaaagaatcttgagtaccatgctccttaaccacccaaccatggacactccttgctgaatttaaagtccccttgccggcaaccgcagagatcaaagtaacagcagtcaccttatcaggtattacactactagcaagcatatcatgaaatagtatcattgttgcagagaattcttcatatcgagcatatccagccagaagcgcattccaggatattatatccctggcaggcgcctcaccgaaatatttgctagcaaggtccaacaagccagcattagcgaatccggcaaccatagtgttccacgaaatgccatccctctcaccagcttcatcaaagactctcatggccgtgttcatttccccgcatttggcatacatatccaagagagcattgctcaagatcaatcccctatccgcgacaccgatcctccgcacgacgacgccatggacggacctaccaagaactgccttcttcagccgcccgcagcaagcgaggagagcaacagccgtgtactgatcaacaccgatccccctcgacgccatgccgcggaaaaaccgcagcgccttcccgctgcatcctcccttgacgtacccggacagcatgatgttgcaggacaccgcgtccgccgtcggcgcacaccggaacatcgcctccgccgcctccacatcgccggcgtcgaggtacatcttgatcagcgagttccggaggtacacgcgcgaatgcaggccagtcaccaccacgtgcgcgtgcacctgcttcccgacggagcggcgctccgcatccaccgacttgagcagcgacaggaaggtttgctcatcggggtgaatggatgacgccagcatcgacatgtagagagcagccggccgacgactaggcgaggaggaggccgccgccgccgccgccgcggccgaagagagcatgaggttgtagatgtagaggttggggcgaggggtgaagtgctcgaagagggtctcggcggcgcgcgcgtggtgcgggaaggagacggtggcgaagtggaggagcctgctcatggggaaggtctcgaaggcgaggcggaggcggagcatgtgggcgaggatggccttgaacggccgcgccccgccgccgcaccgctcgaggaggacgagcgccgggtggcccagccggagcgatacggtcgggtcccacggcggcctcccggcgccggcggtggaggccatcccgccgccggcgagacgggagcgcgcgtcgggtcgaaggcgcctgccgtctccccgggcggcggtaccaccgtcgctgtttgggagcggcggaggccgtccggagagggccgcctcgccgccggcgcccgcagcgcctccgagccggtgccttcgcggcggcggcggcggcggcgtacggcgaggcggcgccgcgtggcagaggcccaacagctaaagtaaacgttcgccaaattatgggccgcgaaattacttcatgggctgaatattatgcccaccctctaattgcgctacgctggaaggaagcccgagaaaaaaactcactgttgcaacttgcaacggccatactagtctgttaaaaaaacaaaaaaaagacaattctagttatgaacctgagcacatatatatttagattcgtagttaggattttcttttatggaggggtaaggcttatttggttcgaagaatttctaaatcataagaatatgaaaaatagaaaaattaagatgtcacatgtaatccaattcctaggattttttttctaaaatgtctatctcatactaagaatcatatacgataaggttataggactatgattcttaagaattttgaaacgaataatgtatatataaaaaaaatcctatggttttaattagtacaataatcttttagaaatcctttaaaccaaatgagtactaagctaaattgtgtaaactaaagtgtgtgcgcatgtacccatatagtgaaatccgtttatgctcaagcaagatcgaaatcagacgagaatcatacggtgctagctcagtttgttctagggataccatatttaccatggtcgattcacgtcacatgaaaaacaagggtctttctaatccatccaggaaagcttgtccagttctaatcactttcagtcagtgtcccctgataaaagtttagtataaaaaagagagcaagatataggcccctttgaattgcatgattaaaaaaaaagagaaatagggaaaacacttgattctgataatagtgcaagtgtaaaacagatgattgcaaaacacaggaataaccatttgattggacagtagaaaaaacgcaggaatcaaataagagagataaattcaaagaaaattttcaagagattagagacttagagtggatgttaaatttcatacatttttcaactagaatcgtagaaataagaaagttttctttcctatacgaattaaagacataaataattaaagacatgaatagtgtaggatttcaattcctcttttttttttgaacatttttcctccaattcaaaaggggccataaagttttgtaccttcacctgctcatcatatgtcgtcacctccatccccccatctcatcaaatcaaacaagacaatgaaaactgatcacattcccctggttaagtatgccattggcaaaccattatcgctcgatcacaaccaacatgatcttcagtttaccagatcaaaacccaattgctcccgaggaatattaccagcagtgtagtactagtagcagatacatgtcatctgcttttcgatatgagccgttcagtcccgtccatgtctgccatcaacttgcttcgtcagagttcatcagactaataccgaccaaccatcatgcatgtgcagagcgatcgatttctctctcgtctataccgaacactcgaatcgatcgatcgacaaaagcgtaatccggatcttcgatctgtcaggaaccttggcgacgaggagttaatcaacgggtgatgagatcgatcgatcgatcgatggatccctcctctcatgtcggttaggcgacaggaaagattgcgtaccagcgatccctgctcctcatcgacacaccagtctgtacattcctcgatcgatacggcgatatatatctcgatcgagcgaattcaaaagaaaaattgtctggtttatcaactctgcatgcagcgtttgatgtgattcgagtggcactttggtggtattttttttctcccgaaaatgaagatgaagttctttacgcaaaatgagacggtattaacatatgattgattgagttttaattattacgaacttgaaaaatagattaatatgatattttagcgcaactttcatatataaagttttcgcacgaaacgcaccgtttagcagtttgaaaagtgtgccacaaaaatctttatcttcgtccaactcttattggagaatgaatgggacctttgtgtgatatggatcctatctccagcctccagggaaccgaacaaaagaagagaacaagtaagagacgcttcgatcgtctgatcgacacaggatcagtggattgcatgtatgatcgatatacatccactggccacatggttccactgttatttctgcaccatgtttgattacgaacaagtagctaattagctatagctagtagcctagtactatgtactaatgcaaagtacgtacagggtacagcccaaattaattctatcttaagccaagtactaagtaccagttagttcggtacgcgtattagcagctgggaatagtcttaagacagcggtacaatagtccaagtaggcactaattctgggtcgcatatgcattgcagtgcagtgctctgatgggtgtgaagtctgaacagccggatataatcgagcaaagggaagagggagggggacaagtgaaactgctcatgtcgtccgagtgtctccggatgccacggttcgctccactgttgttcggttgagacccaacagggacacgcacggcacggccactgtttgtccgccacgcccacgcacacgcacgttgcaagagctattgctttccgtccaaaaaaaaaagatcaatcctatcaacgaacatagactgatccgtagttaggagttggtttattttgaaacgaatggtgcagatggttggattcggcttgggcccgggtgcggtggctggtggctagctaagcatcggtcgatcgatcggtgaacgaattctatgagtttgtcagtagccatcggtgtcatatgttattatcgtcgtcgctgggtcatatggttgtgacttgtgagttgtgagttgtgagagagagcgtcggtgcctagataattagctgttgaatacccatgccgttcgtgcgtgcagtggggagggaccggtcggattgctgcgagatcgatggagggagcaggtcccgttcacggggccccggttaagttgtaactactgtactgtgtaagcagtagtaggatgcagctaccaaagaaaagcgagtggccatcactacaactactgcattaggatggatcagtaggaccagcgtcgtctcagcttgctggtatttggtccattgctgcgacgcgtacgtacggcgggaagcagcgtgggttccctccaccaccgcacaacggccgagtttagtttcaaactttttctttaaactttcaacttttccatcacattaaaaataattttttcacacacgtaaactttcaatttttctatcacatcgttctagtttcaaccaaactttcaattttaacgtgaactaaacacacatgggatgggagagccaaacgggccacggctctgcgcgcgtgtgtgcagtgtgatcgtctgatcgatcgatccatcggccgcgcgcgtacgggatcacgcgcgattcgcaatggattaatgggtgttggatcgcgtgtggtgtagctgcttttgtagctaggcgagacaagcgccggctggccggccgcccgtcgagatgaccgtcgtcgtcgggcacgtacgtcgatgtctacgtgcgtgcgttccggccggccggtgagagcagctacaataagtccacatcagtaggctatagtgtttcatatagtaaatttttatctagttggaagagagagagagagagagtgaaaggagagaggcgctggctacccatgctgcaggcctagcttttttccctgcatgtgtgtgactttgtacatcctttgtgagcagccaatcaaatggtactacttaagatttttttaaaaaataaaagttgtacatgagaaataggtagagataactatagagctcattactttatttattagcttttgaaactagctataacaggatgatgtgttatttttgtagccaatagcgagctctactattaaccttgctctgaggcggccccacacatcgagctctccgttaatttttttgtgcgcatacgtgtggttcaattcgaacggtcgggatggctagtttgttggttgcctaagcgtgtctacactgacatacatgagagtatagatagctaatagatttgttaaacggcatccaacagaaaatttaaagagatttcttcaccgctatatatctgcgctaagattcatgtatgagtcccatctcctccagctctcgtaagttcctcctcttcttcgacggcagcagcatcccaactctgacagatgagctacgaattactaggtttgggatcaaaatttgggcaaagagtaggggaatgaagtccacttgggcttagagggataatcgtgggcgtgcaaacacaagaagacattgtggtggtgccatcgctgctagaaccacgaggttggaggaaacggagtcagtggcgatatctttagctacaggccggatctactggagacagtgaagatgatgggggcgggggaccttgctgagtaggggaggcggcgacattgacatcgatctactcaatctggaggacgcggcgttggggagatggataaggtgaagttatcgtagcagcactaatctcaaaccggtatgggtagttcaaaagtgaataagatgaaatggatttcctcgcaaatgttacataagcagtccctcaatctagagggaagtggactttaaactcttgagagaacatcctattgttgtttgcatgtcattcaaatagtgttatgaaactttttaaagaaaatcaagaaaatggttaatatgctatatatgtatcaatccgcaaacatgcgggttaatattaaattttattagttgaataaacaaatcaaactatagttggtcgactattttttttcttttcagcttgtagaagttaaattaaccttatatgtttatggagtaatctatcttattaaatattttctaaaaaaaattataactatttcaataattaaaaaacaagaggatatccctctcaacagttcagaaccgtttcctaatctaaagatgtatggttgttgagtcgaagccaccaacaaacggataatttatgaatacacacccaaatgtgtctgaccgatatccacaccacggtccaaccaccatctacaggaggccataactagctgccagtggctgatcgacctgtcacggcaaaaatacccacgacgcgcgcggtgctcagtagctcgatcggcctctacgagagagatgagcagcttcctttcctgcagggccctggttacgactactatcacgttgatccacgagcatggcgctagctaccgtgtactgcgtacgcacgtgcggcacctcacgcaccgggacagcatgcagggaagcaggcgagcagcgggccggggttccactcccacatgagaatccatcctcgtacgtcgtccggtggcgaactgatggccggccaccatgcatgcgcctcggctcatccgtcgtcatcgacacactgtcacacgtgggcgggggcgcgctcccgctcgagctccatctatcccgtaattttgataaattgaccctttcaaaaaacttattttaaaaataaaccgtaccaaaaactaatttcaggaataggccgtggcctgtcattgacgctgagctaaagcgtatcagcgccactgcagttggtgctgagatttcatctgccgtggtacaaactcgtcttgtatggagagctcagcgccacactccacagcgctgacctctgtataccataaaatcgcataggtgcttcaaaagcaaggaagcgtagatagctcagtggtggtgttgcgtagtagcaatccaaggcacgggagtttgattcctgtcctcttcattttaattattgtttttctcaacttgctctttttatgtgttcttttgaatgttcacgtgccttttacaacttcattttatttttagacttagagggaacgaatataagaaccaaaattatacgattcaagtttaaaattttatatttataattctttggaaaagaaattaataggacaataattcgtggaggataagtaaaagaaaaactgaaaagaaatactacactaacgaggtttgaacccgtgaccttcaagttcaaacttgtcgatactaccaccaggctagcttcacttgtttatctaatgtgagctaaaacgtcccagcgccaccggcgttggcgctgagatttttgtccaccatgacacgagcttagcgccaaatgggttggcgctgatatcagtgttaaaaccgtgggctggcgctgaggccacggtctattcctgaaattagtttttggcacggtttatttttaaaataagttttttggaagggtcaatttgtcaaaattatggccatctatcgatccccttcggcaaggcacaccgcacgcatgcgcgcgcccaaccggccacacatgtggggcgtatgagcagctgcgcggtatcacggacgcgcgcgacggatgcatggatgaatggatggatggatgtacgttgccgtgttggatcctgtgtggtgtggtgtagcgacttgtttttgctcaacacgccaaagttaggtccaacatgatgggatggcgtcaatgatgtcggcgacgttcttctagctcccgatggaagctaagtcactaatgtgaagggaaacggcgttaacattattggcgccaagtacctatttaatttgtatttctttaaaatataggatctatttataataataatatatttacaaataggtcattggcactagtgttttattacaaataggtccttttctgctacaaatatgtcatttttattttttttacaaaaaggtccttggcgccaacgagatattagtgacttagttttcacctggggatgagggggacggcgccaacgttattgacgtcaataacgttggcgccgcgaaaagggttcattcctagaataagttttttttagggatctatttgtagaataagttttttaaaaggtgaaaatccagccaatgcgacaatgtgatgtgcattcctatttctcgatcgaaatatttcagatgggtttatagatcgatctaccgaaagcaagttttattagattgagatctaggaagggagatttggcctagctaatgaagggtttggtggtgtctttccgtgcagctgagctaacgagttccattctgatcatgaagatatcaagtgggacacacttggatatattcgttgatagtttttattttactatttctatgaatccgtctcgacaatggattcatccattcgctggtgattgtgaatagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8833 - DNA, 2185 bp, Oryza sativa
caaaaaccaaaatgacacagggagagcatggccgaaacgacgcagaaatcagtcgagggagaggcgtggctgaaacgacacaaaaaccagccaaaacgacgcagggagaggcgtggccgaaatgatgaaaaaccagtgacctctcctagcggcgtggccgaaacgatgcaaaaaccagttttctctctgaaagaactaaatgaagttagttctcaaaacttatctatgaaacaagttttttaaaaaatactaccaacttatcctatgaaaaaagattttttttaaaaaaaaaatactacctcccctatataaaatcggatgttattaagtacgattccgtttcgtttttgttgcgaatgcgcgcgcacggtgacgtggatcgatcactcgacttaattagcgcccacgcaccttacggacgcagccattgtgtgctgtcctatataacttcactgctgccgccacacccacaacataatctccccctctcttttccagcggagcaaaaagcctagcaaaatcttgcttaatcagtgagcaaatcctagctccttacttgcttatctccatcatattgatcggagcaagaagaaggggaagtcgatcgatcatggagggcaataagtccagcagcaacgatagcctttgtcgccatcatgccgaggacatcgaggagggggagatctgcaatccgggtggtggtgatgggtgctacgttttgggctccggcaccgaggaggacaacgaggaggagaaggtgggcatgcagccagtgacctgcaagtggtgccgtctcaaggacatcctcgcgctgccttcgcccatgccatcttcttctggttctgaggggacgatcaacgaccatggtgccggcaacgctgccgccgtgttgcgactggaggcatccccgtgccacttgtgcagcagggagttcggcaacatgaaggcggttcacgggcacaagagagtccatcaggtagagaactgttaacgaccaaatttggtaatccaaggatcgtaaatgaagaagaaaccgagatggaattcgagatggaaatcgtcccagaaacagagtgagtatcggctgaagtccgaatcggctacgactaagatcggcagggttcgagtcggactgggttagccgattgagccgaatccgacaaaatatgacgcagcatatgttgtcggtttaggttgacgtgcttcaagatgattgccacacatggatagagtcctgagaaggcaattgtatatattagttaggatattttatgtaatttccttagagatatgtttgggcaaaagtctgccgcaaagacttatggtattttagagtttgttagagataagagtcatgtccgatatgaacatattttgtaattctcgggtataaatagaccacgagccccatgtaatcaaactaacacacgttcaatacaatctcggcgcatcgccaccctttttactttcgttttattcgacgagttcttgcttttgggttgagctgcatcggtttcgatcttcaacaagagataaaacttgctatggcggcttacgttctcgggattagtgcttccatctttatgatactctaatcttgtttatgtaatacgtcgagttatcatatatcttacataatcttcgacgatatcgttatctaacctataatcggctaacatctgtcagaagagggcagccgattaggttaaataccgatgttgacttagattatatatgatatccaccactctatgaaattttcaacggcttgattatctagatattgtctttcttttcatacttatagctgcatcagttgagtttgatcttatgagtcgtgattagaatctcaatctctagcctgtctttggttattgccgattagagtagtatcggggtttcagccgatcttacctgatttaactacatttatcttatttgccttattgacatgttaaatctaccctttatgttaagatcttgttacatctaagtatattaggctttttgtttggtatatcttacttgctttaatatcttaatatagagtggtatcggagtattagccgatacacgctagatctatctgatcggctttactgtaaacacatatagtcttgttattaatatatatttcgatctaagtgatttatactgtctcggccggcgatagatctatcccaat

SEQ ID NO: 8834 - DNA, 1379 bp, Oryza sativa
tttttcaaattatcggcccttgatcactaacaatcagccgactgttcagccagttcctcccaatgtaccatcggctcaaccgacagcaccagtatcggctcctgcacctgctgcaccatcatcggcaccaggtcaattaattaatccttggttgttggtgagagagcagccacagcatagtgggcagaatatgaatcggctaacctaagatcaagttacggctatgttcttatcacctcaacctactgttgacacaatccagcaacaaccgattcaacagacaccaccaaggcagcaggttgtgcatccgattcaacagacaccaccaaggcagcaggttgtgcagccgattcagcaaacgccactgaggcaacaggttgttcagccgatttagcagcaaggtttgataaatgcatcagctgggtttggaacacctaacaatcaactagcacgctagcatacccaaaggcaagttttggacctgcactggagttaagcagatctcccaggcctcgtgttttcacatcaacacgctaaggcagcacgctgcgaatcaagttgtcccagagcatttggttcataatgtccaaccagaccaaacggtgatacctcaagttgttcccgaacatttggtgcgcaatatacagtcaaactttcaaaattaccaggggccaatttgaattatcagtatcagcctccatcgccgcaaactcaatatcagcaaggaggaccggctcagccccagtttattcctcagtacaatcaattcgagcctgttccacagcaagcacaaggagcgcctcagcaacgaccatggacagatatgattgcagatgtaatgagggaacagtttgggcttaagccgaaagatgctggaaatttgtatcggcatccttaccccgagtggtttgagagagttcctctgcctaaccgattcaaagttccagacttttcaaaattctcagggcaggatagtgtttcaacctatgaacacgttagccggtttttaactcagtatggtgaagcatcggctgtggatgccttgagggttaggttgtttccattgtctttatctggatcgactttcacttggttttcttctttgccatgtgggtcaatcaacagttgggccgatttggagaagcattttcatagttatttctatagtgggattcacgagatgaaactatcagatttaacagcgattaagcaaaggcatgatgagcctgtgcaggaatacattcagaggttcagagagatgaggaataaatgctacagcttggccttgactgatgctcagttagccgatttggcttttcagggtatgatagctccgatcagggagaagttctcatcccagactaaaatagggggatcca

SEQ ID NO: 8835 - DNA, 1479 bp, Oryza sativa
aactctcttctttgaaggctatccgtcaacatcacctggatcatctcgtctaatcttgtatcgtagtgctttgcaaacatggcatgcttctaggttttcgtactcctcaccgcgatagaggatacaattgttcagacatgcgtgtatcttctgtacttccggtcctagagggcacactgccttcttaccttcgtacgttgtttcgggcaattcattcccctccggaagaatgttctttacgaatttcaataactcgccaaatgccttgtcactcacaccatttttagccttccattgctagaattccagcgtggtacccaactttttgtgcctctgctcgcaacctgggtacaacgatgttatgtggtccgctaacatgcgctcttgtttctgcacctccttttcactttcgcggtcctcctgtacgtcccacaacatttgaccaagatcatctgcaccgtcattatcttcaacatccacgtccgcctcgcccgttgtgttttcttcaaatccccaatactgagcccagcccggaatgttctcgtcttctacttcatcttcttctcttgcaacccctagctctctgtgagagatccaacaattatagctacgcatgaacccccactgaaacaggtaggaatgaatagttcgtgctgtggaatactccttctggtttttgcacttgttgcatggacaacatataaaaccgttacgcttgttagcattggccacactcaaaaaataatgcatgccgtcaataaactctttcgaccgccggtccgcgcacatccattgctgatccatctacctgaaatgcatataaatcataaaaataaaatccatgaaagtcaaactaattaaataatcatacaataatttaaaacatcatccttaaaatcaaaaccgacgttcgttacacatttttaatggatttggtatgatacggaagaaggcgccgatttttaaattaacttacatttgtattcttttatcttaattttctatactagttttttactttgtcatttttaatttattgtaattatttctagctgatttaactattttccaattaacttagttttcaattattttatataaataatcatataataattccacatagtattcattttttcattattttaaaatttctaaacatactttcattgtttttcaatatttatatatatttttccttttttcctataacatatttatccaaattattttaacctaattttccctctacaagttttctctctcatcatttcccaccatataccttattggagacaatattgaatacaaacaaagccataaatgtaacatgctaaacatacatcattagatggtgttgctaaccttttcgattcctccgatttgtatattatcaataaaaatttcattaaaaattttggtagcacctccctccctcaaagctccattttgcagcaatggctcgagctagaggaggaa

SEQ ID NO: 8836 - DNA, 6318 bp, Oryza sativa
gaatcgggtatgtaaacttttgatttataaactttggatctataaactttaggtgtataaactttagatgtatagaaatactatatatagaaaatatttcaattcaaattcaaatttgaatcggatataattcaaattcaaatttgaaacgggtgtataaacttttgacttataaaatttaggtctataaactttagatgtatagaaatactataaaaatatttgaattcaaatttaaatttgaataggatatataaactttcgatttataaactttgggtctataaactttaggtgcataaatttactaaaataggaaagtaatgcggtgccaaaaaaaggaaacgtggagggagggagggggggagaggtggtgatcgctacccgatcgctccgcgatcgatcgcgcattagacttttcgcctgacaggggtctagcatgccctgttagggggcgaactgggactaaagacgattggtgttaccaaccgggactaaagatcacttagtcccattggagtaataaaccgggactaaagaaacctctttagtaccggttctttatagaatcgggactattgtgcttttcggccgacccagcaaagatcagttctccagtagtggtagttgttctagactattggtcctactacaccttcgtattcaactactacaactcattgccatggtggtctcctacctcgcctgccagctatatattagaaacatcgttacgcgtgttcatcctgtgttgttgccaggcctagtaaacctattacatgatcttgtcctccatggtttgacaacattggctcttcgaaatcatatttctaaatgactatcatgatcgtatcattgttttcagccttagcacgtccgtgtgcaaatatgatccgtggcaccaccctgcgcgcctgcgaccatgccatggtgcattttggacgcctcacggcttagctagcttgcttatcatcggctatattggcgacgactactctaagcacgtgttacttcagtatgacctctattgtgcccctttattttgtggctatctcggcaacaacataaatggctgtcagattcctctcgttgatttatttttccagtctaggcatgctgatcatgtttggactattagtatgttaaatggtatgttaaagtatatataaaatataatagttataggaatatgaggatatgattgatttatttaaagttacctttattcttatattctactagaaaattggtcacgcacgttggcgtgccaactatttagcccgtgtgtgctggttagactaactttagaatgcatgaaagacataatatttgaaccgattagctaaataattgttggcatgttttttttttttgaaacggacgatttgtcagccatcagattcacgtcgtaaatggcaaacctgagttacatatagataacatattatagatacactataattatactataattatactatgatgattgcgttggaaagtttaacccataattgaaaggattttcttttatcaatgatcattgcaagaaagtttttgcacttaagaaaatgaaaaacatcacattttccattcacgtttgttttttcaaattttcatagcttttcatcaaattcatgaaaatcaaaagatatattaattaggtcatgaaggaagatacttatgatgtcgtccttgctggttgaacacaacatccaccaatcgatctcctttctaactattcttcagatggaaagactaatggaaggagaagtatgatttggaacgttctgatgtctaataggctaatatttttttctagattcgcttttttctcttatgaataacttggagatttatttgaaaaatttaattattgcgccacgtggaacaagcggctggcggtaaaaaccgccggcttcagtaaagtaagatagatatatatacacaccataaatttctgtgtaattctttataagtgatacaactctggtaggataaacatactttggatgctgatcaaatactatatgcctctaaaatataaaatattttcccacatagactaggtaatacacaatctttaacaaaaaatgtaacattataaaaaataatattaaaataatgtacaaataaaatacgactaacacagacaattaagataagtggctgttttattatctgtttggtagatgtatagcttcaactctacctctaaagcccaactaaatagttttaactctatctaaacttaaaaaaatgccaactaaaatgctctcgtaaaataactcgcttgttatgtctaatatacttagtctaacctgtaacttgggtacgctcttttcttttgtcgaagaatcgaaaaaggatattatccaataaaacctgacatgttgaactttttgcttttccagctgtatgaaataatataccgaatttaggctgcttcctgatttcactctgtatcatcttggaattaaatttaggatttggtcctgccgacaatacccataattagtccaactccagcacgccggattgccggaaggttggcgacgcgttatcattgcccaggcctgctgccccttctcccctccttctccttggtgaatcgtcggcgatggatatcgctcttgcttctgcggcggcgacatggctgatcaacaagctcctggaccggctgagcgactatgccatcaagaagctgctgggctcggagggcctggacgcggaggccagctccctcagggatgcgctgcggcgagccacgctcgtcctcggcgccgtgcccgccggtgccgccgcaggggtcaggattgggaacgaccagctacttccgcagatcgacctggttcagcggctagccaccgatttggccaggcacctcgacgagctcgagtactacgacgtcaagaaaaaggtatctacactgtcactactgttgcaatttgggcgattcagtttcttctttcagcactcgaaatttcatctcttttttttttcatttgcagactaaatttttttttgggagcgtttagctaaaactctaaggttgtcctcgcaaatttttttttaaaaaaatctgttaaggttgccagactaaatgttcgtgtcacagactagcagtttttaggaacgaatagttgcagcaggaaagcttggttgagtttaagcttggctaaaacaaaaaaaaaattggggcaaccgtaactccaataaaataccattttttatagttttataaaatgtaaaagatctgttctgtcttctggctttctcccaaaagccgggtaatagtcattacctgttgtaaaaaaaaacagagagtaaaagctaagtagctagataaattagaagatgttaacatctgggttggtgggggttgattgtgaaaggagtactatgagtcttaattaactattactaacttattagacacctgatcctagggcaaagccgagtgattagctttccagtgaagcttttttgacatctctacatgtgggccatgagccatcaaattgtcaaagtgtctcaaaatatgcttatgcttcatattgcaaaactttgtttacatagtaatcggaggctctcttgagggctacgccccttaattatcggaggaaataaggactgcaattcccatatagtagatattcctgcatatggactcgcaatcagtacttaagtcccattcaactcctattgtagagtccagaccatgtccaaacagaatgaaacaaaactatgcataaaaaaataagtgagatgtggagtccaattcaatataaacaagaaaatgatcatgccatccagcacatatggttccacaaaaaatatgtaaaaataacaaggcacttctatgactacaacgtgcgattatattaaccaaatgttgaaatttaaatcacactatactcaggtggccaaatattcaaactcgacaaaaatcagaattaagtcacttgtttgtaagagaaatttttttataaactgtattgttaataaaaaagaaatcttagacttcatagtgttcacttgagatctaattttgtagcggaaggtgaaatctagttggactgtgaaccaagaggatgatatgcttgtgcaggaaaataaataaataaatataaaaactttaacatgttaagttagtggtaaaaattgtaaatgtagcaaatactaactcttgatttgttcaatatataaacataatgaaatgggaatttcaagtatatcgaattgacatatattgcaagacttcggatgcaatttttaaccaaactaatatatatagccttggcaatttagtttattgagattcatacgtttaattataaaaaatgtgataaattttatgtacagatgtacgtataagaataaaaagacaggacatgggcactcaaacctttaccaaaaaagaaaccagaaaataaccgaaaataaagaggttgtaggtagtcacctgaccaaagggttgcctcatgatggcagtcagcaatgtgtatctgcgtgctagaactcctggatggcactttgtcagtgagcatggtcacatgtggcagttgttttaggattatcatgccacagctaaataataagctgttctatgtgcattttagatccggttagtaaggtggtctattgtaggcttatggatctcccaatcggttgacttcagcatgggaaaaagccccttactgttccagtttaagcgtcctacagttaatccttgcacgctttatcaaccatcctctcataagtgctagcacagttctattttcgatttcgactgtattaatgcttctgtagtctgtaaaatcttgatctgaatttcacccattgtgacccccattccattatatggtatagtgatttcatctatatcctttgacatcctagccaccattttccatttatgttgtgtaggtaaagaagaaccagaagagcagcaatccattatccaaaatgaatttaccccttactcaagctgggcaatcaaagccgaagtacaatagaacagacataaaacagattagagatactgtgggatatttgcatagcatttgtgatgatgttcacaaggctctcttgctagataaacttgatgcaattaaacaagctgctcaagatgcaagtacagacaaacgtgagactgtggataacttcactgaaaatcctagaaataaggtgttcccaagggaagaaatgaaagatattatagaactaattaatagtgctgcatcgagtgatcaagaacttttagttgttccaatagttggtgctggtggtgttgggaagacaacacttgctcgattggtgtaccatgacccagaagtaaaagataaatttgacatcatgctctggatctacgtatctgctaactttgatgaagttaagcttacacaagggattctggaacaaatacctgaatgtgagttcaaaagcgccaagaatctcactgtgcttcagcgtggtatcaacaaatatttgaccaaaagatttctgcttgttctggatgacatgtgggaagagagtgagggtcgttgggacaagttattggccccacttagatccgcacaggctaagggtaacgtactcttggtaactactcggaagttatcggtggctaggataactagcaacacagaagcacacattgacttggatggtatgaaaaaagatgacttctggttattcttcaaaagatgcatatttggtgatgaaaactatcaaggccaaaggaagctacagaatattgctaagaaaatagccaccagactgaatggcaatccattggcagcaaaaagtgttggtacacttttgagaagaaatattaatgaggattactggacaagaattctagatagcaatgaatggaagttacaagaaagtattgatgacattatacctgcactaaagctcagttacaatcagcttccctatcgtcttcagctactcttcagttactgtgctatgtttccaaagggttacaattttgacaaaggacagttgatatgtacatggattgctctgggatttgtcatgaatgagagaaagaaattggaggatgaaggaagtgactgttttgatgatttggtagaccgaagctttttccagaaatatggagtgtcacagtattatactgtgcatgatttaatgcatgatgttgcacaagaagtctccattaacaaatgccttattattgatgggtcagatcttcgaacagttccgtcgtccatttgtcaccttagcatctggactgagccggtgtacaatgagcaaagcatagaacggaatgataactttgaagagaagtta

SEQ ID NO: 8837 - DNA, 1205 bp, Oryza sativa
ggatattgcattaataaagacttcatctaattcataacaactcaatgttgtaaactgattggcgtactgcttagctgttaatactaatgactaaaagtatatctccttcggacttgtctcaagtgcccttaggggagtttgtttaaaacatactcaacgtttgtttaaaatatagctcactcagtaagaagcttctttcatccttgcaattgttcttgagttattttttttagataatggatttatattaaacccggcctctacacttgtgagggtgtatacagccaaacaagtttccaagagtacataagactcatccagttatatgggagacaacacaaggtacgaagtttacataagactcatcccgatacatgggcaacatcacataaagataaaacccaaaataagaatcaagaaagctaagctttaattcttcttctaaaattccagccataagtagcataaaactccattacccgtgactccaaaattctacaatgaacttggacggcatctccatcgtcctctttaagaagcaaggaccaaagtcttgcccaatgagcccccctgaagattacctgcatgaaagaaataggattggagccattaaagactacatcattcctactaagccacaaagcccacaaaattgccgcaatgcccatataaatttgtcttttaagtctaggttcaaaaccattcaaccaatttccaaacatatgagccatgctacggggttggctaattccgaaagtaaagaaacatgcactccaaatgtaccttgccatgagacagtcaaagaaaagatggtgcatcgactctttagagttacaaaagcagcaacttagactacctctccatcttctcttagctaggttatcctttgttagaataaccccttctttaagataccacaagaatattttaatttcagtggaattctgagcttccaaatcaaagtctttctaggtatcactccattatacataagcaccttgtacatggagttaaccataaagagctcatccttgtttgctttccaaataaattgatccttttgatcagacatagtgacattcactgctttggaaactaaattataccaatcttgcaaatttcttccagttattgctcttctaaaggccaccttcaacggagttcttcccaaaacctctgccactactgcattcttattcctaacc

SEQ ID NO: 8838 - DNA, 1737 bp, Oryza sativa
tttttgtacttgcataatggttttttttttgccagatacttcctcctaagcatattttgccacagtccatcctcattgattagtttaaataaccatgtacttaacatacacctattttggatttctaagttttgaatccctaggcccccgcattccttagagcaaggtcaatagtgtagccagctactagctccaataatatccatgtcattttatagccaataccaaaattaactagtacaataggttggctattatatcaacatgatctcattattcaaacaataaactttacatgtgcatgatcagaaacgccctcaactctgtggcctatatggccatttgtattatgcaataaacatgggttatctactactctacctgaaaaaataacgaataacaacacacttgataattcacatagtatatcacaacccactgccgcccaactgcataatctatacatgaaaaaaggagaagaacaaaagggaaaataaaaggagctataggaagagattagaacggactagatgcaacagatgagacgaagaatcggtagaacagacatagacgacaagcattcaacagaccaagggagaagaaaagaaaagaattagaccaagccaattcaaatcaagaagttgcttgttgctttgggtgccagctgcatgcccgcaccaagcgcttctcaatcctcctctcgctttctttgccgctgagaactgggattactaactttttgggcgcactggagctttcacggcggagtttcacgtcgcgggagaaaattccggcgagacaagggtgagcggaggcggcgtgaagcggagcaaaatgcgtcgggcggatcggaagaggcacaacaaaaacaaaacgatacacgggatcgcgtggtggttgcgggacccacaaatgcatgcgtatctgtgtatcgcccggcgctacatctagcgcccgctctgttccctctctccagttatactctcctccacataagaatagtctgagttggaatattttggagcctgctgattagacttattgtacctgctcttaggtctgcaaagcacactccatttggctaatctgtatttctttttatgctcgtcacattgctaaaagaatctggacctataatagtccagttttttaaggatacctttagggatctcaaagaatgaaagcatatacattgctaaactactcaacacggagttaataagaattaatcttcctccggtcgatagcaacttccctttccaactactgagtttcttttggattctatcctctagttccttccaatcttaattggccaatcttctgtaatgcattgggaggcccaaatatctaaatggataagatcccattttgcatccaaacaagctttcatatatgtcttccctttctttagccttgccataacaaaacatttcgctcttatggaaattaatctttaagccggataacttctcataggcacatagtatcatttttaagtatctggcctctttcaagtcattctccatgaagagaattgttcttcagttatatttaatttcaaaaccttatgttgttgcagcaaatcagtaagaaacatcttagcatttgtgtgaaataggtactcaactaaaataatatgtttttttgaagaaaccacaaactaaaataatatgttactgtattaataaactgtagtgaataaaacaaccttgattaatttccttcatttatgtt

SEQ ID NO: 8839 - DNA, 668 bp, Oryza sativa
aagctctgttcacacacgttcccttggattcgataccctggaatactccgtaggggaagtgctacatcggtatatccgtgcgctgcggattttatctgtgatcgtaagaaataccaacaagcatttctggcgccgttgccggggaacggttgctgatcatttccgaacccagttcatcctcgtatcctttttcacttttttattctaccttcacccctgctatcctagagaagtattcctgtcaaactcttctcaccatggagcaatctctttttgagctgtctgctcctcagggcgaattctatgagccaactccttcatcggagcccatttatacaactggctatgaaattcgtcccgagctaatcagtatgttcagggaaaatcctttttttggctttgatctagaaaatccctaccatcatctatgagactttgaacaagtctgctcatgccttaagattcgtgtcatgagacaagaaactgtgccgtggaaattgttcccgttctctcttcaagagagagcaaagcaatggtacacctctaccgttggatgtgtaagcggtagccgggaaaagttgacagattctgccttgccttctctccagttactcgtattactgcccttcgagtagaaattctcagttttaagcagatcgaaaatgaat

SEQ ID NO: 8840 - DNA, 3069 bp, Oryza sativa
ctccaacatttccatacgggtttggataaggagtctgcattctatttggacatagccgctggaggatcattcatgcacaaatgccgtcagaaggaagaataattttggatcgcgtcctagaaaatacttccttcatgacgcaacccaataaaccccagccggaggtatcgtgtccaagattgaggaacctctaacgatcgagccactcgctgaaccatccacttatgctagctcgattgatgagaaggttcctgagcagccgtccgtcgagaatgaagaaattcagactccggattgtgccgcaattctgctcagggactgttttgatgaagactacggcaataccctgaactattttagcaagaggaaaccacccattcctttgtcacctcccgatcctatggaactcgggctcctacgagaaactgtccgggagttgacatccataatgagcgatgaatggctaagggaggcagagctttcatccgaagtaattcggataaataccgctccccgaatcattccttgccatctggaagggaacaacatcggtattctctacagtccaactatcggggccaatctcgtttcggaatcttttgcattcgcttagttaagtggtaaggcagtgaccctgacaaacaaattttttaagcatccaaacggaaatatcattgaaggatttgggattgtacaagatgtgcctatctgctttgaagacagggaggcgatcttggatttccacatctttgaaatccaagactttgatatcctaattggggtacccattgagcaacttctcatcaacacaccctgattagatagcctcaaaataacactgggagggaatgaattctcaattccattctcgcgggcaaggatcaccttgacagaccctctcctcgaaattaagtcagcggaagaggttaccgcagttcctcctcatgagtctcccgaagcccttctggaagatgaggtcccccgacttcatcaaggaagaagtagatcccggtgagactctcgacctgccaatcatggaaccaccacctcgacctccgcttgagcttaaacttctacctccaggcctacgatatgccttcctatacaatgacggagaggcccctgtcataattagtgacaagctctctgaagacgagactcaacgtcttctcaccgtgttagagaagcatcgttctgttcttggctactctctccaagatcttagggggattaatctcgcgctttgcacccatcgtattcctattgaccctgagagtactccctccagggaacctcaatgacggctcaataaagcaatgcgagaggttgtaaagaaagaggtcttgaaactcctccatgccgggattatttatcccgtaccatacagtgagtgggttagcccagtctaggttgtgccaaagaagggaggaatgacggtcgttgcaaatgctcaaaatgaactaattccgcaacgaaccgtaaccgaatggaggatgtgcatcgtttacacgaaacttaacaaggctaaaaaaaggatcatttcccgctacccttcattgatgaaatgttggaacggctggcaaatcattcctttttctgtttccttgataggtattctggatatcatcaaattcctatccatccggaggaccaaagttagactacattcacatgtccatacggcacctatgcaacgctcctgcatctttccaaagatgtatgatgtctattttctcagacatgatcgaagacatcatggaagtcttcatggatgacttctcagtttatggaaagactttcggtcattgtttgcagaatctagacaaagtcttacaacgatgccaagaaaatgacctggtgcttaattgggaaaagtgccatttcatggtccgtgaagggatagttcttggtcatcgggtgtccgaacgatgaatcgaagttgatcgtgctaaaattgatgttatagatcagcttcctcctcccttgaacatcaaaggaatccacagtttcttgggacatgtcggcttttatagaaggttcatcgaggacttttctacaatcacccgacctctgaccaatctgctcaccaaggatgtgccctttgagttcgatgacgctgtttacacccaaatttagcacctatggacgaaacaggggaaaattgccaaagtttggaaagtgacgggtttccttttcacagagccggtcagaccacaggtgtgtgggtggtctgaccggctagtagggccggtctgaccgcaggtatgtgggcggttagaccgtcagggtccgagtccgagtctgttttcgtcgggtctcgggttttcttgctcgggaaggcatgtttcgtgtttcctttggtttttatcccgagttggacatggagaagggcctgtagagggcaagaccaacccctatttaagagacaaggcaggttcattgtaaaacccccgaatacaatttactttaattgttattttaccatgtttttctattttaccctagtttagtccatctttgtcggtttgcaccctaaactgtccgtcatcgctgcgagagtgcgacacctctttgtaggtttgtcctgaaaaccttccgtttttcccatgagacgggtagttatcctcatatcgatctaaatcggcctagaggctgattttgatctctaaatcggctccgctagctggtttagttgcttttctacaaaacccatcttgatttggccctttggttagattaaggtggttggcaactctatatcaccgtaaggcgtttaggtgttgcgatcgtgcttgtcgacttgtcaaaaaagttgccaacagacgcgtgcctaaaatcttttgaaattctcaaaaaggcactcgtcgctgctcaaaccattcaatcccctgattggactctgcccttcgagattatgtgtgatgcaagtgactttgctgttggagcggtcttgggctaaaccaaagataaaaaacatcatgcaatctgttacgctagcaaaactctaaccggagctcagttgaattatacaactactgaaaaagagctgctcgcggttgtttttgctat

SEQ ID NO: 8841 - DNA, 1704 bp, Oryza sativa
tcatagaacgatgccatgcctcaccctatggtggccattatggtgcattccgcacccaggccaagatttggcaaagtggtttcttctggccaacaatgtacgaagattcaaaagaatttgccagaagatgcacaagctaccagaggcaaggaggaatcactgctcgcgatgcaatgccccttacatacaatttgcaagtcgagatattcgatgtttggggtatagacttcataggacctttccctaagtctcgcaactgcgagtacattctagtggcagtcgactatgtctccaagtgggatgaggctatgccgtgcagcgcatgcggatgcgaggcatgccaagaagatgttcacagaaatcatcttcccaagatttggtacccccaggatggtcataagtgacggaggctctcacttcattgacaaaaccttctgagacctcctacgagagatgggagccaaacacaatgtggccactccttaccatccacagaccagcggtcaagcagaaacatcaaactaacaaattaagaatattctgcaaaagacagtcaacaaaatgggaacaagatggaaggatagattgccggacgcacgtgggcataccggacagcatacaagacacccattggaatgtccccatatcagatagtctacgggaagtcatgtcgactactcgtagaacttgagcacagagcatactgggccatcaggaattggaacatggattttgagggagcaggagaatggagaaaaatgcagattgctgaacttgaggaatggagagaaagggcttaccacaacgtgaggatatgtaaagaaaggaagaagcgttggcatgacaaaaggataaaaatcaagaaattcaagccaggagacaaagtactgatgttcaactccagggttaagcttttcggccacagaaaattatgcagtaaatgggaaggaccgttcgacgtcatcgacacctcttcgcacggggcaatcacactccgtgacaaattagttaacatatttaaggtaaacggtcaacacctaaagattttccttgagctaaatgaaactttagatgaagtggatgtcattgaattaatcgattatgaaccatgatgatcttatctaatgcatgcttaaaactctgtatagttgtcgtttttgtgcttagaataggttttagtgggcctaggaaaaatttggtggcctgccggacccaccagggttcagccgaaccaaaaccagggcgcgcccgttcagccccatttttgaacagtagtctcccccactcgtcttgagtctgtttagatgcgagttcggaggtagatcagtcgtaccagaacaagagcccctgttcttcctcctatctcccacattttgcaacccttctctccatctcaacccaattcccttgctccatcatctccaattcaccaatggctggcaaatccttgattccattcgtcggcacttcatccaattccacatacaacctcaccggagagccgacaccggtaaaccaattgattccgatcgaataatacacgatggaaggggtgaacactgtatgggctcaaccccttgcagctgtcccaggctcccctgcaattttggagccaatcgacgagctccctggttcggccgaacccttctcggccccattcggccccccggggggcagtaaaaaaggctgcaggaattcgatcag

SEQ ID NO: 8842 - DNA, 475 bp, Oryza sativa
atctttcgatcaatgtctggagagcttacacagggtcttacaaagatgttaagaaaaggacttggtacttaattgggaaaagtgccacttcatggttcgtgaaggaatagtcctgggatatcaaatctccgaaaggggaattgaggtggacagagcaaaaatcaaagtaatttgacagcttccacctcctgtcaatgtcaagggagtccgtagcttcttgggtcacgtggggttctataggcgcttcataaaagatttctccaaaatcgcactacaagataattgagctattgacaccaaattattacaacaaaaaataattcgtagcaatatattgtactattgcaatgataatttttctgtagcaaataattatattttattgcaacgatctacaatcgttgttttatttagtacttttgttgcaatagaaaatgagatatcaccacaaaaaatcgtactgttgcaaaaaaca

SEQ ID NO: 8843 - DNA, 851 bp, Oryza sativa
gtctgttcagatggtctactacgaagatgcgttccggtagatgaaggcatgaagatcattgagaagtgtcatgctgccccatatggaggtcactatggagcattcaggacacacgcaaagatctgggagagtggattcctttggccatcaatgtatgatgacacaaaggaattcgttcgaagatgcactagatgccagaagcatggagggatcactgctcgagatgcgatgccactgacatacaatcttcaagtcaagctatttgatgtatggggcatcgacttcatgggacctttcccaaagtccgatgactgcgagtatatcctggtggccgttgactatgtgtcgaagtgggtagagacaatgccatgcagggccacagacgccaagcacgcccgccggatgtttcatgagattatcttcccttgttttggaactccacggatggtgataagtgacggagggtctcatttcatcgataagaccttccgaaattttttgcaagagctcggagctcagcacaacattgccactccgtatcatccccagacaagtggacaagcagaaacgagcaacaaacaaatcaagaacattctgtagaaaactgtcaatgagatggggaagacatggaagaacaagctacctgatgcattttgggcatataggactgcttataagacgcccatcagcatgtcaccacaccaacctgtctacgagaagacttgtcaccttccagtcgagttggaacacagggcgcactgggctatccggacatgaaacatggatttgaagggagccggatagcacaggaagatgtagctctctgagctggaggaatggagggacaaggc

SEQ ID NO: 8844 - DNA, 670 bp, Oryza sativa
atctccattttgttcagcttttttaacctactcaaatgacaaggatgccaaaataagacacatttctacttgctaagaaagtgaagagtaaagggttaaaggaatacttttgtaccttatcccgcagagctttgcacttgataggatcttttagtagcgcaacacagcgtgctacctctgcttttttgccaggtggaggcccaagcaaatgaatacgaattctcgttaagctacccttcaatttcttctggcaatgcttacactgccactgttttgttccactgtcgttctttccttttggtgccttaacgacagttacttcatcgtaaagagggtttacagtaccactctttttagatgatcctgcatcttcttcctcggagccatcagccccaagttcatcgttcgtgttactgtcatcttcgtggacgacaacgtctgcatcagctcctcctacatcttcatgtgctgcgatctcagatcgcctgcgtttcttggaaccagatccaaatgccattgtatctacagatggtttgtatgaagattggagaccttatatttttctaaactgaaacacggtacctgggttgagtttgccggcggccggcctgacgtcgtgagcgcggctgagcgcttgacagcttgaaccctggactggatcagcagcagc

SEQ ID NO: 8845 - DNA, 6200 bp, Oryza sativa
  unsure (1)..(6200): unsure at all n locations
atatccatgtcattttatagccaatatcaaaactaactagtacaataggttggctattatatcaacatgatctcattattcaaacaataaactttacatgtgcatgatcagaaacgccctcaactctgtggcctatatggccatttgtattatgcaataaacatgggttatctactactctacctgaaaaaataacgacaacacacttgataattcacatagtatatcacaatccactgccgtccaactgcataatctataatctatacatgaaaaaaggagaagaacaaaagggaaaataaaaggagctataggaagagattagaacggactagatgcaacagatgagacgaagaatcggtagaacagacatagacgacaagcattcaacagaccgagggagaagaaaagaaaagaattagaccaagccaattcaaatcaagaagttgcttgttgctttgggtgccagctgcatgcccgcaccaagcgcttctcaatcctcctctcgctttctttgcagctgagaactgggattactaactttttgggtgcactggagctttcacggcagagtttcacgtcgcgggagaaaattccggcgagacaggggtgaggggaggcggcgtgaagcagagcaaaatgcgtcgggcggatcggaagaggcacatcagaaacaaaacgatacacgggatcggcggggtggctgcgggacccacaaatgcatgtgtatctgtgtatcgcccggcgctacatctagcgcccgctctgttccctctctctagttatctctcctccacgtaagaatagtctgagttggaatattttggagcctgctgattaggcttattgtacttgctctaatgaccaagtctaggaaactgaaaatacgaagagacaccatcttgtgatcctgtcacgttctcaacaacatagaacattagcacgtccagatattggattattgaaccattattacatcattntatagttngcattctttgagtcatactgtgcgtagtggtgcacaatgacggatctcttaaaaatcgattcgttggtgtctatcagtgtcatagtgtgctaatctggggatgcgggtggcaatctgggccgtacgatccggtgatccgacggtttggtttcgctataggttttaccgaaagtcgttgatgtcactatatatagtttgcattctccgagtcctagtgtgcatagtggtgcgttcgaacgttgacgttaggaatttatcgatggttttcatctcttagagtgtgttatagatgccactaccgctgatgtatagatgtgttactcaggtatagtggagcatgatcggttaatgttcacatcgaacatagcctatcatgtactccctccgtccaataaaagggcaacttagaattggatgttgacacatcttaccattgtccaatattagatgtgtcaacatccaatactatgttggttttttataggacggatggagtacacagtgaggctagagatttgccattgattgttgccagctcgagcgtgttacaaaacacattcgctgatatatgcatgagttcgtgagatttgggtgatgggatatggtcgccacattttgtatggtgtttggttcatggtaaaggtggaatatggccgcccacataaaaatattctataaagatgttggataaggctatcccatgattcctatccaaccttatcctccaagtaaatgggtatattcacggatatatacacatgaccttttttttttattctaaagcacaatacaaatgtagttgaccacaacactcacaccttatttttatgagcatctccggaagattgggctagtatatatcttgatattgaagaagtaacaacgggcgttttgctgtcataccttgagaaaaatttgccataaatactatttttttatcattttctttattaacatagttctttgtttacttaaaaagtattattttacaacaatattaagtaaaacttgttataatatcataaaaaataaaaaaactaaaggtttaaccaaaaattgttaaaaaataatttacacgtttctatttaagttatttaagtaacatacacatttcactcaaggtgtagttgttagcacactggtcatggcgcctcataggcgaagacgacgtcgcgtggtcgaccctctggttcttttttttttgccattcatgtgacagcagaccatttttttttttttgccattcatgtgacagcagatttttttgccattcatgtgacagcagaccagcctagaaaatttttgggccatgcgtgcaaacaagcccatcaagagaacgtaaaagtgagccctagcacttcgttcgtcctcaactcctcgtcagtggtccctatcccccagccaccgccgccgtctcctgtagtccaagtctccaataccacaagctcgatgcaacgacgacggctgcgcgatggcttcatcagccgtggcgccatctgtggagaaaagcggttgtggcgcgccgcgccgccgctcgctggccggccggcgcccctctatttctccaacggtccactccaacctagctgcgtgatggagggagaaacgcggctgcggcagcggcgcgcggcgcgccgcttgccagcgcccttctatttctccaacggtccaacctcccatgttcgacggcggcggcgagcagcgaaggaacaactgcgctgctcgccctgtctccaccaatgtagatccgggtgagtctccactctccactagcttttgctcaacatacctcgttcctccatcgtaccacccttctcgttcctccattgacgtaccaagtgttgggtcgacgatccttccgtttttggaacgaagttccgcttcgttcccgttcctcgtttcgagacgaaattcccggaacgtagaacgcacccacgttccgcgtttcctgtgacttagaccggctccaccagtaagatgtccttaatttctcattagccgatcatagtcgatattatcttacactgatctttttgtagcctcttcctcctccctctcctgttcagcaaccaccaaacaatcaaactccatcggctgcagggagtcaccatgttgaggaagaagtacaaccaggctgcttctgctatcccagtaagtctctttaaaccaccaagtcttggatcggctatatctgtttgacatctaactgtcttcaaatntctctaatgtaggccttagccgatctgttctctttagatattaaagattactttgatgagacagaagaagaaaccacgagcaaggcgtctagcccccttggatgacactgtcaagaaaacacttgaagacatatccattcggctagaatcttcattggataatctggtggctgattgtggtttgatccgggcacgatttgctgaaatccaagcctcaattccggacgatctggcaaacaccattactccagccgtgtaccttgagcaacaccaattcaagctggagaaggccaagcaacggatagccgattggcgagaacagaaggacattgaagccactatccaagccaatcggcagcttgtgcatgaagagaaggctaagttagatcaactctctgttgggcctattcagtcgaatatagatcggcttgaagctcgcaagattgatttaatagctcaactcgaggaatgcaacgccgagctggatcttgaaaaacaaaagctagccgatcttccaaatgttgttgaagaacagaagtccagattgagatcggctatcaagaacgtggctgacatgactaagtctctcaaggtcatccccggaaccgacgcccaagacatccaggccatcgaagaaatagatcaaatcaggcaatgagctttgtcggctatccaacgctatctgtgtaatagatcttaggaattttttgtaatcggcgaagaaactctgactctttatgtaactcatcttaataacttttatgccgattcaatataactccatattttgctcaaaaatttttgcaacttttgcatatatgtgcccccctaattttacaatgtcgaaagcatttataaaattataatatgaactaagggcgatataacaatatcggctattgtacatcagcaaaccacaaccgattacaatagaaagacaactaagggcgatataacaatatcggccatctcaaagcgatgtaaacacatcagctatcatgtatcggcaacaccagccaatcatgcattaacccaaacacttgggtaatatttcttcaggtacttgccatttagcgctcgtccatagacttctccatcgagtccttgcaacatgtaagctcccttagacacaaccttatagatttggaacggtccttcctaattcggcgaccacttgccgaatttgttatcccgagtcccaatcggcaaaatcaacttccatacaagttcaccttccgaaaaagtcttggacaccaccttcttgttgtaatgccgagcaactcgttctttatccttggtaaccttcgcaagggctcttaatctagattgaaccaagtcttccctttcatcggccatgagatgataatattcatcggctgtcaaatcattttgtaactccgttctccttgagccaattctaacctcccatggtaaaacagcttcatgttcataaacaagcttataaggagggacttggatcgatccatgacaagccatccgataagaccacaatgcttcggccaatcgagtatgccactgccgaggataatcagaaatctttctcttaatcaatttgatcaaactcttgttagatgcctcggcctgtccattagcttgtgcataatatggtgaagaagtcaacaatttgatacccatgctatcggcaaactgaacaaactcatcggacacgaagattgaaccttgatcggttgtaatggtttgaggaatcccaaatcgatagattatatgctcttgaacaaattgtatagcatcccccgaatcaactttctttaaaggaattgcttccacccacttggtaaaataatcggtcgctaccaatataaacttatgccctttactcgatggtggattaatcatactgatcatatcaattccccaacctctaaacggccatggtttaatgataggattcatagccgatgccggtgctctctgaattgctccaaatttctgacaatcttggcaccccttgtaatgtttgaaacaatcttccagcattgtcggccaaaaataccccgcacgttgaagcaaccacttcatcttatgagccgattgatgagtaccacaaattccttcgtgaacctccccgattgcaaccttagcttgatcggcactaaaacacttaagcaacaccccatcaatcatccgataatagagctcatcatccaacaaagtatacttcaacgctttgtaacgcaattttcgagaagccgattgagatggattatgtaaatattgatgtacatcatatctccaatcatcggctgttaatgcagcaacctcaaccttgacatctttgatcatcggcttatatctcgacgccccttgggccaaatcattagcttcaatattttgctctcgagatacatgcctcaaagtaaccagccgaaattccttcattagctctcggcacttctcattataaaccattaatgtatcatttttgcactcatattcccctgccaattgactgatcactagcaaagaatctcccataatttcaatagcatcggcttcaacttccttgaataattgcaaccctttgagaactgcttcatactcagtctgattattagttgcataaggtttaatagtataggcaaactcaaaacttgccccccgaggggaaattataaccaagccgataccacaaccataagaggatattgacccatcaaagaacaaagtccatgggacaacctcaaccgagccgattgaatcatcatgatggtcaacaataaaatcggctatagcttgccctttgactgccttcggtgactcataccgaagatcaaactccgttaaggaaaatatccactttccaacccttcctttcaaaattggagccgataacatgtacttgacgacatcggctttgcatatgacagtgcattcgttggacaatagataatgcctcaaccttgtacatgacaaatataagcagcagccacttataccagggggatcca

SEQ ID NO: 8846 - DNA, 1068 bp, Oryza sativa
aaaaggtatccctttctgtggaggaatcaaaactggaggataggtaagatattccttaatactatccaaagccttatgttgctctaccccccaagtaaacttttgatcggccttcaatcataacaatggtgtaaaaggctttaaccttccaaacaaattagaaataaaccttctaacaaaatttatcttgccgatcatctcctgtaactctgtcttgttctctggaggctgaattttcttaattgcattaacaatcctttgagttatctcaatccccctctcatgaataagaaatcccaaaaactggccagccgatacaccaaaagcacatttcgttaggttcatcttcaagccatatttcctagttctctcaaaaaccttcctcaaatcggctatgtggtcctctatctctttagacttaacaaccacatcatcaatataaacttcaaccaaccagccgatcagattatgatatatataattcatggctctttgatatgtagctccagcacttttcaagccaaaagtcattacaacccacttgaacaagccgattgcaccaggacacctaaaagccgtcttatggatatcctcttcagccatgaaaatctaattgtatcccgtatttccatccatgaaactcaatatcttatgccctgaagcagcatcaaccagctgatcggctactggcattggatactcatcctttggggtagctttgtttaaatccctgaagtcaatgcacaccctcaccttgccgtttttcttgataacaggaactatactagaaacccactcaccatatcggcaaggacgaataaaaccaacatcatatagacgtttaatcttagccttgataggttcgagcatatcggctttgcatcttctcggaggttgttgatgtggtctaacccctggtttgataggtagccgatgttcaacaatcgatcggctgagtcctggcatctcataatactcccaagcgaagcaatctctgaactcctttaacagctctatcaacttggttctaaattctgaagataaattcttactaataaatgtcggcct

SEQ ID NO: 8847 - DNA, 1007 bp, Oryza sativa
tagtgttcgaccataggtacatcccgtacctaaaggcggccgggttgctcagggtggccttggtcgtgagcagaggaatgccagtgttcaacgctcctgcgttgacagcacttgtggacagatggaggcctgagacacacagcttccacctccccagtggtgagatgaccatcactctacaagatgtggctatgatcttggccctcccattacaagggcatgcggtgacgggtaggacagagaatcctggatggcgtgcacaagtggagcagctgtttggcattccactcaacattgagcaggggcatgggggcaagaagaagcggaatggaatacccctgtcttggctgagccagaacttctcacatcttgacgacgacgctgagccatggcgtgttgagtgctatgcccgtgcatacatcttgcacttgttgggaggggttctgtttcctgatgttgggggtgacattgcttcggccatatagattcctttggtcaccaacctaactgatctgggccgtttcagttggggcttagcagtgttggcgtggacatatagacagctctgtgaggcctgttgtcgtcaggcaccatcatccaacatgagtggttgtgtgctattgattcagctgtggatgtggttaaaactaccggttggaaggcctaagtggaggcaaagcttcactccttggctctacaatgagccagacatggagaagatagtggcctacttgtttgagagtactgccactgcacatgctcaccgggatgtggcatacaagcattatgtcaatgagatggactgcttacagcctcaacatgtaagtacttccaatatcacttctagtttgacatttacttctttaattgagatactaaccaacgacatctcttcaacttttgcagattgagtggttaccataccacacaaatgaggcttcaagcctgaccctgaactcaatgtgcaatcgagactctgactacttcatgtaccagtgcccattgat

SEQ ID NO: 8848 - DNA, 711 bp, Oryza sativa
aaagctttcgtcagatgaaaccttctgtgccagatcatgaattagatcatgcatgatgagtaaggttgagtgctcaaactgtttttcgaaaaatccccaatcaagtagatcatcaaagtattcatttccaatgtcctcaggtcgtgtgtgaatatcagcggaacatagcaaatcttgcgctatccacatatcgatcagacgctctttctcatacctatgatactttgggaacacagcacagtacgagaaacaactttgaaggtgagctggaagatatttgtagctgatcatcaaggccggcatgatatcattctcatcatttttgtacttccattcaccggtatgcagaattctcctccagtaatcaacgtcaaagctccttctcaatactttgcttacagtctttgctgctaaaggattgccctttaacttgtcaactatctgctgcccaattttttccagtcttggttctcctttatagttctcatgtccaaatacacattccttgaacaaacaccaaaagtcatcttttttcaaaccatccaggttgatgtgatctgctgcttctatcattgttgccacagatggtttacgagttgtgacaagaacactgttccccataacatcgtttttaagcaatggatttaacagctcatcccatttttcctttgtgctatcctcccacatgtcatccataacaagtagcactcg

SEQ ID NO: 8849 - DNA, 3737 bp, Oryza sativa
ctgctgctgctgctgttgtgcttgctgctgcatctgctgcaacacctgatggtactgttgttgtatctgttgcatcatcattgtcatcatctgagtctgattgtccaacacctgagcaattgttgggttctcgggcggtggagatgaactgttgctagatgcatcgctagcacgtgctctactgatctgctcttcgctgccactggcgttgtgggattcacgggaaccattccttgtcttcaccatctggagggggataggtagaaataagagaaaagggagaaaaacagatggcttagaaactaatctttcttataaatttaagtgcaattatcttaatcttgattaaaacactgaaaaggaagcaaacaactcctaattaaggcagtcataccactcacacgtgatatcgaccgccgactaacccacaagcaacaaacctaaacacggaaactagcaagaaaacaaactaagaagacgatgaatctaagggcggcgactctgaagatcggagcggcgcttgtgatcagagaacaagtctaacatctaagatggacaagggataggaactaacgcatgctcaaatccaaattaaacaaagcaacaaatgactcaaataaataaccaagcatcatgatttttttatgcataaaatttttttcatgaaaccacacaaaagatacttatgcaactgactaaaccataaattaatgcataaaatagatgcatagttataatgatacgcttgaagctgccccatcgaacctagacacgacttagtgcatatcacccgataaattcccgactgactgtcgaataaactccaaataaattttttctaaaaccctagactgagctaattttaaagatccgatctgaatgaacgaataagattttttccgcaaaccaaagaggcaaaaccccaaattttcccgaaacaaatccaagtgaaaaaggcatatgcagatgaaaaggggttcagaggtctcttaggtttccagttggcttgtcctacggtcaacctggctctgataccaacttgtcacgcccagaaattcccgaatagaattccagaatttctaagcttaatgtgcattaaacctctgtccaggaccagccagggtacacaaacgacaattgttgacatatagatccacgtcttacaaaaatataaaagattacaaatgcagcggaaaaaggtaaaacgagctagacttggaatcttgacttctgcagcgggtgattccactccacaggcaatccttgacggcagcgacgaaaccaacctctctgagatagctccaactgggaagaactccagctctagtgtgggggaaaagggagcaagactgagtactacccactgtactcagcaagtcataccggaagaggaggtatgatgcaggatataaccaaaggaggctaagggttcatttgcaataaagcagcaaaaccaccctcgccgacccaactccatcatgcccaccctcgccaacggtgcctaggaaagggtcgagctatacttcagatcaaacagtaacccactcccgcttgtggtaagcacgataagtctcccagggtttcccgtgaaccggtccttaattgccatgggtgcgaccagcaaaaccatgcacccacgacccaccattcagtgtattttaattaactaacatcattgtggtaacaccaatccaaagctatgctaatagtcaaagtctatgtaataatgtgatccccatttgtgtactagttgaactaagcatggctaagcatttcctaaaccaacatctaaacattttgatacccaagttatcaatggcataaggtaaataatatatggctgagtagtaggacccatcccacatgacattgtaaaagaatgtaacatttaatagaaatgcgggatatttgtaattgggtacaatatgatcaattgtaatgcatgactttcattgctctcgcattgatgagaccacagcaacgtcttcgagaaaccgcggatcgacgaaacggccaaaatctacgcgacaaacaaagcacataagaaaaacatgctataagactgctgaaacaggaaacaaaaccatttttaatggattctagggatttttatgaatttactgagacttgaatggacttaaacggaggtcggatgaattagatataggggtgaaatcgggtcgggttcggtcggatctcactcttcccatatcctaacccacattttataatcggaatcggcttggatacggatagtatcgaatacggatacaagcacggataatatcgggcacaaatatgagacgaatacgtacctagacggatacgaccactatcggttatggatatcttttcggatatcacgtcaaagcaacgatcatctatactatatagacaatagctatatattcaaccatccccatatatccataatgtgactatattattagggtttaagatatacgagcaatacgacaaggaacaatcgatttttaactggaaaaattgaaagtttggttgaaattgaaacgatgcgatggaaaagttagaagtttgtgtatgtagtaaagttttatacgatagaaaaattggaagtttaaagaaaaagtttggaactaaactcggcctgacttgtgatgagctgctgacttcctattcctgaagagatgaggatcggctggcagcaaaggcatgtagcggcggtggccacggctcaacggatgcagcaggtggcggtgcgacgggtgctgcagcaccggtggcgctcgtagtctcggcgtcattgcttagtgggattagtgaacactgaacagtaattagtatttttagttgttgggttgttaagcatggtttactggttgatggtggttattgtactagtaggccttttggccactagtgctttattgggctaggcatgttatccgggtattatccggatatttaaccgggtaatacccgtatttttaccggataatccgtatccgtcggataccgtcctcccgaacccgatctcatatccgatagaaaatacccgtattcgaacccgctacccgtagaaacttccgggtacccgaattttttacccgaaattgtcccgaaataatacggccgggcgggcgggcgggaaatacccgccccgttttcacccctaattagatatgatttttagaagattctctgtgtttttactaataaagaaaagtccttaatcaattttactgcgcaatattacccagggctgacgtcagcgaagggggggagggggcggcgccgacaggcgggccccgcacgtcagcggcttgagggagagagggagggagtgccggcatgcgggccccacgagcagtggctcaaagggaaggggggtgtgcggctggcggctcagcacggctcaagctggccagccatggggcggcggcggcggcgcgcggccaccggtggcggctggcggtcggtgaggcagcggcgactggcgcgaaggcgggaagggagagaaaacgaggcggagggagtcctcacccgagggggcggcggcgaccggcgtggaaaacgagggtagcggcgacgaccggcgatgccgaggcgcggacgggcggcggcggcaccctaggagagagcagagagggattaggagaggaggcgacgaccacggtggcttaaaacgccggcagaaaatggaaacaatggcgagctcaccggcaaacgtggggaacggagctccggcgtcgttcggc

SEQ ID NO: 8850 - DNA, 2322 bp, Oryza sativa
cgagcgcggtaaagaacacgggagagcgcggcaagagcggaaagagggagagaaggctcggtggagtgatttatagggcatgggaggggagaacgtggctgggagaacccccgattttcccagcgacgtgggaaggagacagagggagggcaggggattcaaaatgaatctcgcccatttcatgcgcttacgtggggcgggagacgcgggggagagggcggcgacgcgggcacgacgcggagtggggcgcgggagagacgggaaaggcggtggcgtgggcggttgccggcgtgggcgcgggtggctggaggttggggacgacccgacaggtggggcccatctatcggcgtcccgaaaggaggaggagggggcgcgggccggcccaagaaggagtggggcgtgcgcgggcgacggggtggactgggctgatggcccaagaatagggaaaaaggaggaaaagaaaaagaaaaagaagaaaggatttttcctgggattctttattgcggttaatgaattttaattggttaaaattacttatagggctctgaaaattccgctaaaaatcctgttaatatattgcgacacgtggaacccaagaaaaatcacataatgccaattccaattattaaatgcatttattaattagggaattaactctaggttaaattaaacaaatttcttcgaatgatttatttaacaaatttttaaagcaagaaaaaggggatacttcagggcgtgacacgcaccacctgacagggagcgatttgtcacatccaaaaattcagtcaattcctagattattttgtgtattaaatttctttctatgcatcaagtcaagatatacaaaaaataacaaattgatatgcaaatacaaacgtaaatagtgcagaaatgctttttaaacccttgaaagaaaatgacggtgtgacatgactggagtcccatcctagacgtcctctacactcagcaccgctgggccacctccgtcgagctctctccacaggccccatcaccatccacctgcaccatcgggtggctgcacgtctccactctcgtgtcctctggcatcttctccgttgggatctgcacctccatatggatccaccttcggctcctccaaatccacgttgtccatgcccctgtcactacaggggtcctatgcgctgcccgccgaccaagttagcgcggccctctccacccggctagccacgttgtccgtcgggacccccggtctgtcccacattgttttctcttctcctgtactggtaaggagagagagggatgggagatggttggtggttgactggttgtgcctccgtggtctatgctctcagccttgttcctcgcttgctgcgatcttgtgcgtagctgccaagtgaggagggagataacagatgggtgtggactgtggatatattctgcctgttctttaacctcatcatggcgactttgcgtcggagggctgtggtgtgtaataggttttccttatcatttgaaggggttatcgcaccccatggtaagatggtaaccgttgaaaaccgtgtaaatttcatcgacaaacatttgaatacaaaaatttagcgttttcgtggtttggtcgcggttaccatatggtttgatgcggtcaccacacggtttgacgtagtaaccgtgagttgtgtagctgaccaaaacaatgcttaaaaaattttaaaaacatttaaatgtgtgtagaaattatggataattagaagaatatataggatacttgttgtaatgccctgtaaataattagattttttttttgagaagggtacaactcaggacgcacactaacacacactgcactcacacacgtgcgcgtccctaacacacgctaggaatgagattggaggcactaggcctcagtgcacgggaaacgtgcagtcccactaaacacgcacgtgtgtgaagtcagtcttagggaaacggggaaaaacccctggtgagacacgcgagttgcgatcccagggatcgagcccgcgcgggctgctcgctcacctggcgacgctagccaaccgagcaacgctcggttctctgcaaataattagatagaaaaagagaatgaagagagaaaagggaaaaagagcaaagctagctagcagcccagcacatgcagcccagtagctagtcggcccaataacaaaaaccagcccaagcatgcaagcagaagaggagagagagagagcgcagcgctacagtaccatcgcggtactgtagtaagaataatcccacctcgccaattcaacctgagggagaccagcttaaataggaaggtcactagcaactctatttttggaattt

SEQ ID NO: 8851 - DNA, 8260 bp, Oryza sativa
ttcaggtatagaatcaaccagtccaactcctcgggtataaaatcaaccagtcctactccttgttccttatcctctcaagtcctactcattgttcctttccttaccttgtttctttacttatcctctcaagtcctactccttgttacttatcctctcaatctaagtgtttactcttagactccttgttccttatcctctcaatctaagtgtttacccttagaaaacccaagtggtatagaatcaaccagtcttatcctcttatatccttgcaagttttagatagtatcatatcttgcactactccttgttccttgtgtttgtgaaattctcttcacgtatagaatcaaccagtccttatcctctcatatccttgcaagttttagttaaactagacattttggcgcgctttgcgcgccctatcaggaagctaataacaaaacaaaaaaagaaaagtttttcatgaaaggtaaacaatatttttaaacggtaattagtgtttacatgcattgtatagagcgaaaattgccaaccatattggctagctgtagtacacatgtaacatagtaagataccatatgttgccaaaatcagtacacttgtcaagattagacaaaaccatatggcgcgacaaaatatgccacaaaaatatagcggccgattagatggcatagcatagtagcatgttcaatatatagagcaaggcatagtggctgattgcgtttttctttaacaccatttaaaaagattggaccgctcccactgcatatagtgcacccttgagttgattctgtagagctgaatgaagatagtcaattgcttaccatatatatgaataacatgcttcatactatggacgacactaaatattgcactcattatcacataaccacaatcagtacagttgttcaaaatcacaagcagagtataacatgaagcactgttatcttttaaagattatcattgataacaatcataaattcataacactgtatcgctaatacaaataacattatattgcagtataaataaaatgaccaaaatagtttcaaagcatatactattcatacataaacagcccagtttatgcttgcaagacaactttttgggtgatcagctatgtttcaaacatcacagcaaatagcttctccagcaaagttcagcaaattgatatagccatatatagactgacaattcattgcattatctatactcataaagaacctgctgtgtacaactatatatatgtggtatataaagtgcatgtccaataatatacgatgcccaccaccagtctcgcccctgttggtctcctaattgccgcatcttcaccctgctttgccaccggtcatgagaaccaatccaagcaaaagtgtaacataatggcgattacttacccaaatccaatatagttgcaacaataaaactaatgcaaaattgcaaagtcggtcatagttgggttataaaaattaggccttaagctaaaatgccaatgaatagcaaaacacaaaacagcaaggtcttgagaaatctaatgatataattttgttttgaacaaaaggttttcctccctatgcatcactccttttctttctgaaattaaactacattgctactatcctctaatcatcagctagcacgaaattgcttatattgccctttaaagcttatattgcaatgaatgaatctgattcagaaaaatgtcgctcatccccagattagctacaaatctgactgcaccacaacttaatacctgtccatagagggtggcaaacaatattagttttgcctggatcggtagttaaaaaaaaaattgtatccctgaacagaacctccctaatttgcatcctatagaaagaaatcatcacagtttaccttaggtatttgcttgtgacaaatttcatctttttcccagcaggtcatatcacctaaaccctttgaagctaatgaaccaatcatcattgccaaaaggaaactaaggtcagtgcatcaacgacaaaaagaataaaaagctgtgcagtcattcatgcaatccttaacatgaatggcaaggcaccaaaaaaaaaaatctacagcactcattcatgcaatccataacacgaatggcaaggaagaaaagccacagctacaatttagtttcaagagaagatgttaaccgcaatttgtataccatacaaatctatgattaacatctagcaaaaaaaaatgctatccctatttgcagctctggaagagacatacaaggtcagacaatgggagtctctatcacttgacagtaaattgtaaaaagccactaaatttgatttctacataatttcaactcgtgcaaccttcgtgtatatattttacaaaaacgcgaaatcaaagttggggataaagtagccggaagacacaggaataaggggatcatttcaaaaattttgcctaggcaagatatgccctatttgcaagatggaacgcctgttgatatggttttcaatcccttaggagtaccctcccgaatgaatgtgggacaaatatttgaaagctcgcagttacctctgggtgtgtacacagaattgcaagaaatatagcaagccagtcaattgatcgtccagcagccaccaccttttcccatactaatttgagccagaggtgctaagttttctgcattgcagagcatgtcttgcaccaacgggtctccaatctacatgcactaagaaagaaggaacccatgatgacgatggcaacggactactaagaatgaaggaacccatggtggagatggcaatggactgcttggtgatggatctgctgttctgcaacaaattgatccatcctaaccatgctgaaacctagtgttatcagcagaagaatcattgcagggggtaaaacatttttgatcagattgattgctccattgcaggcacaaaccataaggccggaaagggaagaaagtatacatgtcttttttttcactaaataccagcagagtggcgtcacagcagaaagtggatgaaagcaaagatccactcgctagatgcagtgctctcagaatgccatcaagaacgaacaagttccaggcagatccactcgctagatccattgctcttgaggatggcaacaagaacaatcaggtggctgggacttgagggtttactttggagaattacctctgcacatctgtccggaccgcccaatttcctcagccgggatcaaccacctcgccgtcaacctcaagctctgatctcgcaaatggggtgttgcgctgcgaccagattagtggcatcccatcgatttccaacctcatgccaccgcacctgctttcggccgccgccgccgccgccgtttccccaggctccttctccctttccccgacgagcttgccagatccagcgagaggcatcggtgcgcgggcagttgcggcacggcgaggctcgggccgcgagccatcatagcaggggagggagggggaggaggaagcggcagggagagcaagggaggacggcatgggaggaggaagccgatgggggatgttcattttttcaaaagagcccctttctgtttgatatttcgagcgcggttcttttttggggtttttctcttcttcttacaaagttttcctgaatgtgaagggcctagaagtaagaatgaaaacgtaggatcgtattgtattgagacctaaaacaaattacaaataacttgaagggtctttttgcaaaatctccacccttatcatcctgccgttcaatcaagctgatcggacggcgcgcgggcgcaagagggaggccgcctccaagagggcgggggcgacgtggatagcgccgcgtgcgaacacgcctctgcaaaacgctctcagctcggcacggcaactccaggcaagttttaatataaccgataatctaagtgtttacccttagaaaattcaagtgtctctgtaggtaacctatctgatcattcaattataaattcctaccgctgtcatcatccaccaaataggctcaaattctgtagttctattgaactgaacatgaatctattcattatgatttagcgagaatcctgttaggcgcgtacgcgccggcaaacctaagtcgcgctcgtggctaagattttttttacccgagaagcctaattaacgtaactaactaatccgattagatttgataatgatgatagttaaggtaatattttcctttttactttttactaatagattgaaaagaaaacagtacgtgaagttaaattttgaaaacttccaacccatatttgaaattttcaaattgaaatttaaattctttgaactaaaattttgtaaacttttaacttttcatttcaaatttgaaaaactttcaactcaatttgagacatttatcccagatttaaaaacaaaaattgaaaactttcaacctagatttgaaaactttgaactcataatttgaaaactttcaactctagatttgaaactttgaactcaaaagttgaaatccttcaactattgatttgaaaactttcaactcaaaaattgaaaactttcaacccgaatttaaaaactttcaactcaaaaattgaaaactttcagctcaattttgagtctttcaatccaaatttgaaaacttttaactcaaaaattgaaaactttcaacatagatatgaaaactttcaaataaaaatttgaaaaccttcaactctagattcgaaactttctttatattgaaaaactttgaagtcaagatttgaaaacttttaatttaaaaattttgaaaaacacgtgtgctaaaaataaaaaaaatgaaaaagaaaacgtaaaaaaaagaaataacgcgaacagatggaggcgcacacgaagaagaaaaaaagaaaagcgaaaaagatggaaaagaaaaagagaaacgggaaaagaatagcgaaaaaaagaaaatgtgagggggagcgccaggccgccgcgcgcgccagttctgttactggcgcgcgcgcgccaattagcagcacccatgatttagtgtacatccttcaacatttcagtgccaatcacacaatacttaagttttctttccaaactacacccatatttctgttttccatgtctggttggccaaccattctggcaggagaccaaaataaaccacaatatatcatttatgtttcaaaaaggaaaaaagaagacagggacacaaatccttttgttgacaactttttgtgacaagtcgacaaacatgatcacagcacctaaacgtcttgcggtgatatagaatcgccaaccacctcgatctagccaaacggccaaatcaagatgggttgtagaaaaacagctaaaccggctagcggaaccgatttagagatcaaaatcagcctctaggctaatttagaatgatatgaggataactaccagtctcgtgggcaaaacggaaggtttttaggacaaacctacaaggaggtgtcgcattctcgcagcggcggcggacgatttacggcgcaaattgacaaagatggactaaaactagggtaaagtagaaaacatggctaaaagttaagatagaagaaaaaacaattcaagtagattgtgtgttcgggggttacaattaaaccaagtagattgtgtgttcgggggttacaattaaaccagccttgtcccttaaataggggttggtcttgccttctactggccctcctctacatccaattcgggatagaaaccaaaggaaacacgaaacatgccttcccaagcaaggaaacccgagacccaacgaaaataggctcgggcacgaactctgacggtctgaccagccgcatacttgcggtcagaccggagtttaggccgcggtcagaccgctcacatacctgcggtctgaccagccctatgaaggaaacctggcactttccaaactttggcaattttccctattttgtccataggtgctaaattttggtgtaaacacatgctcccctgcctttttggtgaacattgtgaacctaaaagcatagaacatgttatctcagggtgataatccaattactggctccgtgaatccccaagcatcttgcaaatgcgagagaagtatttcttcaagtatttcccaatgattgctctctaaaaatgctgtccttgaagtgtctccatctctttcgaggtcttcaaacgcttgtcactgacgtcttcaaaattgccccccatcaaggtcttgtaatcttcgactgacaagtcatcttgcttgaaacaccgaagagagccaagatttacctcaactggcaaaacggccttttgttcagaagccaactcaaaaggagtgactttagtagcaccatgtttagatatcctatgagcccataatgcttccaaaagcacttcatgccacttcctttgatgtttttcaatcttctttttgactaattttaacaatgttttattactcaactcggcttatccattagcctgagtatagtaaggagaagaactcaacaacttaaaatcataaaattcggcaaaacttctcacctttttggacttaaaagaggcttattgatcaaagtttaaaagaataccgaatctatgaacaatatgcttcaaaataaagtcaattaccttcgtgtaagtaatattcttgaatggcacggcttaggcccacttagtgaagtaatccgttacaactagcacgaaccaatgcccttttgatgacgaatgataaatttgaccaatgaaatcaaaagcccaatctcggaatggccatggtttgataataggattcaatacggcggcgggcgccaattgaacattgccgaaccgttaacaatcttcacatcctctatagtacatggaacaatcatcaatcatcttcggccaatgaaacccattctcctaagcaagcaatttatcttatgggtgttggtatttcttaatgacattactagaaatataattcccagcaatggcacagaaatactcctggtatattatggttacagagttcatccgcaagcgcacggatataccattgtagcatttcacccgagagtattccaaaggtatcatatttattttatcccgtgggaagaagatgtagagagaacttgactaataatttatatatcacttgtgataatcatattctaaacaggggttaagataaaccaagggtagagtgacacacaagcattggctactcattctcataatatattatctaagctaagtggaaagaaaagagaaagataatctattcctatacttctaatatacatagtatacatacattctagttaactgatatactagctaataccctgtatccgatgccctcctggtacttcgagaagccacccctgactgccgagtttcttacgacagcccgtcatgaccatataaccgaggctaaatacggaggagtaccctccccaaggaattaacttaggactatatacacgtgcggaggaatacccgtactgagctgtcaccatcagcgacccacctctcatccgtagcatataaccccaaataatgatatcccataatctagacaccacgtctaaactaccagatactactctaatatcatcgtcatgacatagagaaattgcatatgcaaacattatacccgcaccaaagcatctcccagataagctagcagtatattccgtataacatgaacataatgtaaagtaggcattcatatactcggaaagtatttcaataccataaatgtataaagaagagtattctaaataaagtacaaagcttacaaaagaggaacagaaagctactagagccatacccgaactcttccgaagacttccggactcccgatttctactttattcctattccaccagcttgatactaaactaaacttgagagaatatgagagagctcttgcttgaggtgtgtgagtgaagtgagaaggtgaagtccttatatagaggtagttatgacagttgtggaaggggaattgtccgaagtgccctccgaccgtcattgggatgcaatcctggacgtccacgccgaaccctgcatccaacggtgctaggatgggttcggcccaaccaccaggttttgccgaaccatgggctgggccatcccggcccatcttcggctggcggcctcctctattgcttcactttgtagacttgtgaattttggcccaattcatcgtgtcaattctgagttcttggcccattcatgcataagtctgattctcgacatcgtctgattgatttatcgtttgagttgatgtcaattctcctccactttatggttattctctgcaaaaggttagtgaaccaaacacta

SEQ ID NO: 8852 - DNA, 1583 bp, Oryza sativa
ttcacctttgatccaccagaccgattctttttgtgggaaacggtcttgtcttgaattagaatcaggggcgaagcccagtgaaggcccgtgggtgcagatgaaccccccccccccaaaaaaaatagttattacccccatatctcggccctatatgcacccccctcggcccaatatagtgcacccacagcccaaacaacagtccagttagcgttgtaagcccatgaggagagtagaagcgagatcaatcttttctgttctcgacttcttgtatgtcgcgtcacgtcgccgccaatcttgacgactccgcctcgcgtctgtttggcttccacgccgctgctctacaatcagccaatcccagtctccgagacagctcgccgtcggcgttgcccctgcttgcttagcacctgcattgctccagccgcagcccgcaggagccagaaaggcaggaagccggtcgccaggctaccagctaaccaggagcaagcgtcataccacactttctcaagccaacaacgacatcatccatctccatcatctgaccagcacacagccacattgtgcgttagtagagacaaggtaagaaagcatgcttcatctatttctttttcaatcaatttgatttattagatacaaaggcctaaaatttttattggttgtttttttttttacattgtaggattaggaggccagtaggcttcaatttggaatccttcataattggaataaaattgcagattgggggaaaatttgagaattgaaggtgctatttggatgtaagtcatgtcaattttcattctacttctgtacttgaatgaatgataaaatcagtatacatttacatcctcctaaatcatctaatgataggttacgtggagaaagaagaaatgaagaaagtcaccaatgaggcccttgttcgtcgcttcatgaaaatgcaaggacacagatttgatgatgattgaagataatgattgtatctaagtgcgttggattttttttatttgaaaaatgagaactgattttgatgttaacttgttttaggttatcaaatcatcgtcgaggatattgtttgcttatgcagatcatcttctgctcatgggttagtaaccaattatcaattatcaatgttattagtggttttcttaattttgaaaaacaatgtttttcactttttttattttattgatgcatgtgagtctctgtactgttgattaaaaaattatcgatcaacagttccattgaaaatgtagcttgaagttatgtatattgatatacttgtggcaaaatctcgaaccccctctattttgctctagcttcgccactggctgggcgcggccaccggcgacacgatgcagcacggcggcgggcacgggaggtggccggtgcaagggaaaaagggagaggagatgggggctcaccgggcggtacggcggaaggaggcggctggtggcgggctcctcggggtggcacggcaacggtggtccagcggtgttccacgagcgggaaccagcggacggcggtcggaaggacctagggaacaaggaggaaaggttagggtagggatgggagttgcggcgcggcgagaa

SEQ ID NO: 8853 - DNA, 1507 bp, Oryza sativa
tcattcatatttttattcccactagagccataggttgatcggttatgattagcttgctacatacgctgcttgtcattacatcaagcgttgtcaagttttgtgaccctagtgaaatgtgtttcatactttcatggtcaagatcacatacattccgcatgcatgcacatatgcttgacttctacactggaagttagcatttctcatttgtcattcatttcatctatcaaataaatactccatgttatttatgcctcttcctccaaagttctttcaaaaaaaaagaaagaaagagagaggcatggctatgcaaaaggaaaagaaaaaaaatgctcaaacaagtatggagcatgatggtgaaaaaaaaagaaaaaaaagataaacatgcactctcccaaatttcaaaagagaaaataaatgaaggaggaggtatacaaaaggagttatttttatttttcctttttccaccgacaaattcaccatacacatacacatgcacattcttgaccagaaagtatgtcttgtatttccgtggatccattatttgactttgcaatatatgtgatgcaagtaatgctctactcttttccataccctgagctccacataagccttattagatggtaggaaaagaaaaggcgcaatcatatgcctttgtgaggaatcatacaccatgagtgatcgagagaatcaattgagtagctaagcaaagttatagttttgtgttacttgaaaaaaaaatccaagttgttcttcatgaaaagttagggtgacttgagtcaagattgttccatttctcaattgctcaggatcgcatggtagacactacaaagacccacaagtacaggtatgactttgaataatttgtttgcatgattgttagtaaggaagtcataactcttttgtagagtccatagccttcactcgggacgagcaaaggttaagtgtgggggtgttgttgacggttcttaaattataatatctgactgacaatacctgcatataatgaaataaaacatggtattcaacttagtggtaggtgttattactaatcatttccattagtgttggtgaaatatgtgtatgcatgtaatttgaggagaaaacacaagggaaattgacgcagtcaaacccaatgaggggtcagtcgaaccaccaattcggctgaaccacctctaccatgaatcgtcctctgttttatacaaagcgcaggtttgcacaatttttcctttggacatccattttatcttgagatcaatttgattatcaattctaaaatgtcgaagataattgaacccaagctagggatggtacaattagagttcatggtctccctgaaaataacaaaatgaacctccgcgcattcaggacgcatttacacagattggagggcccatatgtcaaccaaaaccacttagaatcgggccaaaacattgtgcaagatgttggcggcccaataagctatctaccggccaaatgagaggccgggaggtcggatttttggttcggc

SEQ ID NO: 8854 - DNA, 10245 bp, Oryza sativa
ttccctaagcggttgcagggggtgtcatgctcggaaaattcactagtaatttctgaacttatttgtgcataaaatcctcatccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagaagtaaaacagtggagtaattaattagaaattttaatcaacactgaacagcacacccatgctgcacaggcccaaccatcctgaacaaccatacccggctgtacagatctaactccaaaccaggagctaagcaaattattaccagttatagcatcaataattattgtgagagctgtgagactaatcacgaaaaacattgctcaacccgcccataaccgtgggcacggctattcgaatagttttactctggctagaggtgtaccactgtacccacaagacacaactccacaatatgtcaccatatcatcatgtgcccatgctgaacatgtcaccatatcatcatgtgcccatgctgaacatgtcaccatttgtgtagttgtgacaagacccctcgcataactcaacccaaagcagtgcaccgttcccggatcatagtgacccccttataaacaaggcatggactccccagtgacccccgtgggcttatctccgccacttctcagtctggtgctccgcagtgagccttgttatacaaagtgtccagccgttgcccattctggcttgtggttggcacggttaatgtttcacaaccgaaaatcgtgaaccggtccttaattgtcatgagcacgaccatcaaaaccatgtgctcacaacccaccattatcaagttttagttgacacattaattaattaaccaatcacgattgaccatcgtgagctatcattaaatatccatcattaagtaatagtgaaacattagttatcccaattgtatgctaatgtttctaagcatggataagtaattatgtctaacatctagctgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggaactgtgtttgggatctgtgtgacttgccttgcaataaagggtcttcaattaatcttcttaacacttccggcgcactcacgaaccttcgaaacgacggaaacgacaagctaacacgcaaaacgaggaaaaagactaataaaaaccaaatagacaatacataaaaagtaaacaaacatgtagatcataattttagatgaattatgagacttgaacggccttattcggacttcatatgaatttattacaaattttacaagattaaatctaattaaaacctatttaaaaaggattaaataaatttaattcaatttatgtataattttaatatgtagatctttattttatacaacttttgcaacttgaaccacattaaactgagttacaaagaattagttatgaatttttaaagattaaaccggattaacgcatttttatggattttaattgaattatgacgcaataatgaattatttttgaaaaggaaaagaggattattgcgtcagcgggctcggctcacggaggaccaggtgcatggcgacggttcacgaaaacgaacggccgagattcatccatccaaaacggacggccaagatccatcggtccacgaccggaccacggcggacggcaatgatgacgtcggcgatgacgtcatcaccggcgatggctcggcctcgcgtgctcgtcggcgaacgacggcgcggcggcgcaaacggaggacacctacacgtagcggacggcacggcgaactcaccggtgctcaccgatacgacaaacgacgacggacgacggccggcggcgaggtggacggcggcggcggcttcggtcggcggtggcgtcggagctgcggtggtcggcggcttcgggggtcaggcggccgggcttctccaccctcccgcacacctaacggtggtgacggcgaccggcggcgacgacggaggcggcggcgcgacgcggatggagctcggccggcgacgatagcggggtggagcacgtggcggcggcgctacgaggcacgggagatcacgggagagggggcaaacgaaagaagaggactagggggtcctatatatagggctagggagcggcggcgaaggcccacggcgaccggcgacgagaaggaaggtttagggtttggaggagagagatcgatccgaatcgaactcaaatccaacactttccaagcgattttagccggtgattccaaaagagaaaagatagaggagatcgagaagatcatttcccctctattgatttcaccggaaacggaaaggaacggccggatttggaatggcggcggcggcgcagctcggctagggtttcggcgagaggaagacgacgagcctgacaggtgggccccacctgtcagcgggcgaacgcgcgcgcgcgggcggctgactgggccaagggagagagagagtggtttgggccggctttcggcccaaaaccaaaagggacttttaaaaacctttttccatttaaattattcatgaaatgcaattccatttattaaaaatacttccttggctcaaataaatcccagaaaaatctaggaactatagaaacaagagaagtatttaacaaaattttatctagcccacttttatattgagatttaacaaattaaaattagatcttctcttctaagcttttaagatcatttctaataattcccttttagacaacaatttataaattaaggatttttaaacaagaaaagcacttaacataattataattagattattaatgattaaataattactgaactgttctttgtatcatttagaaattgagctccgaaaaatccgagaaaatttcagagagtataattaatcatggagaatttaataaaaattaaatccatccatgctttaaatttaggaaatttttatttcccacatttaacttcacttataaattaaagaacatttaatataaattctattaataatttattagataatttataaaccctaaaacgaaaatctggctgtgacacgtagatggcttggattccttccctaaggcggttgcagggtgttttggtcatttcccatgcccctaaccgtaatttggagcctatataaggagtagttcactctcattccaacacacacaattttgaactgaattacaagaggccttattgtatcttttgtacattagaataaggtagagagtgaggggaagctctggaggagtgcctggaagtttggcactcatccgacttctacctcgacgagtgtagcttcctaggaagaattctggaggagtaccagagctgtcagtacactctgctccgggttcggagaacttcttctataaagtaagcattcgtgttcctttcttatcttatttaattatttaatctgagtaagatagacttccatctttttgggttcattgtttagtatttatactaagtgctctagtactaggactccggatagagaaggaagttcctgcgaatgtattagagtagtaactaataacttagacgtggtgtctagattagagattacctttgtttgttgtgtatcccacggatttgtcagagataggcggcaggtggtgacagccctaaatcccgtcctagtaatcctccacgttcggatacatcatagagctatagccggaaccacgctggcagaccagcaggggtcggtgcccgaagcagcagataggaaattatgttttgcttagcttagataattaaaacatatagagagtcctgtctagcctgcctacctatagttgttatccttggatagtcttagccttagatagattacacatgttccctgagttcgatatcctttagggctcacccaaaggtgaaatgctacagcggtattccgtgcgcttgcggatttatctgtggtcataagaaataccaacaggcatgaggtgaactatatatggctaagcaaaatgaaccatcccacatgacattgtaaaataatgcaacatttaatagaagacgaggcatttataaattaggtacaatatgatcaattgtaatgcatgacttgccttgctctcatgttgttgggacctccgcaacgacttcgcagaacagcggtgcatcggaacaaccgaaatctacgcgataaacaaagcacacaagcaaaacaggcaatgagtctaccgaaacaggaaacaaaaccacttttaatggattctagggatttgtatggatttactacaatttgaatggactcaaatggagcttgcatgaatagttatgatttttaaaagattctttgtgtagaaaagtccttaatgatttattgcgaaataaacccaggggtgactggaccacgcgggtggtccaccgccagcccatgggaccaatggtccagatcagcctcaaggctgatctgacggcggcggaagcggctgcctggctcgggcacggcactagaccgccccaccggccatggcacacggtggcacgagcggccactggcggcacaggtcggtggcgcgtggcgcgggagcaccggcgtagctcggtgctaggagggagagggggaaaaggaaacaaagggggtcctcaccgaggggttcagccggcgcggggaaagatgacggcgaacggcgacgacgggcggtagacggcaagacgagccgcggatggcgtccggagcaatctaggggagcaaataagaggaattagagggagagaggaggtctgcggcgagcggcaatgccggctgaaggcggcggaaatggaggggctcaccagcgtgcggggaagggcgattttcgacggcggttggcgacgggtgaacggcggacaagatggccccgacctcacaaagccaacggcggcaacgaagcggcgcgatggtggcactagcggcggccagaggcggcggtaggcggcggcgctaggaaggagtagtgcggcggcggtaggcagcgtgggagaggacggcgaaagaaggaaaaaggtggaggaggatgcggggatggtttttataggggcggagagttcggacgtggccgggacgtggctctatttcgccggcgacgtggggaggtggagagagagagagagatggaggatttcgaatccccgccatttgcgagcgtgtgcgcgcgcgcgcgacgtggggtgtggaatggagcggagaaggtgggcgacgatggttggagctagggctccggcggccggaggttgaagaaggggccgacaggtgggccccacttgtcggtgattttgagaggggaggaggcgggcgccagccaggccacggccacgggccggcccagtaaggaggactggcgcggaaggcgtattgggccgacggcccaagaaaggaaaaaaaaggaggatttcgaatccccgccatttgtgagcgtgcgcgcgtgcgacgtggggtgtggaatggagcggagaaggtgggcgacgatggttggagctagggctccggtggccggaggttgaagaaggggccgacaggtgggccccacttgtcggtgattctgagaggggaggaggcgggcgccagccaggccacggccactggccggcccagttaggagggctggcgtggaaggcggattggaccgacggcccaagaaaggaaaaaaaaaggaggaaaagaaaaagagaaaaaaaggaaaaggattttcctaggatttatttattgaagataattgattttaattggataaaattattttcaaggctatgaaaattccattaaaaatcttgttaatgcattaaacatcgggaactcaagaaaaattccaccatgccatttccaaatatcaaatgcattcattaattagggttcagctcaaggttaaattgaacaatttctttaggcgttttatttgatgaatttaaagctagaaatgggaaaacttcagggcgtgataatattagacccgtcttgaaatgtttttattttcactttgaactacctattgttaccaaatgttgtacattggaccaagtgcctcacatgtcaatgaaactaaccacctctattatgtgtcgcttacacgtggaccactcgattcaaagtgtagcatttgacaagaatacatagtccaaagcaaaaaaaaagcattacaacggtggtccaaagtgaaactttggtaagaatttgcaacccaaagtgccatttacttttttttatatttttcccggtcaatcatgactggatttgcgttacccaccaccgtccacgcattgacatcctcatcgtccgcgttggtcatcattagctattgggttcttcttcgccaacatcgagcatcgccaccacgtcttctcaagataccaatattgctggtctaagccagtggtttaggtaccataggttaggctaccgaccttattgttctatgttgttggtcttgctgcttcacttttgttttcatctaccttcaccagcgcggtattggcaacaccgttgcacacattcaccttgagttatcattgagcctggcaaatccgacatgatatctcgtcctttacggttcgacaacatcggctcttcggtatcatcttccccaatgatagttatgatcgtgtcactgttttcaactttagtgggtcgtctcacaaccacgacgcattccatgcatccgtaaacactacttggcaccccttgcatgccacacgacttggctactattggtatttcttacgatcacagataaaatccgcaagcgcacggatataccaatgtagcacttcccctacggagtattccaagggtatcgaatccaagggaacgtgtgtgatcagagcttcctccggttcatccgaggacaccaagcaaatgataggccaggatacagatgatttactagtgagaaacagtgtctagggaaagcttaattctaatcctaacgcaatacttcaggcactgtcaacctgctgttcccagatgtcgctctactatgtacccggacagggaggacttaagtgatcgcgagggctgtcaccacctctacatctacctcaaacgtactgtgcgatacgcagcaattactggataacaattacctaaacaccatgtctaagcaattaatatctactttagtgtttataactcaccaaagcaatcactatattttagttgattatagtgaacaataatcccgtatgctatttaggaactaaccaagagataattctcacaagataaatctaaattactcaagaagaatattatattgaattcagagtaataaacagaataaaaaaaataggagaagattaccgacaactccggaattcttccgacttcttctactctactctcttcctattctagtatacaatatagtacaatagagcctcttataattcagctcaagcttggaagtgtgtgtgagagtgaatgaagtgaggtccttttatagggtagttatgacggttgtgagaaggggaaatgtccgaactgccccgcaaccgtcattgggagaacatctggaacgtccatgccaaaccccaggatcaacagtgatcaggggggttcagccgaaccagggggttcggccgaacctgggctgggccttcgtagcctggccttcagtcggtgaactccctgggctctcctctgtccatttctcggagttttgggttgattcactgatgttttgatgaagttcacaacccctccttgtatgaatacataattctcctcacattagtctgattttcctcccaacatcggggtttatcatctgcatacaaatatacatcaacacttgttgaatatgtgagagtaagcatgcagatgttggctgtatagaatcggcatttaacaaccgccaacaaaaccccccacacttagccttttgctcgtccctgagtaaaggttagtgtagaatgaatttcttcaagagatgaatcaagcatataaatcattcacaaccatacatgcacctgtgaactttatcagtggctatcttaccatcttgagtaattgataaatggaacaatcttgattccagtccttcttgcttctctgccagactcatgggatttttatgaattttcgcaaactagctcttttcctcatattgactttctctcttgtctctcaaagatgtatattttcttttggatcctcaccaaggcaaagtgtgccagaatttacccctattctaaggctgatatgtggagcttggtagggataaactgtaacatacctgcatcatatatattgcaaaaccaaaaatgtggactcaagaagatcatcaatcatgctcttagatcaagggtttttatttgtggtggaaaatgaaaacgtaaaatatattgtggaatgatggaaaaatttattctccttttttcctatactttctctccattttgttctcttggcatgatcatggaaggggcatggctatattttcttttcaacttcgctcaatgttttgagagcaaactttatttccgtcttctttttttttctagccatgcatttccctccttttctcattttctttttgccaagaacttttccaagagaagaaagcatagttcactataggagtttatttgaatgtatatttttgtggaaaaccaacttccagtgtagaagattagcttaattttatatgtggaaatggaaagtggaaatgataatgaccccttgatcatgagagtatgaaagatatctaacaaaagtcacacaaatttgacaaagctcaatataatgtcaagcagtcatatgcatgataaggttgatcattaatgtactttcatatggccttggtcataacaggagttgcaagaattcctttcatctttaatcatctctcataaagcaatcacttagatatataaggttccctaaatatggatgggtgttcacaagctcaagttcagctgagaataataaatatacaagatcaatcacatgaagaatttcattagttggaaattttatctcatacttatccttaaccaattgttttctgaattttcagctctagtactataccatggtggagatatacagataaaagacgtgctcacctgcttacctgtaaaaattgagagggattggagccagctttggttcggccgaaccactctggtgcccgatccctctgcaattttctgtagagtttagtgccttccaggtgttcatatattcagcaattttcagagtatatgcacgtcagaagctgggatatctcccccacacttattcaaaacctgaactttattaaacaaaacaaatttttggcaaacattggggttaacaccaatgagccacattattcatagcaagtgcttacatgattggaaagataaaaccaagcacctactactattttattcatgggacaggaaatatctaattagcataatacttattttcctttcccatctctatgaatgcacgcttgatcttagcgcacaaaccgcgactaagggtatcaaaattatttctaatttcagcaagctctacccctagctccgcattgcgatccctaagctctatgttctccttgcggagtttctttacttgcgcagcgagcttatggatcgagggctccggcgatttcacctcgtcttcttggaattggccgggagccctcacaattggagggggcgtcaagtgatgcttcaccttcctaggtggagggctacaggataccgctgccccctccttctccgatgccgtcaaaggccggagtaaacccttaccatacccaccgccgggagttcgcactccctgaatacggaatcgctcctccttctgagtagatggagtagcggtgggtgtggtgtacttgtggagcacctcatcccctgccttggtgaacagggtgcccacataac

SEQ ID NO: 8855 - DNA, 18257 bp, Oryza sativa
gaaacagtgtctagggaaagcttaattttaatcctaacgcaatacttcaggcactggcaaccagccgttcccagatgtcgctctactacgtacccggacagggaggacttaagcgattgcaagggctgttaccacctctacacctacctcaaacgtactgtgggatacgcagcaattactggataacaattacctaaacaccacgtctaagcaattaatatctactttagtgtttataactcaccaaagcaatcactatattttagttgattatagtgaacaataatcccgtatgctatttaggaactaaccaagagataattctcacaagataaatctaaattactcaagaagaatattatattgaattcagagtaataaacagaataaaaaaaataggagaagattaccgacaactccggaattcttccgacttcttctactctactctcttcctattctagtatacaatatagtacaatagagcctcttataattcagctcaagcttggaagtgtgtgtgagagtgaatgaagtgaggtccttttatagggtagttatgacggttgtgagaaggggaaatgtccgaactgccccgcaaccgtcattgggagaacatctggaacgtccacgccaaaccctaggatcaacagtgatcaggggggttcagccgaaccagggggttcggccgaacctgggctgggccttcctggtctggccttcagtcagtgaactccctgggctctcctctgtccatttctcggagttttgggttgattcattgatgttttgatgaagttcacaaccactccttgtatgaatacataattctcctcactttagtctgactttcctcccaacatcggggtttatcatctgcatacaaatatacaccaacacttgtagaatatgtgagattaagcacttatcactatgttggatgttttattatctgatctttatgcagatgttggcggtatagaatcggcatttaacagctgccaacagctacctcgacatcaacatatccgactttggctatatcaaccatggctactctacacatggctatgaagttgcatttatccccctagtgggttttggtgattaatgacaaatagggttaagggactaatgagttttattgaccattctcaggtgtttaatcccaagatgatattgtgtggtcaagagatgcttggagaacccccacaacttatattcaagcggaattggaactcgaagggtgcataggatagtttatttcttgcaatcgaattttaggaaaaaccgtactattaagaggggttccaggtgtggttctaggatataacaagtgctctttgtgagacccaagtgtcaaaatatttttgggagctttgttggaaaatggccctaccaggatagatcaggccggccggaagttccggtcctatggacccggaagttccagaccttgaaaggtgaaaattttcccaagtgttgtccggaacttccggtggtcaggaagttccagacccattccagttcaaaaatgtgagtaacggctagaagacgtcacctagccgttatatatatatatatatccaaaacgtccccagctcactctttggccatttcacttttgtttctccactctatagctgttgcaagcctctcccaaaagtttctttgcttcctccacccaatcttgagccattcttgagagagagtgagattttgagggtgaaggagaagttttggagaaggtttgaagactaggattggtgtgaccacttggggtatcttgtgggttgacatctcggtgcttattactcttggagatcatctcctagacggttaggtgtcacccgcgagcttcttagcaactgtggatgtcccagaaaagtttgtgaaggtatttctcacctctgcaacgaaacgaggtaagtgagtaaagaaccttgtgctgaagccctagaggttttcctagtagagcaactcacacttgtggtgttttctagacggaggtttgtcacgaccggaaataacccaacgggcgttccttacgtgcgtgtattattccttgtcccaggaggcaaggtacaccaaaagttgatacatttcagagtttatcaagcggaagcgtaaataattaatttattacatgggcggcgaaggcccagcacacacaaagacaaacgggaaacagcggaagactagggcgacgaccacaggcgcttgacggcaggcacgagctagacactaaagccttcatcttccaggaactcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagacacttagttgctcaaagctattttgtaaacatgattctagagctatacaatattattaatcaaggccgtgaacccacacgaacctgctttaacccaaggcctacgacgattcagaccgaactggcaacccgaccatgggtcctagctcgtcccaagccaacccaggccaaccattccacattttagttgttaagcaggttttaagaattaaaacactaacttgggtacattgctaggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagccatagacaagagtaccaacccaaccccacctatggccggaacctccgggacaggtaggcaggactgagcccctagcagcaggacaccggccttgtgccatgacatctcgactactggaccgcagctcgtgtagccttcatttgccctagagatgtccatcgacccccgacttcatccatctccatttgtgtacttttatttataaccagactgagccacaaactaagccttacccactagacatgtggaagtatggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccatagtgtccaggtgatgagaatattcccaaagtctagagttgtaaaaccacctaatgttgcctaattaaccagcgaaacatctacctaaattcatactagtggtaccatgagtagagtgtccactagttggggttttgtttaatctagggtgaacaaggtaataatatcaataacaataataataaagtcataacaaaggtaaataggcatggctaaataaaacattgataactcgggaatttaagtaaagcgataatgcaataatttaaatcaaaataattttataaaatgggatccaatatgttcaaggatgatgtgacttgccttgctcgctttcccaaacgtcggcttcaacctccacgaagagcggatcttccgaagctgcagcatctacacgaccaacggaaaagaaaaggcttttactctaataaactccatataacaagcaggaacaaagcacaaaaatgggttcttgacttcttaaggaaaaattagagacttgaacggtccaactccgagttcaaatggccaagttatggccatttgaagtttatatgctctttaaatgaatatttgcgaatttcttcatttaaattttaatttaaaaagggtttattgcgtcagccgagggggaggggcgcgcggaccgtgtccacgggagtggggcccacgcggcagcctcacggtccacggtggaccgggtgcacccgggctcacaccggccggcgccgtgggccccacacatcagccgcacccgaggacgcgggcggctgacggccgggccccacgcggcagccactcggcgcgcccgagggcggccacgctggcgcggtcggcgggaggcggcgcgcccgcgccccgatggtcgccgccggcgaccaccagcgcggcggagcggcggctgagagaggggagggaagggggaaaggaggcgacggtccacggctcaccccggggcgacggcggcgacggaggaggcggccggagcggagggaggcggtggcgcggctcgggtcgacggggacggcggcgctccggcggtcggcgaccgaaacggaggggtggacgaggtcagcgacgatgcggcgaagccgaaggaggcggcgccgaggtgggaggcggtccagggcgacgacggcggcggaccggagctcggctgcgacggtggagagagagagcgatggcgcgagctcgattccggcgaggagaaggcgcggcaaagggtggaaacgggcgaaggaagtgcggggagggtttaaatagggttggaagggggagagagcggccggaggggaaggaaaccggcgcgggaggtcggccgccatcaatggcaccgacgagatttgcgggggcaaatccgcccgtttgaacgcgagagagagagggaaaaatgggggaaagggagagggaatcacggagagtatttccccccactttattgcacgcggggacgacgggaggcggcgggattcgcggcggcggcggcgctagggcgcgggcgaggcggcgggagcggcgggaggtcgtggatgacgggtgggccctacccgtcagcgagggtggcgggcgggcccgcccgtcagcggcgcgcgcgcggggaaaggccgagtgggccgcggggagaggagagagagaggggggaggagagatgggccgggccggcccaagggagggaagggggacttttagggtttttctttttataaaactttctcaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggagtttaattattctaggcataatttaaaggatatattttagagtcgttttgggacgtgacaaacctaccccccttaaacggaatctcgaccccgagattcggaagaactggcgaagtgatcgggatgggctgccttcagctcgtcttcacgttcccaagtagcctcttcctcagcgtggttgctccattggaccttgcaaaaacggattacccggttcctggtcctgcgctccatggtgtccaggattttcactggcctctgcacgtaggtcaagtcttcgcgaacttcaatttgctctgaatcggcctgctcggatggcactcgaagacatttcttgagttgcgacacatggaaacatcatgcacgttgcccaaggatgcgggcagctccaactggtaagcgacttctccgcgtcgagcaatgatacagaaaggacccacgaaccgaggtgcgagcttccctttcgtctggaacctgtgtacaccccgcaatggcgtgaccctaaggtacacaaagtcatccactgcaaattccaggttacggcgtcggttatctgcatagctcttctgccgggactgtgccacctttagattatcccgaatggttttgactttagcttcagcttctctcaggatatcagtcccgaacacttggctttccccaacttggtcccacaatagcggtgtccggcatttgcggccatacaacgcttcatagggtgccatttgtatgctggcttggtagctgttattgtaggagaactcggcataggggagactcttatcccaggtcttcccgaaatctagaacacaggcacagagcatatcttccaggatctgatttagacgctcggtctgtccatctgtctgcgggtgatacgcggtgctgaaatttaatcgggtacccaactcttcttggagcttcttccagaagtgagaggtgaattggcttcccctatcagatacaattttcttaggaacgccatggagactcacgatcctagcgaagtagagttcagctagtttgttccctccataggtggtcttcacaggaataaaccgagctaccttggttagtcgatccacgactacccatatagaatcataaccaccctgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccaatatttttctttcaagtccaagtacgtcttcgtgctgccaggatggatggaatagggactttcatgagcttcctgaagtatcaactttttaagttccctgtcgtctggaacgcatacccgatttccgttccatagggttccgtgttcatcctctgtgaaaccagcggctttaccctgtttcatattcttgaggatcccatgcatatctagatcattcttctgagcctcgcggatttgatcgagcaaggtaggcttggcttccagcgtagccaagaatccatgaccaactatgcttaggttcagggcttccatctgttgattaagttccggtggaatgtcacggacgccaagagtgttgcaacggctttttcgacttagagcgtcggcgaccacgttggccttaccaggatgatagtgaattcccacatcataatcgtttatgagttctaaccatctcctctgccgaagattcagatccgactgagtgaagatgtatttcaaactcttatgatcagtatatatttcacagcgattcccaatgagatagtgccgccagatctttagagcatgaaccacagcggccaactccaaatcatgggtagggtagttgccttcatggggccgtagctggcgtgaggcataggctaccacatgaccttcctgcattaatacgcaccccaatccttggcgcgaagcgtcacagtacaccaggaagtccttgcgagtatccggtaagatcaacactggcgaggaaaccagcttttctttgagagtttggaacgccttctcgcattgcgggctccacacaaatttttcttctttcttcagcaactatgtcatgggtcgagcgattttggagaagttctcgatgaatcttcggtagtacccggccaaacccaaaaagctgcggacttgagtgactgtcttgggttgcttccaatcagtgacggcggtcaccgtgtcgggatccaccgcaactcctttagcagatatcacgtgccctaagaacttgacttcggacaaccagaactcacacttgctgagcttggcatacaattggtgttcccgcaactttcccaacaccagacggagatgctgctgatggtcttcctctgattgtgagtacaccagaatgtcgtcaatgaaaaccacaacaaacttatccaagtattccatgaacactttgttcattaagttcatgaagaaggcaggatcattggttagaccgaacgacatcaccgtgaattcatacagtccgtatcgcgtggtgaatgcggtcttcgggatatcttcttcacgaatacgcaattggtgatatccagaacgaagatcgattttagaaaagacagtggcacctttaagctgatcgaacagatcatcaatccggggaagagggtacctgtttttgatagtaacttcattgagagctctgtagtcaacgcacatcctctttgtcttgtctttcttttccacaaaaatcacaggagcaccccagggggaagtgctcggccatatatatcccttttctttcaactcttccaactgtctctctacttcggctagttcatttgctgccatacggtagggtcgcttgtacagaggagtggttcctggagcgagatctatccggaactcaatctctcgcttgggcgacataccgggtagttcttccggaaacacgtctccgaactctctgacgatggggatttccgacagtcctatctgatgaagttctgaactgccgacagaggttgggggtgcaaagaaaacaaccggttgttccagcccccgatacagagtgacagtgcgccttgcgcaatccactactccttggaattgagccaatcaattcatcccaaggatcacatccaagttcttggtgtctagaaggatcaaatccgaggggaaaggaattccctggattcctataggaacggcagggctataatactttgctgtcataacccctccaggggtggtgatgagcagagggttcctaagcctttctacccccaactgatttctccccacgaatggcacagatataaatgagtgggaagctccagagtcgaacaaaatggtagcagagatggaatgaatgaggaacgtaccaacgatgacgtctggagttgtcagcacatcctcggcagtcacgtggttcacacgaccccgaatgacatccttaccaccgttgttggggcggggaggcgcttggccttgctggcgcctcggctttgggcatttatccgcaaagtgcccggactcgaagcagttgaagcacagacgctgctgaccttgagcgtctctgcggccttgaccaggctgcacaacaggcgcaggaggacggggcgcacgggtcccttgctgactctgctgttgctgtggctgtgggacgcgcaccacaaattgaggtcggggcgcggagcgtggttgctgctgctgctgctgctgcgaggaggatccccctggatagggaatggtgtagcggaccctttagttagccccctgttgattgcggaaatttgccaagcgacgcttgtgcgactccagttccttgtgcttggcttccaagcggatgctcttgtccaccaaacgctggaaatccggataatccccggagactagacgcacggacagctcagggtccattcctgccaagaacttctcctacttttcctcatcttcacgaacatcctccggggcgtaccgggccaggttgttaaactcatgcaaatactccatcacagagcggttgccttgcttcaactctcggaattcccttttcttaagggccatgactccggccggcacatgggtcctccggaaagcggcggtgaagcgggcccaagtaataggctgtccttctggctgcgtagcctggaagtggtcccaccatagagatgcgggcccctgcagttgatgggcggcgaagatgactttctcctcatcattgcactgcacggtatccaactttttccccacagcatgcaaccaatccaaagcatccacggggttattggagctagagaagataggcgggcggatgcggaggaactctgcgagtttagaatgttgcgggggtggtggtagaggtggagcattatgctgtggcggattttggatgtgatggaggaaagcagcacttctcctggttgtcaccatctgaaaatcccacacagaaccagcaaacagagagagctgactattaaaactaaccacccacgactaccataattcttgaatttatttctgctattaaattggttcattaaggttcaagttggttaagcaaataaaataaagacaggctccgacacagttataccacacaccggtataaccatgccccacatgactcaagcagaaaaacaaacgagaaaaacacacgcgcaagcctactaactgctcgtctacttctgcgacgggccagggcggaaggtgagcagcagcgcatcctccatgctaccaacgccagaggctccctcctcctgaggaaccacgggcgcgggctcggcacgaggggtctcgacgaaacaggtccatgccaaggactgacgaacaagctcgggcctggaggtactcttgcgggcggtgatcttcaggctgcggcagacgcggcggcgcttggggcgacagacctctccctgggcgatcttgagctgacacagctgcgcctctactgcgtccaagtccttctttagctgcagattctcctgacgcagctccaggatcttcatgttgttctcgaccaacccacggcgcaccatatgatggaagttgatacgggtcgcgttgtacgcctgcaccatgcgcgccaggtgcatgatggtagcgtcatcctccgagctagcatccctgaaggtggcgtagtcgcgggctcctccgcgacgagggtggtagcggtagggcgagtgctgcaactcgtccgggtagcgctggtgaagagtgccgatggcgaggagtgcagcgttctggcaagcggcggagaaagaatctccacccgcggtgactgccaacgaagtcctctcgggagagccagtgaggaccactacagtgacctcccaggcagcgtggggctctacatcatcaccctcctgctccaggagctgcttgccctggtagtccactccatgcggataccccaggacaacgcacatgccccgcagctccaaaacaaagccagtaaggtccaggccacgacggttgatgctgccggccatctacaagcaaggacaaaagagaaaaagaaataaacattttagagaccagcttttgacaataaatgaagcagcaggacagagagagactaaaggattttcacaaataagaaaggatttttatttcgaaaatattgctaaggcttgggatctaaagctcgttctagggtcaagggggctctgataccaacttgtcacgaccggaaataacccaacgggcgttccttacgtgcgtgtattattccttgtcccaggaggcaaggtacaccaaaagttgatacatttcagagtttatcaagcggaagcgtaaataattaatttattacatgggcggcgaaagcccagcacacacaaagacaaacgggaaacagcggaagactagggcgacgaccacaggcgcttgacggcaggcacgagctagacaccaaagccttcatcttccaggaactccacttctgggattgggaaaaattgagcaagactgagtacaaccaccgtactcaacaagacacacccacaattacagaataaatgcaagggagtacaagggagccataatatagggggttagggtttgcagtaaacagcattaaaagacacttagttgctcaaagctattttgtaaacacgattctagagctatacaatattattaatcaaggccgtgaacccacacgaacctgctttaacccaaggcctacgacgattcagaccgaactggcaacccgaccctgggtcccagctcgtcccaagccaacccaggccaaccattccacattttagttgttaagcaggttttaagaattaaaacactaacttgggtacattgctaggcttgcccataatcgagggcgcggctattcgaataggttatactctgatcagaggtgtacatctttacccacaagacacatctttctcacgtgtaaccacgtgccacataccacaactgtatatggacggaagacgtgacatagtttccaacccatcctagccatagacaagagtactgacccaaccccacctacggccggaacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagactggtccttatatggccgaggtgctactatcaaaaccatgcaccccgagcctagcctaaaaccattttgaggattttgaatagagggggaggtgtgaatccaattccacaataatccatccattccatagtgtccaggtgatgagaatattcccaaagtctagaattgtaaaaccacctaatgttgcctaattaactagcgaaacatctacctaaattcatactagtggtaccatgagtagagtgtccactagttggggttttgtttaatctagggtgaacaaggtaataatatcaataacaataataataaggtcataacaaaggtaaataggcatagctaaataaaacagtgataacgcgggaatttaagtaaagcgataatgcaataatttaaatcaaaataattttataaaatgggatccaatatgttcaaggatgatgtgacttgccttgctcgctttcccaaacatcggcttcaacctccacgaagagcggatcttccgaagctgcagcgtctacacgaccaacggaaaagaaaaggcttttactctaataaactccatataataagcaggaacaaagcacaaaaatgggttcttgacttcttaaggaaaaattagagacttgaacggtccaattccgagttcaaatggccaagttatggccatttgaagtttatatgctctttaaatgaatttttgcgaatttcttcatttaaattttaatttaaaaagggtttattgcgtcagccgagcgggaggggtgcgcggaccgggtccacgggagtggggcccacgcggcagcctcacggtccacggtggaccgggtgcacccgggctcacaccggccggcgccgtgggccccacacgtcagccgcacccgagggcgcgggcggctgacggccgggccccacgcggcagccactcggcgcgcccgagggcggccacgccggcgcggtcggcgggaggcggcgcggtggagcagcggccgagagaggggagggaagggggaaaggaggcgacggtccacggctcaccccggggcgacggcggcgacggaggaggcggccggagcggagggaggcggtggcgcggctcgggtcgacggggacggcggcgctccggcggtcagcgaccgaaacggaggggtggacgaggtcggcgaggatgcggcgaagccgaaggaggcggcgccgaggtgggaggcggtccggggcgacgacggcggcggaccggagctcggctgcgacggcggagagagagagcgatggcgcgagctcgattccggcgaggagaaggcgcggcaaagggtggaaacgggcgaaggaagtgcggggagggtttaaatagggttggaagggggagagagcggccggaggggaaggaaaccggcgcgggaggtcggccgccatcaatggcaccgacgagatttgcgggggcaaatccgcccgtttgaacgcgagagagagagggaaaaatgggggaaaagggagagggaatcacggagagtatttccccccactttattgcacgcggggacgacgggaggcggcgggattcgcggcggcggcggcgctagggcgcgggcgaggcggcgggagcggcgggaggtcgtggatgacgggtgggccctacccgtcagcgagggtggcgggcgggcccgcccgtcagcggcgcgcgcgcggggaaaggccgagtgggccgcggggagaggagagagagaggggggaggagagatgggccgggccggcccaagggagggaagggggacttttagggtttttctttttataaaactttctcaactttgtttatttcttaataattattatttgtgctttgaaaattccactaaaatttatttacacattttaggcttttaggaaatatacaaaaatcctctaagccttatttgacttttaactttgcacattttaattgttggaggctttcacacggattttaattattctaggcataatttaaaggatatattttagagtcgttttgggatgtgacaaggttgagttggatcttggtggtcactcaaattctagaaaatgacctagaggtgttggggttgaaagctgtagatttgctctgagatttttgcacaagtgaggcaaggggttaatcgagacccaactctttggagcacctcaacggagagtaggattgcaagataagaatttcgggacaaatcgtctttgtctcttctgtgatgtttctgtgcatgtgttagagcacctcaactgctctgtttacctatgatccatctcgtgaaatttagctttgtccctgttagaatttcctagtttttttctgttgcccggaagttccgatacaagaacaccggaagttatggactgtctgagcagaccgaaagttccggtgttctacaccaggaggtaccgggcctgttgaattttatcgctgtgatttgtttgtgattttcaggaaagcctattcaccccccccctctaggctacatctctgcgcgttcaggctacctcgaccatggtccctttgccccttcactttagctacctcgaccagtggcggatctagaaaaatgattcattggtgtcatagcatgctaattatatttagactatagtgttataatttatggataagcagtttaatcataggttttaccgaaagtcatcgatatcgcctgacaccgatgctaacactgtagatccgaccctgacctcgataatggcacaaatgtctattatctgtgttgagcactctgacctatttcttctttagtttaagcgtttatgctattcacacttggattgcaggggaaatgaagtatatggtagttagagatatattaagatgggattgatttgtatggttgtttttcatatttctaattcctccttctctctacccatgtactccctccgtctctaaatatttgacgctgttgactttttttaaacatgtttgatcgttcgtcttattaaaaactttcgtgaaatatgtaaaactatatgtatacataaaagtatatttaacaatgaatcaaatgataggaaaagaattaatgattacttaagttttttgaataagacaaatagtcaaacatgtttaaaaagtcaacggtgtcaaatatttagagatggagggagtatcttatatctatacatatctctcaaagctcgttacaatcaactagtccacaatatattctctctgtattatttgactttgacttctggacattttggggaattctcaaaagatgggtttggagatgagttttacattttcttcaatgaattgaagtataaatttgaggtaaaatggggaagttttgggagttgctcgaaggaacttttgtatggggattttaaattttggtatgaagcttgtgttctgatttttttttaaccgagggggaactttgttccagcttttatatttggaagaagagaaatgacccagtttataaggaaaatcaggtaaaaaaccaaacaactgcacggttaattacatgaaaccggctcaaacccaccgctacacaactaacaatgacggtggagcccaaacgcaaaacatcgctgctatgctaaacataaatgcgacacaacagctccgacatcgcagaagaggtgttatcattccctagctagccgcccaagcgacccaatagcgccgacttcacaatcgcagcgacactgaagccacgaaagtcgccaaagcgaaaaacagctcgaacatccaacaatggacatcagccaagccactgaggagccacttcctttgcacggccagcatcacaactccttaaaatagactgcaagttctgaatttttgggtctttgatgttttgtgtcaatagaactatagaaggggatagttgttgggtcttatgtcagcagatggaattttggatgctaaaataggttttactaaaatatcttatccttccgctgcgaaggatatgcgagaggtttttcctaaaaaaaaaaagatatgtgagaggaaactcctaggcccaacagattgcagtttgtcacgagaaagggcgtccaggaaaggaaaaggccatctagttcggtgtggagacaccaaccgttttcctgtttgtcctaacttctttggcttttttttattatgtttcctaagcaccaggattttgtaataaaagtacaaggaaaatcgtccactccttgtcattttggtaacgctcccgctcatggatccctccattcacgtgaaacaattatcgcaatgctacatctacacttaagttgcaccacgaaccttccagctacaaattgggtacctaggtggtattcggcattaggagaaagaaaaaatgcagcacataattttcctcgaaatgagtctgcattgtatgattaaaaataatgtttgcatttcagcacatgctcatttgcccgattatcgtattattctcgtagagctgtatgcttttaatcttccttgtcatatgtattagctcaaatacatatcgcgagacattttaggatatcataagttaattttttttagagtttgatcaaatttatagaaaaaatgtgacaacatctataacatcaaattaattttattcaaattcactggtgcaaattaagtttattaaattcactagtgtttaaatatttttaaggactttctataggacagccagctgaaatttttggtcatattagctgagttttagacggggatccttcccaatctgacacatatcaagatctccaatgacagatataccaaagaagattatcatagtcctccatgataacagtagcacaaacattataaacgatatccatcaattgtagaaataattatgtttatgtttccatcttagagatagcaaaagtagttgtgaccataagcttgtgagttgtgaccagacaaaacaactaatgcaaccgatccgactaagaacaacgataattgggtcatagagttgctaggtaaatttgctttgagaaaataattttatctaattatgatattcatagtttaaaacatagtgctaacaaatagtaatgattagaaatatatattggaaaccaaatcgatatcaaagacactaggctgtgttcggcaccccttttcccaacccctatctcttatttttcacgcgcacactttagaaactgttaaacggtgtgttttttgcaaaaagtttctatataaaagttgcttaaaaatgaaactaatccatttttgataaaaaaatagctaatacttaattaattatatactaattaaccgctccattttccgtgtatattgtttcggttgggaacatggaatggcagacacagccttagagaataaaacatgctataaatatttttaaaattgttgatggtttaattttaaccgaagggagaacattcaacgattctgcagctgctccgtgctcacgagtcttcctgtaccaaaacgacgcattgatttatgttacggtgtagtaccacgtgaaactccgggtacgcctagccccccatgaatgcccaaccgacaaacaacaaaaaagcgttactgcgcccacaccaacctcgcttgctggccgttggattggattggatgacgcccacccggcccaccaccaccacctcccccctagagatggcaacggtgaattcaccgttgggggtcatgcccgcgtccccgtcaccgcggtgaaaatatttcactgtccccgcccccgtcaaccacgacgaggctataatttctccaaccccgatcaccacgcggtgaatttttccccgtggtgaacccgtccccagttaaacaatatattcacagtcacagattgtagtatgctcaccttgcatcgtcactgttgtagctttaggagggaggtggccgaaggttgaagccatggtcggcagatggcggcggcgacgacagatggcggcggcgactcccgacggcacggcgatgacggctcccgttgaagatggctgcaggctggcggtgcatcgacggagcctgccggccgctcctggtaaagacggcttcaggcgccgcgcggcccggcgccgcgtcgacgaaggcggccggtgacgggcagcttcagtctcctggcgagaaggcagcgagtggcggtgcgcgtggtggctggcgaacggcgccggaggtggctggcgaacggcggcgcggctcccggtggactggcgaccggcggcgcgcatgactcggtcgggtggctagtgtggatctagatctggatgggtggaaaatttggagattgacctgttgacttagggttagattatatatgtctgttaaatgggcttcaatattatgggccaatacatctaaaaagtctagaattcctcccttgtacagtacagtcgggtcaccgtgggg

SEQ ID NO: 8856 - DNA, 10248 bp, Oryza sativa
ataggtgaattcactacggggaaacggtgaacagccccattgccatctctactccccctcaaaaggagcacgaatctgcacggcccacacagccagccgctgccgcctgtcgccgccaccaccacaccaccgcctcgttgctgccgtcaccaacccaccaccagaaaaaaaaaccatcgcgcctcgtcttttcctccatttcgtgcgtgagcgtgaccttggttgccgcgtacaccaccaccgcctcgcacttttccgccatttgtccgactccacccgcggcttatccctccttttttttttctttttcccttgctctcctccgctgtttgcttccccgcctcgtcttctcggttttttccgtgcggtcgaagcatcggttccttataccatacctttgcccccgttcttgattcggttcttgccaacagctttgtaacttctcgggcgcctcattggagtttctttgtgagattcgcaagggggagaggaggagtcctttggtcaagcccctgtttctccatttctggttctctgtccgtgcagatttgctgaggaagtagttcttgggttcatcagggagcgagaggtgcgggatttgaaggggaagccgcggggcggccgggcctgggcgccggggcccatggggaagccggcggcagccaagaagccgccggcgagcgcggcggtcgacggcgacgaggaggtgttcctggagctgtcgcgggagctcaaggaggagggcggcaggctgttcaaccggagggactacgagggcgccgccttcaagtacgacaaggcggtccagctcctccccagcggcggccatgccgacgcggcggcacacctccggacctgcgtcgcgcagtgctacatgcggatggcccccgccgagcaccaccgcgccatccacgagtgcaacctcgcgctggaggcggcgcccaggtacagcagggcgctgctgcggcgggccgcctgcttccaggcgctggaccggccggacctggcttgggaggacgtccggaccgtgcttgcctgggagccggctaaccgcgccgcgcgggagatctccgacaaggtcagggcggcattggaggagaagggcgttcttgtcttggagaaggaacccgtgccgccgccgccggagcacaaggctgttagtgcgaagggacaggggaagttgaagaaatctcataaacagtgtgattctgctattgaggggcaggagctgattcatgtcgaagattatgagcaaagtgagaaaacagagctgaagattaatggtcaggagaatggagaaaatcgtgccgggaaggagcaatttgattgtaatgtacctgtcaagcaagaaattcgaaccgaccagccggaagcaaatggagtaggaaaacatcaatatcatatggacgataaggaaaacaagggtttagataaggaaggaaagaatggcaaaccagggaagcacagtgcaggaaagaaaattaggcgtgctgacgccaagaagcaaaagcattccgctatggagccagtgcatcatgctgaggaaaatcgtcatgagcgttacacggagaccagtgtccatgtcaaggaagcaatgaaggatctgaagctggtctttggggaggacattagatgtgctcaaatgccagctaactgcaatctgtcacaattgagagacatagttcaaaacaagtttccatcgttgaaagcgttgcttattaaatataaggacaaggaaggtgacttggtgacgatcacttcatcggatgagcttagatgggcctacagcttggcagatctggaagggccaattcgactgtacattgtagcggttgatcctgcacaagagctaggtgtggatgtggtcaggagacgctcttcatttgcctcattagagaaagcttattatagcatgtcggagaatgggagcagtaggcatgatgatgatcacaactgctctattgatgactggatgatacaatttgctcggctattcaagaaccatcttggttttgattccgactcgtatttggatctccacgaccttggcatgagattgtactatgaagctatggaagacactgttgcaagtgaagaagcacaggaaatatttcaagttgcagagctaaaattccaggaaatggcagcattggctctgttcaactggggcaatgttcacatggcttctgcgagaaaaaggcctcccttgtcagacgatgcttcaatggaatgtatacttgagcaggttaaggttgcttatgaatgggcttgtgcggaatatgccaaagcgggcgcgaagtatggagaagctgtgaaaacaaaaccagatttttttgaaggtcttattgcacttgggcagcagcagtttgagcaggccaagctctgttggtattatgctcttgcatgtaagatagacatgggaactgaggttttgggattatttaaccatgcagaggataatatggaaaagggaatggggatgtgggagggaatggaaaatacacgcttgagggggctctcaaaaccaagtaaggagaagatcatatttgagaagatgggcatagatgggtacatgaaggatatgtcttccgatgaagcatttgaacaggcttctagtatccgatcgcatgtaaatattttgtggggcaccattctttatgaacgttctgtagtggaatttatcttgggacttcctagttgggaggagtctctaacggttgctatagaaaaatttaagactggaggtgcttctcccgcagacatcaatgtgatggtaaaaaaccattctgctaatgaaactactcaagaaggttagaataactttcctgcagcattttgtttgcaatttctcagtttgctttatattgtttatttgcccaatttttttgttctattttgcaacttcgaaaagcaagatgcaatttttttaacacttagagccctctattaggacaaggtcgttctcctatatagataaagaaatatggtatgccgtatgcttaataaatgttgatgtaccagtatttagctgctaactagtagccgctgtgataagcttcagatttcgtgtgaactgtgtatagaacattgtgttttttgtgtgtgccgatcctaagaacatagttttgataccaagttcttacaagatttacctcttttatatttaggactgagttttaaggttgaagaaatagttcaagcatggaatgaaatgtatgatgcaaagaagtggagaaatggagtgccatctttccgacttgagccaatattccgacgtagagctccaaagttgcatcatatgctggagcatatacactatgcttgaccctctaatatatataagaggctctggtttgtcatcatggagaagttatttcatgattttatcaggtaatgtcttgccttgcaaatattatcggcattgacaggctgcaaacagagcttcaccaaggccaattataccagaaaatttatgatgatgtccctctttttagataattggtcctggtttgaagtaatttagtatcttagactacttttcatgtcaaggtgaaaactaaaaatattagcttagaacaagtaagcgggaaaaaatgtctatccttatgtacctggaaattgacttgttatcagttggtgtccaggatttttacttcaacctgtacttttatccttgtgaattggttaaaacttactttgatagaataatagaaaataaatgtctaataatttgttaaatgaggaatgcaagtgccaaagtatgatatattaaagcactcatgttctacaactactacatcttgtgtgtgtgtgtgtctcccttctctcagaaagcacagtccgtttacacaacattacagcttcacctaatacaccatctgtgaaatacaaatgcagggcactagggtatcaagggatcttatactcagttgtttttatctgttactcctacagctgttgaactaaaggagctaacggtagtcagccacccctcaggtgttgattgaatgtactgaaactagattgttgtcatattttgtcgaatttcaatcatcagactattagtgacaaagtaaatccttagctgtgaagtcatggatatttgcatccagtaacatgacctaatggaggaatactttagaaaaggtccaacatatgcattaaaattccaacataacttgcatacagtgacaactaggaaaaactcctccagattacacctctaccaggtgctctttttcttcatatcaggagaaaaaaaacatgaacaaagaagaatttggaatattatttgcactgttatataatatattttctgcatgatatggcattataaatgattttgttttttttcgaggaaacgattgcaattttttgaagatgtaaaaaaccaatttatacataactattttttaggtctctaatttttctttttattaggaatacaaatttaacctgattggtttgaaggaccactagcttatattgtacaatattgcactcaatgtaatctcatccgctttaattgcttttgctcctgatctacactgtgagatagcattaacttgtctaatttctatgcagttcttctacatagtaatataatttgtattgaaatacagttgtaatttctggagaatgattatgcttgtcactaaacatttaattgaatattttgcggaactgtaacattaggaaatatagccctctgtcattaggagaaatacagtgaccaacaaatgatacaggcagtagtcatttttgtttccttactgctattgtttactgtctctgcttacatatctccatgtgcaataccagtattttatccccttggatcctattttatttttctgaccttctctctaatggttgcaggtttgtttattctgggagctgtactgcacttactcgtcccgccaaaagaaaaaaatataagaaaaagaggaaaagaaaaggaaatattctcttcaacttcaagctacagattggttgagagtagtgtgtaggggtttcctcaactgaaaagacaaaaagaaagtgctaacaatgtggcttgcgtttgctgttatatttggtgcttcacgcaaccttctgcttgatgctatatttcctttcaagagatactgtggatattttgatgttgcacttcctcatatttcagtcatggaagtgcttcaagttgttaggtcatcataggaaatttctgaggatacactaattgtatttcacttgtgtagaagatcaccccagctgtgttttacacttttactccaggtcacacatgaagaaagctgaatacagttcgtgtaacatgtagctgaagtagcaggcacagaatgcttgtagtctaattgtgtgaaacagatgcttttattgaagaagttatcagatactagtgattgttggtcattcagtttgttgcctactcgggatcggctttcatgaaatgaggtttgaagaatacttcgttcataaaacctcgaggggtttttggatttctcatttttcacaattgtttttcttctcagggaacggatttctcattgttcgcaattctttttctccgtaggaacctaatgggtgtcaggatattttgtaaaaaaactcatcatttaatatttgggttaattagattcatgccattataaatttgctagttttataaaatgccattactatttacctatttggatctatgccattacaatctcatacctattcaaaataggttaattggattcatgctattggaaattttatggttttgaaatataccattattatttacttatttggagtcacgccattgtaatttggagtagaaatttacgaaatgccactacataccccttccatgcacttaaatatatttttggaccaaattgcccatcgtcttcttcctccatcccacttctctctctgttgggttacacgtaggctacgatagcataaatcaaaatttttctaccgcgtaaaccaggaaccatgcaagtattagatcatagatcgttatcactcgacgctaggggtgggcaaaataagaccgaaccgaagaaccgaaccgaaaagaccgagaccgagaccaaaaagaccgagaccgagaaattcgggtagtaattcggtctcagcatgtcaaagaccaaaatttgttcaggtaattcggttattgggctcggttaaccgaattaaccgagaaaaccgaattgtggcccaatagatccaggaggcccaataagcctaatacaccactgaaccctagaggccaccctcatccatccaggctgcatccccatcccatccctatcgcgccgcactaccaccgctgcctccatcgcgtcgcgccgccgcctccacatcgccggcaccgtctccgccctccacctccactccacctcgccggtcgcaccgggctgccggccgctggatccatcgcgccgcgccaccacctccgccctccgccctccatatcgccggcgccgtctccgcctccacgcctcctcgccggtcacgcgggccgccggccgccgggtccatcgtgccgcgctgccacctccgccctccgcctccacgccgtctcgccggtagcgtgggccgccggccgccagatccatcgggccgcaccgccacctccgcccttcgcctccacatcgccggcgtcgtctccgccctctgcctccacgctgcctcgccggtcgcgcgggccaccggccaccagatccattgcaccgtgccgccacctccgccctccgcctccacatctcaccggcgtcgtctccgcactccgcctcggctcctccaaattcggtctgaccgagaccgagacaaaaaaaccgagaccgaattcatcggtcctgatttttttgggacgaaatttggtcctgacttttcaaaaaccgaagactgagaccgaaattttcgggtagaccgaacgcccacccctactcaacgcgctgtgcagcggaagtaagtgctaagtagccgaaggaacgtcggggacataggacgcatcggtatagaggaagtagtcgatcgcagcaactcgacattctcctcctcgtgtgttctcctcaccgtgctctcacaccgatcagtaccgcaaaccagcggcacctctaccagtatccacacgtacagggatgaaacgccacgcgcagacatgctagcgtctgcgtgcggcaagggttttgctcgggggaggggagtggcagttagggtttctcacgtgatgcaataccaccgccggtcacacccctcacgaatatataggagatagatagtcgggtcatcgctggatccaatgctaggtctagcaccaaatacagagatagataggaggaaggggaacgaagagagaaggggatggaggaagatggggtcaatttggtccgaaaacaaacaaatttcagtgcatggaaggagtaagcagtggcacatctcacatattagttagtaaagggatgaaaacggagcggatagattccaacccctccggacaaaaacggatacggatacctttcggatcggataattctcggatagtttggatacggatatgaatacgtatactttctcctggatacgaatatgcatatggtatcggggtttccgtcaaatacagataataattcggatatccgatgaacaatgctattaggatatccgtataagccatgagacatactacatttctttctaactctataaccttcaatatacctttatagattttaatagtagtttatctcataacactagtccatactattaatattatttaaaattttaaaaatatttataaattatacttcattttatataaaatgagctaattatatatgttgatatttgtttctattagaagttgaattggttttcgtgttccgagaaaaaattgtttctgtattcgtgtccgatcatattcgattcttattcgtatgtgagataatccgtatttgtttccgtattcgagctatccgtattcgttttcgtatccggtaaaaaaatatgaaaacaaatatggtatgagtattatttgtccgtatccgctccgtttttattcctaaattgtaatggcatgaatctaaatagaaaaatagtagtggcatatttcaaaactgtaaaaaatataatggcatagatccaattaaccctttgttaaatggttggcatgaataaagtggtagatgtccgtgtaaaattccattatttaaaggaaagatgtctgaagttctgctctatttccttaacacttgaaactggacagtatttcaacaccaatccacagtaacagtatttggctgtgtcttataataaagattccattgtctaaaaaatccagagtgtcagccggaatcgtagcttcttgttacgtaggcaatttagattcaacacttccaagaatagtctttcatctgtaggctgtagccttttttcttctcttgtattttgatattttgtttcttttgctcccttcatcgaaaatagaaggtgttctcgtattgttctgttcttccaaaaaagaacctagtgcaaaaatgaacgagtaagattgtgattgatgtttctcaaaaaaaaaaaaagattctgagttttttttccagaataacatcaatcaatagagaggacaagcatacattgtaattctgaagcacaagtaaagtttgaaaaccagtttatctgtgtacaaaaggatacctggtgtaaaggctatacgatatgcgaacataagctcacttatttcttcgtcagagcaattctgtgaaaagaaatcctcctcgtcgccatccacccacaaatgtaagtttcttcgaagtctaagcatatctcggcacagtacgtttagttctttgctgcaattatagagttccatgtccttgagcgaagctgggagaccccctaccggcagggaagtaatatgtccacagttgccaacatgtagtctctgcagggatgcaagggatccaagttctgcaggcagtgaccggagttgctcaaggttttccagatcaagaaatctcaagcaggtgagaaatgacagtcctttgacatggttgtctgtcaaaaactccacatgaccatctggatcgtgacgatcctcttcaatggataatatcttgagagaagttaactggctgcatatgggcacacaaaggacatcaatgttatcaacgttgagcttttcaagtggtagtgagaaattcttctcctcgatattaacttcagctgctgctgatatccatctcgttatgaacccaggagacgcttcaactttcaagatctcaagagaaacaagggatttcaaaccttcccatgatgtcagtgccgggcagtctttgatgcatagtttctgcaatgatgtgcatgatttcagttccagagatgctagatttgtgttattctctatgctcagtgttttcagggtgtggagtgatgcgctgagcgaaggcagcaatgcacagtttcgaattttcaaatccctcagtgctgagcatgacggcaaaccttcaattgactgtaacaaacggcaatctataacacacaacttttctagcgcggtacaagaactcaggtcgagacatgccaacttcgggcatccagacacatctaaatccgcgatggaagagacatctgagaactgcagagtgctgtcttggataccagtcatgcagagtttatccaaagatgatggagatatatgagatgctcctcctgaaagcgctctagatagcagagtagggcaattttctataacaattttcttaagagatacaaatcttcctaggcctttcttgctcgtaaagtgcataattgaatttgcatcagatggagctgttgtgaaagagatttgcaaactttccagactcgtgaagcatctgggaggaatgtgccatgagccttctgacattgtgttctgttcatctgtaaacaaccctacaggtaaggatgttaccccttggcaattagttaacttgaaactcttaagtaaatgaaggttcacgaggagttgtgatagttgtatcaatgtaatgttgcatccactcaactcaagttcctcaactgacggaggcagaaatagctcaaagttggtagaaaatatttctgggcacttgatcactctaaactttttcaatgatgtcaactgttcgaagccttcccagaattgacgttggaatatcactgattgatagtcccggatttcaagttcccgcagatccttgagtttctctaatgtgaacaatctttcct

SEQ ID NO: 8857 - DNA, 5652 bp, Oryza sativa
tagcttagccagagtagttttcccaatacctccatcaccgatgatggcaaggatagagagtttcttcctagcacattcctcacttgttaacttgcttattatcaagtcacgctgttggtccctcccatgaactttgggttcactttggcatggtgatgtctcccgatgatctgttcttgttctctggtatttgtgcgcgtaaaggtaatccagactttcaagctcaagagcttcactcacctgtttggctatcctgtagcatttttcagtgtatttacttatctcattcgagatgcacttgttaagagtctccagatagggtactggactactgctactagcaatgtacgtagtaacctgaagagcagatgcagatgaatctgtgttgctaagagaactttctgtggtgtctttgtcatcttttgctgcatcattgttaaagaactcaacatccctttgaggcatggagagaagcaaatttccatttgcattgtcatgcaatagctgaaaaaaaggggcaaaagtggatttaaacaactatcaaaagttgctatgcatcataatttagtataactctgtacccacaagaaacgataattctgtaaagcatgtcactaaaagaagttgtatttatattttggtttgacacgtcacagttgaagagtccactacaaagtagtgtcaagtatttcacatataatagaaatttgtctgcattgaatacatacattattatatcataatgtatgaaacagagcatttgcacaagacagcactttgcaaatccagtcgttgaagtaaacggatagcgagagaacaaaatatggataaataccaattcctattactggtaaaaagatacagattactggcttgaactgttgtaattctgtatcttatttgttttaataatagttttaactgcaagggcctcccctgcagtatcattctcaacaaaattataagttccccaattagttaatcagtgttttagctgtgtgtatctccaggcacacaggccaggatattagttctagtatctaaaaagtaaatcagtgttttacactgtcattaaaatttgtttcaaatttacttgagtaaattgtgcctcaagtatggcaggtggcttacggtttagtgcaagagcttgaggactaaccaatacttcctccgtttcaaaatgtaagtcattctagcatttcccacgttcatattaatattaatgaatctagattatatctatctagattcattaatatcaatatgaacgtgggaaatgctagagtgacttacattgtgaaacggagggagtacatcacaaaagcaatttgcaaatgggtatttagtacaagaatctaaacactgagcaatctagtgaaccaatttggtgagttagtgcattcttaggacagttttgctaattttgtgtgaacatgtgttttccaaccagccattttctcatttggttccaggcctgtgagctcaaatctttttgccttgttccattttgattgcaagcaggtgtgctgttggctggaagattgattgtggtttacttcatacatatgcatgttgaaaaatctgactattttttgatacaaaatatcgaggtaaatataggaagggcctttttaaggatgaggaggctttatcgaagattatgtgccattatgattgctgttatctactgcaaaatgaagatgacaaatcagatatcatcatggcatgtagcaaaattgagatggtcgtcatcaaaactctacacatggttggagatttagtagtaggatttgtgtttgattttcatattctcatatagtcagtagttatgtttagcaactcatgttgcaaagctgtaataaactagggtcagatgcatcttttgatgcagatgctggattaatttcaattatcgcaaaaagaggcatgtacttatgatcattcatcatggattcatggcataggtttgtaatccaccgtaaccggcataacatttttcactagtcacatcaaaaccaaagtatggatactgcattctgattgggtgagaaatgaaagaaagcatatcgagcccacgaacatgccacagcctgcttcgtgcacgaaggtaccatgggcatgtttggtttgtattgcgaaagtaaatcttatcaaacttcactaaagccaatttttggcattcccgcaaaaattttggtaaggcgatgtttgacttgagcaattatcaaatttgttgctattttaacagttgaaagctctgaaattgccaaaatttagtgggattgtgatggttgaaatatgcagtaatttgccttcgatttgtagtacaagtacataggaggattggggaacaaaacaaccaggacctcaggtgaataaaaaaaaatccagaaaacaaaacctgcgctgaccttatcgtggtcgtcgcgctccacctcctcgcggatgcggtagtactcgagctcgccgaggaggtcacgggcgcgggcagcatcatgcgaggcctccctgaggcgccgctggagctccttgttccggatctccttcccctgcgtctccgcgagcaccgagtcgaggcgtcggtgggcttcgacgaggcgccccacctcgcctccgaagccgacggtggaagcccactgctgcagcgcagcagtacgatcgtcgttgactcctccggtgattggaagtggaacaaccgccgccttgtccatctgccagctacaactacagctagggatcaacagagaatgggtgtggcactgtggcgccgtcgaggcctcgagggcgaggtggcagtgcgtgccgacgccccggggcaaagctctgctggttgcaaacttacaatcctctcctccttttccctacgcacgtttttaaaccgtgtattttcttaaaaaaaatctgtagaaaaattactttaaacaattaaactaacctacttattaagtttctttaactaatatataattaatcctacactaattcatcgctatattttccgtatagaagctgaggaatactcaccgaagaacacagagcgcggctagtgactgaggagacgacagcgatgtacagaaaacacaaggccatagagagatactacgacaggagtactgtaggtctgtgaggcattgacaggtcaaacacacagccgagaggtagtcacgttaaattatgcgccaacttgcacatagctacatacgcgcgtgttgtcacgtttcttttcatgctagctacagctagtagtggctgctagctgttgctagcatagttgataagtgaaggtgaagactcgccaatccacccagcactaactaccatatcttcttggggaactctaatactgttggcaagcgcacaaatttcagtttgatcttcgtccatgtggaaatcgatatgtgggatccacgcagagaaactattagtctcgcccgcgtctacctctctcgtgcacaaccgaacctagaatattttattgggtcttgtgaaaaagatccaaatatcctctacatctcttgtgtttccactttaatttcttccatgcaagtcattttctcttctagctttccccctatcttgctttcgttgatttattctcattgtttaactttcttatttcaacttttcataccccatatacctttgtggtgggtctttggaaacctttcacaaatcccgtacaagcgaggtaatgatggcaaaacatgatggctcaacttgctaagttgtgagctagctataatttatactataccaatctctcgaggtgatatgagttcttattgtcccatgacgcgggaggcccatcggtccttacaaattgaagtaactagacaaaatagatgaaaacggggtattagaaagttataagataaattgatttgcagggaagtgtatgagattgaggtgtaggggggaaatagacaaaacactagtgagttgtagggggtatttagatatttccttttttttctttttgaatgtcaatttttcaatgacacactattcgactcccaaaatgtgttcggttttagtatgacattggagctccccttaaacggaggaacagacagaaataaaaaagaaaattccttatgtgcattttaatttagtagtattccttcaatacaaacttaagctttatagagcaattttaccatacaatattagatttattttaccatccaacatttggtatctacaggtaccatgttttgtacacagaattttggtacctcagatactaagtagcttgagataccaaatttataccggaaagtacctcaagtacaaaaatttcattatatatgtccttcatttttcatttttaatctcctcagggcatggcaaaactcaagggtgaaaaggacatgacatttcttatatttgatggaaccagctttcagttaatgagaaaggtaaatcaaatcggtaaaggctagttaatttggtcaagtagctagcattttttttttacaacaggcaacttccattacccagcttggaaaccaagcccaacagcacaaaaacataatcttaataaaacataaaagttgtctagctaccagctcgaaacttagagacaaaagggaaagtagctagcatcgatcttgatcaataggccagatatgatgtaacctataattcaaaattagcattattatatatacggaacgttttattttcactcatactcctgcgcagttcagttaactcactgctgcaccgatatatgtccatttcctctagcgaagacggcatgccttcctccggtagtgaggttatacgtggacaatgtaggatcttcaatgttttcaacaattgaaagtgacgaatctctgaggacaatataggatcttttatgccccattctttcttagtataaatttcatagacatgtaaggtaaaacaaatgaaatgttttatgccatcagtatgtcctttacggaaaatataaatacgatactccagaatacttcgaggtgaaacatatttatgattatgtgcactcgcggaacatttttgtgagggcataagaaatatcaacactgctcccgcattggctacctacgtgtagttgttctagaccattggtcctactacactgctcccgctgtcatcaatcgttacgcctccaccagtcagcctaacccattggcaccgaaacagagggaccttcaggggtccatagtctagttcccatatgttgtcgatgacaccgtaatacatgctagttgtactatcatatcttatggcattgatacgaacatcattgttttggttcgtgctctttttgtctttggctcttgtgtaaaatgtgtttccattgatttcatatccttggaatgtcgagaccgagcaagatggtcccctagccaagaaggctagttgtcggtcaatcatctcgttacccatgaggtgttgtcgcagccaagcggggaaagtatcaatatgatagcatgtaatccaggcatcggacttgccaatgttttctgagcgaacaatcgcctggtgctcctcgatgtaaggagcaaccaacgaagattgttgcaaaaccgtgaaatgtactttacggaataaatcgttgtctgtagtcataattgctctccttccaagagtgccctttccctatagtctcccctcatggcttga

SEQ ID NO: 8858 - DNA, 934 bp, Oryza sativa
tcggcgattcaactcccatcaagcaaaatacatttgaatgctcgccgccgaattttctgatcaaccctaagactaggatctttcaaatattctatcaaagggattctccagttttcttctaactcttgggcacaaatatccgaatttacaactaattcggcctctaaatcaattgtctcatgccccccagcttcatgtctgggatcggtaatgccggtcaaaccgccggtcatccgcagttagaccggttataatgcgtcggtcagaccgcccccaatatggaacttcgccaatttatcccaaagatttaaaatcaaacaccggcttttctaatataaaaaatactcctttcttcacattttagccagatgcttggtgtatcaaataactggacaaaaattccttctttctggatatatgaaaaattataacacccaactaatatgtctagatgaataccaattcaagtggcttttgaaacaataatcaaggtatcaaaacacttagccacttgaagtatgatcaataatgaatcaccaaagtcataagcctcacacacatgaattccaataaactacaaatgtaagtaatcggcttgagcatgtatgcaaaatattaacaatgccaatgatcctaaagaagacaactctagaacaaatcatcacattggccattgacattagccaaattactaataagcaaaactttcttggtgcaataattatgaaatctatatcttatatggtgatccataaaaacacacatgatttggcttttaataaatatcaaagactcactagccaaatcatacttcaaataatttatatgccaacttgacaattccaccacttagaactggcatttgcaacatgcatgtataatatcaatttaatgagcaaacacatgtgctagatagcaagcaatgttctaacat

SEQ ID NO: 8859 - DNA, 652 bp, Oryza sativa
caaatgtaccaattcacagtttgcaattcaaattacaattcacagtttcatacagactaaaacaagttccaattgcacaaatcacaactccaaaagtccatcacatagtgcatcacatattccacacatcaaacaatgccaaaagtccatcacatattccacacatcaaacaatgccaaaaatccatcacatagtcctcacatagtccatcacattttatatcacatagtgcatcacatatgtcatactaccaacaaatagattaacttcatacaaatcacttcttccgttggcgccaaatagcttgcgagcccggagtgtacctacatttaaaaatccaatgtttaaaacatttaaaaaacaaaatgagggaaatcaaataacatttgagaatggtaagctcattttacctctttttcgctgcccgagtggatcgcaagttgtattgggtgggttgcgtcctctgaggcgcgtcgggaagctgcgacatgtctatctcctcagcgtttggtgcgacatagtcctcatcctcctcctcgtcatcatcgtcgtcgctaggtggagccaacgccttcccctttcccctcccttgcggaatgcgtgacgacgacgagccaccaacttcttcatgctcttctatcctgatggagtg

SEQ ID NO: 8860 - DNA, 11535 bp, Oryza sativa
tttacctgtgcggcccaactacaacccgtcggacaagatcgataaaccagcaccagtctcatgaattctctttctctaccaaggcaaaagctaaaggtacaagttggtcctccgcatcagctgataatgcagtcatcaaggcaccaccgtatttcccagctaggaaggttgcatctatagctagtactggcctgcaatgcttaaaagcctcaatggaaggaccaaagcaccagaatgcacgcataaaaattttcttggtcactccatcaatgttgacaatcctatcaggatgagtatcgatgtggtagaccatactgggatttctctgcttaatggcttgtagcaaagtgggcaaacggacgtacacttcaccccattcaccgtaaatgagcttcatagcctcctctcgtgccctccaagccttgccatacttaaccctatactggaaaacttcaaatatatacaaagctaacgtagaagcagagagtgtaggttgtagttttatggcattgcataacctatttgctatgaacttggatgtcagctgccggtggctccctgaacctttggcagtagcacaactatgtgccttaccaacctgtgatatcctccacgttccactagacctcttagttgcatggaccttccatttgcaccgtgggttttcacatttaacagtgtacctcctatttgcggcagaattgacaactcggtatggacgatggtgcacgatggcgtactcctggagtcatagcttcaatgcgaccatggatgggaactctaaaccctttctgagaccatccatctggaatggttctggcaattgatctaggttgatgccgccatctagtattgcaccatgggcatgtgttaggtccctaaactcaggaatgtccggcttcctcccaaacaccttctcaaacgcacgacatttctctaatgctaacttgtcattgttagttagtggagggaatggacggtcatcatcagagtctttagcaaattcaacatcatattgctcaacacttgcctcctcgtcaacctcctctctattgacttctactgagacagaatcgtgaccacctgttaacaactaaatttgcaccaccactcaattcgacatcaaagtaatcatctggattcacatattggcctgctacttgcgtcgggtattcagggttgcctccgtacaacgaccaatgcacactctccgacaaatgttcacttagatcaagcccctcttgtactaactcccttttcatctttctcgctgcatccatatcatcactaccgcaatgtctctttgatggtcctgcctcccctaattcatttccaaacaaaggtctcttcttctctccttcctcctccaagtcttctcgtaccaactcagtcttacttgcacccctttcacgacgagaagaatatgtcacaaaattcttctcaacgtaatgataagaaggagatttgtttagatccaaattttctacggtacgtaccaactttgatgtaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtaggaaacaaaatggtcttcaatgacatatcctcaaactcaacatgtgcaccaacataaggttccaccactctaccaccgtagtaaacacgaacaagtctatccatctacaccaaaaaatcaaatgtaactttgcaacaaaaattaaatctttcttcctaaacgtagtccaaaccgacatattataaccaatgcataacttaaattgtcccaaagctactactccaaaaaaatatttaatccacctacaactatcaacaagtttactagtgcattacacatcaaaatattacaaatactccgtcaaacaacccaaccaaaatttctataatgcaaccaaaattttctccccttcatataattaatggttaaaagtttaacctataggctatagcatcaagtccatcaaattaaaattactttcatgcctcaaccataatttttcatccatccatccaactaaaccatccaaaaattaacattaccacatatatggttcaaaaattcatgacaccaatgagtacattgcaaacatgtagcactacaacaagccaatcccaagaacaaattctaaaaatcacaaatttgggcaaaaaaggggttctagggttaccctccgatctacaaattcaaccaataaaaacgaaaaaaatagggggatggaggagtctacctttctcttcgatttccacaaaaaattcccgcgaaaaacagcttcaaattgagtggattagagatggagaggtgagggggagagagagggagagaactgctgctgctgctcgggctgggagaggggcgaaactgagtgggagaggagaaagggagtggggctcgcgcggctttatgggtgaggcccacacaggacgagtgcgccagcctggctggcgccgtgatagaaggggcggcgccagtgtggctggcgccctcctttaccacgtcacaccatccacgtacgccctattgccacggtggcacgagcgcggcaccagcaacagtgttgctggcgccgccatgttgggggacggcgccagccattctggcgtcctaaaaaagaccatttccggtttaagtttttccaggggtccatttgtaaaataagttttcaaaaagaaccaaaatgtaaaaaaatcagtttaagttagtttcatttgtttccctatcttttaggagggaaaaaaaagctgaattaagagatgtttgcgtgtaatttcccctgaaacataagttgttcattcaacttaggtcgaaatttactcaatgtactaatgactagcctccatcaaagatcaatatcatcagtggaaagttctgcactacactagagtgaaaggcaagcaccgtgttcatatggggtctgttggcatatttcaactaaatcgaatttttgaatgctgcagtgttacaagaggctagaacgcaaaagtatccagtcctccaagtttgatgctacgccattattggtgactgacatgaatccatcgccactcagtttgaagaaaattgcaaagtagtttccaagatactgggggcttttatgacttttttggcattactacttattcatgtatgagtgtatgacggcattgcagttttggatttacactgcctaattagttgtattcgttatccttggattatttatctgacaacacaaatcacttcagttcctctcctgccaatgaggagtgtatatgtttttacaatgaaagtattgtggggcatcatcaaggtattgtaaatccagtaacagatgctatgctcaacaattgttttgaattgtaatttttgatgaagctaatgatcaaaagacgcttaaaattttctccatgatgctcaagagactgcagatggttgtttttgtacagaacttaaattttgcgataaccttttttccatcgacaatatttcaaatttaatttttgcaatcatatctctgaccaagtaggacaagctcttcaagatatttcaatctaaataacaataatgattttgctgctatgtctcttatagcttttgctgccatgccactagctccatgtcttttgctcttgatctccctctatcactgatcactccaactaatttgtatttgcttctcgatatttttagagatgtaagaatgccaagattgaaagggctgttgtctgcaaggtgctcgaaatcaccaactctagattatgaacgtgtgaaagtgattgagtggttctgaaaatttttccttgctttgctagaagcctagaagattgaaagtggtactgtttgcaaactgctcaaaatcactttatccttgctttgcttgtaactaaacttttgtattatcattttacagcagaaccatctgcgtgaactgcccaaccaatgtcatattgccatggacgtgctatttgtataattatgacatttataggtgagattatctcttcagatgtaaaaaattcatctctttgactcttttggtgttgttgcatctggatcttctggtacaatgacaaatttatttctgagcacgaatatttttgtttgttcagagttgttacatcggcatgaaagcgttatttttcctttatgcagttgtccagtgtcattcatgggaaagcttatatctgctcaagggtcctgattctaatatcatcagcggatttatcagggttgctggcctaacctagcaccttagggccatgacactctaatattgttgatgtaaacacctatttatcatacatcttatagttaatctaaatcgatgtttcaatttacctatatcggccatatcttttctagggtttcattggtattagttaaattgattcattgttctatattagccaaggtattcaccaccctgaaaattagtcaaaaacttgattgtctagatattatatttcttttcatacttagtgttacatcagttaagtttgatctactaagtcgtgcttagaatcataatctctagcctgcttcatgattgccagtaaggattttatcgaggattcagccgatgagttatctcaatgttgcatcgacttataaagattacatacaagttggatttagccgatctcaacaaaggtttcactatttacctaatcgtttggattttacgatattggtcctccaggcgatgtatgctttaacctccagatcatcatttgttctattatatcattattggtcgattggtttctactggattatattattgttatttatcatcaacagccgattgtctttatattattatttactcaggtatcagaatatacattggatatataagccgattgctcaaaccctatcgatatcggctggaaccattccatcggcttgtcagtcgattggctatttgatctgttgtttacatatcttgtcagttgcagaatcaaaatgactagcacacccgcatctcaacaatattttggacctgcactagagctaagcagatctcccaacttgttatgttcgtcaacttagttcgagccaacacaaatccggcaccatcggcgagcgcggatttttcgtcaacatggcgatacagtcagcaaaaacaaataaaaaccagtggggcccacttgtgagcgctgctttttctctctcccccttctttgcatctctcggcgttcctcccatgtcagcgtgcggctcggcctcctcctatgctggcaacgtcctcgcctctcctcggggtgttgttggtcgtcgtcaacacgggcggccaatgcttgacctggccaagttagagaggttgttgcggcatgggaaggccgtcacggagttgtgcactggcaaggacggcgcgccaatgcccttgtcttggatttgagaccaccgccgccgccgctttaggattattcttccgctgaccatgcaccgtcatcaccctaggcttttctggccgactacgttccgcctcaagcgtcacgggggactagtctccgctgtcgctgcctcctcctcctcctcctccctactcggttcaagggtagagacagagatcgaggtgaaaagaggtagaagagaagaggtgagaatatatgaagcactaacaagtagacccattatttttaaaatattttttgctacgttggaaatgctacgtcagccaacctacccaaaactgcccaaaatagtgctgcggagggggagggtaattcattcggttttaggagtttgaggtgtcgaatgtccggtattacagttcaggagggtaaatcatacaaccacaatagtttagaggggtaattcgtactttttcctttaaaaatgaaaaaaggaacctaggctaatccgtattccttcgaactccttgaatgcgagaaactcatatagtgccatatagcctttaatctcaccatgctatctctcaattaggacgaaacaaaattgtagaacatcttgtcatcagaaccataatgcttatacaccatgttatcattaatcacaaaaactcaattgggacctaaatgatagcaatgtagcaagatgaggcgaaaactgagtatggaaaggataggcccgtactctagaggacacaaagaattttctcctgaaagtatctatcgtccgagttgttcgcatgacacatgtcgtacttgtttcaaatgttaaattgcctaattttgtgttttgtgtgtctaatcaaatgtagttgaccatgaaaacatgggtattaactaaaagttgagaaccaccatatcatttgacgtggtaatgcgcttccaaaatgttgcctaaattcagtttattgtgtactctttataacatatcgtatctcttaattctcatttatttgttacttttttaaaaaaaattgtaaacatttgtcaccacacatatttaatacaaaaaattccattttgtccctacaattaataattcactcccactcaaccttgttgattatttctatagacgtccttaacactagcaagctaaatgatcataccgaaggtaaaattattatgtccaataaaaattaaattgttatggccaataaaaagtgttaaaagtaaatataatcagagctaatcttaataactactaacttttgttggccaccaaaatttttcgtttgtcaatccgttttgtacgtgcatttgtgtcgtcaatgtccgatttttccaatcggagacaaaaaaaacacttaccaaaattgtcccgggtaataatctaatctcataacaagataatcctgacaataatctaatctcatgaagcacctaccaaacttagactttgatagttccatacaacccataaggcagaaacaagagccaaatttcacccacataaaatcggtgaaggatccatgggagaactccaatccactccaataaaattagcgttgtgttgatgtgaaaacacgaggcctgagagatctgcttaactttagtgcaggtccaaaactcgccttcaggtgtgctagcatgccagttgatttgatcatgcaatcaacaagagcaaagacaaagaaaccgcggttaaatccataaacgatagcctatcggctaagtgctgatgacatatcattttatctttgagccgatgtcatatatgcatcgatcggcaatcattaaaaagtaagaaataactaaatctactagatcggctatagatattaacgatatataatccttatgtcgatatatacttaaatcaagtgattaggatagatcggttgccatgccgagacagtataaatcacttagatcgaaatatatattaacaacgagactatatatgttcatagcatagccgatcagatggatctagcatgtatcggctaatactccgatactactctatgtaaagatattaaagcaagtaaaatataccaaacaaagagcctaatatacttaaatgccaccagatcttaatataaagggtagatttaacatgtcaatgaagcatacgagataaatatggttaaatcaagtaagatcggctaaaaccccgatactaccctaatcggcaaccaagaagcaggctagagattgagattctaatcacgactcataagatcaaactcaactgatgcagctataagtatgaaaaaaaggacaatatctagacaatcaagatgtgtttcatagagtggtggatatcatatataatctaagccaacgttgctatctaacctaatcgactgccttctactgacagatgttagccgattataggttagatgtcgatattgtcagagattatataagatatatgataactcgacgaattacataaacaatattagagtatcataacgatggaagcactaatctcgataacgtaagccgccataacaagttttacctcttgttgaagatcgaaaccgatgcagctcaacccgaaagcaagaactcgtcgaaacaaaacaaaagttaaaagagtggcgatgcgccgagattgtattgaacgtgtgttttttgattacacagggctcgaggtctatttatacccgagaattacaaaacttgtccatatcggacacgactcttatctctaacaaactgtaagatatcataagtctttgcggcagacttttgcccaaatatatctctaaggaaatcacataaaatatcctaattaatagatacaattgccttctcaggactctatccatgtgtggcaatcatcacgaagcacattaactcaacccgatgatgtataccgagtcgtattgtcggaatcggctatatcggcttacccagtctgactcggactcagccaatcctgatcgtagccaatttagactccagccgattcttactttgttcccgaatcaatcttcttctttgatttcgcttcgatctatttttcatcttcgatactgatattactaaatttggtcgtcaacacatgcccccaagtccggaatatttggtaatgtttcggatttgccatatatcaactccgagtgaaattcacaccttgtcgttttccgaccgttattccaatgctttaaatactaaccgttgccccctaaaaaatcttcactccgttacttccgtttttaccgcctaagccaactttgtcctttctctctccggcgatttctccgacgcacaaggcgatccccaagcgactccatctccggccagatctccgcccgcggcgatgtcgtcctccgccagcccgtctgccgcgccgtcggccgagtacgctgaggtaagttctcatcggctagatctcttttcctcgcaacagattgattttccaactcctcatctggttttcctcctctcggttcttttggatttgtagcatctctccaacctagttgcaattcccagcctgtcgcacgaaaattactacttccttggcccagtcggcaaccctgaccctaccgagttcatcattggcgaaaccaataggattcccttcagattggccaacccagatctaggtcactggaaaaataccttcaaatcttggccatctctcgagaaaactccacccgagaaaagttggattacatggtacaagcgcgtatcggctagctagaaagttcactgggacgagattggaatcggccaagcacttgcccttaccatagccaattcagctaaagatgaacctctgatggccgccgccacttatttttggtccaacatcatcaatgcctttttgttcaaccaagggccgatgactccaacactgattgacatcaccatgatcattggattagatgtaacctcattggctaaccctatgagcatgaacaccaagaatcaatttgatttcaagaccaaaagcataggaggttggtctagctatgtagcggcatatatgggcaaagggcctgtcaattctcgggaacatgtagctttcttgctaatgtggctagaaaagttcctcttctgtggatccagttgtggtcctacaaccaattggcaatttgtagccgaagccctagaatcaaagaaacaatttcctctaggcaaaatcctcctcggctatctataccaaatgttgaataatgcatcggccaagatagctgtcggctcagtagttggagcaggtggaccatggtgtctgctgcagacttggctaaatctgatggtcatgaaagttgtcaatcggccatctgtaacagaagccgaattcccaagactagagccgattgtagaagatgatggagaagagcgcactcatcgcagatgcatgtcatatagagaatatgcatccacaccagccgatgctggagcaaaattattggttgaactgctcaaggaccggttctgcagtttctatgagggctttcaaaaagatgcttgagtttggtttccttatgaagattcagcaaaccttgagctcccatcggactttagatttgaagacatcaatcatgaaagataccaaaagtccagggaagttttctcagctgcaatcagcccatgcatccttcctgttggcatccatcagggaagaaacatccaagtttcttatgaattctatcacccgatgagcttagccagacaacttggaatgggccaactcccaatcggcttattctttgctgacaagatccagtgctgaggggaaatttcatcaaccttgatgacggatcggctgctcaatctccaaggacctcctctgggcatcattgaaaatatagagatggcaaagttcaggagcaaaaactttgacagatggtggggtgaatggaaattgcatctattccatcaatcggcttctatgtacatgacagatctctttccagatgttatccctcaggtatgtcttcatttaattaactccgtttaaataattgcttagccgattcataacttaattaattttcttttctgacttgcagaccacagagttctcccctcctcaccagaccaatagtggcagggacatagagtatgcaccaggccttattccaaatggaggtgggccatctcctcctgtcatcggctatcatgccccccagacttcaactcttctccaagggctcatcagagaaccagccgatgccagtaaaaagagaagaaccaggtcatcggctatggatacatcgtctcctactccaaagaagaaggccaaattaaagaagcctaaaccaaccgatgatctgcctgccctagatccatccattgaacaagctctggatgaagaagaaatcggcgaggatgttgatcaagccgcagatgaaataagcgatactgaaagaactccatcggcttcacctaagcaaactcctccgaccccctctgctccagctcacttctctagggtgaatatctttccttgattctcttttataactatttatcctcagccgattgctcactaatctcatccttgcagaaaaagagaattgctgtgaagaagaaatcggcatcaacaactctaaaactggctccaccagtaagatatctttaatgctttcactagttgatctcagccaattttgtctaacatttgtctcttttacaacctcctcctcctcctccctcttctcctgcacaaccatcgtcgagtgaccaaactccatcggctatagggagccatcatgttgaggaagaagaacaaccaactgctcctgctatcccagtaagtttccttttgatacaagaatttagatcggctatgtctatttagctctaactctctttaaatcattattgcaggtcttagctaatcttttctcttttgacattagagattatcttgatgagacagaagaagataccacaagcaaagctttagcccccttatccgatgatgtgaggaaaattctcaaagatatctctcatcggctagaggcatcatcgttagatagcttagtggttgattgcggatcaattaggaatgcggctacat

SEQ ID NO: 8861 - DNA, 1445 bp, Oryza sativa
ttaggaatttttgtaatcggctaacaaaactttgactcttcattgaaattatcttaataactttcatgccgattcaacataactccatattttgctcaaaaatttgcaatttttcatatatgtgcccccctaattttacaatgtcaaaagcattgataaaattatagcttgaactaagggcgacataacaatatcgaccattgtacatcggcaaacgacaaccgattacaatatgaaaacaattaagggcgatataacaatattggccatctcaaggcgatgcaaacacatcggctatcatgtatcggcaacatcagccaatcatgcgttaacccaaacacttgggtaatatttcttcaagtacttgccatttagtgctcgtccatagacttctccatcgagtccttgtagcatgtatgctcccttagacacaaccttatagatttggaacggtccttcccaattcggtgaccacttaccgaatttattatcccgagtcccaattggcaaaatcaacttccatacaagctcaccctccgaattattgtaatgccgagcaactcgttccttatccttgttacctttgcaagggctcgcaaccgcgattgaaccaggtcttccctctcatcggccataaggttataatactcattggctgtcaaatcatcttgcaattccgttcttctcaagccgattctaacttcctatggtaaaacagcctcatgcccataaacaagcttataaggagggacttgaatcgatccatgacaagccatccgataagaccataacgcttcggctaaacgagcatgtcattgccgaggataatcagaaatctttcttttaatcaatttgatcaaactcttgttagatgcctcggcctgcccattagcttgtgcataatatggtgaagaattcaacaatttgatacccatgctatcggcaaactgaacaaactcatcagatacaaaaattgaatcttgatcggctgtaatggtttgaggaataccaaatcgatagattatatgctcttgaacaaactgtatagcatccctagaatcaaccttcttcaaaggaatcgcctctacccacttggtaaaataatcggtcgccaccaatataaacttatgccctttactcgatggtggattaatcatgccgatcatatcaattccccaacctctaaatggccatggcttaatgataggactcatagccgacgccggtgctctctgaaacgccccaaacttctgacaatcttgacaccccttgtaatatttgaaacaatcctccagcattgttagccaaaaatatcccgcacgtcgaagcaaccacttcatcttatgagccgattgatgagtgccgcaaatcccttcatgaacctcgccgattgcaaccttagcctgatcggtattcaaacatttaagcaacaccccatcaaacgt

SEQ ID NO: 8862 - DNA, 5684 bp, Oryza sativa
tcgagatacatgcttcaaagtaaccagccgaaattcctgattagttcttggcacttctcattataaaccattaatgtatcattcttgcactcatattctcccgccaattgactgattactagcaaagaatccccccataatttcgatagcatcggcttcaacttccttgagtaactgcaaccctttgagaactgcctcatattcagcttgattattggtcgcataaggtttaattgtgtaagcaaactcaaaacatgccccccgaggggaaattatcactaagccgataccacaaccatgagtacatactgatccgtcaaagaataaagtccatggcacaatctcaactgagccaattgaatcatcacgatgatcgacaataaaatcggctatagcttgccccttgactgcctttagtgactcataccgaagatcgaattctgttaaggaaaatatccactttccaacccttcctttcaaaattggaggcgataacatgtacttaacaacaccggctttgtatatgatagtgcattcgttggacaatagataatgccttaaccttgtacaggaaaaatacaggcacaagcacaacttctccaaaggggaatatctggtttctgcatccaagagtcgagaacttaagtaaaatacaaccctttcctttccttccaactcctgaatcaggaccgagccgatcgacttctcaccagccgatagatataatctgaaaggtacccctttctgtggaggaatcaacactgggggagagctaagatattccttaatattatccaatgctttctgttgctctaccccccaagtaaacttttgatcgtctttcaatcttaataatggtgtaaaaggctctaacctttcgaacaaattagaaataaacctttaacaaaatttatcttgtcgatcatctcctgcaactccgtcttgttctatggaggctgaatctttttgattgcattaacacttctttgagttatctcaatccccctctcatgaacaagaaatcccaaaaactggccagacgatacaccgaaagcacactttgttgggttcattttcaagccatatttcctggttctctcaaaaaccttcctcaaatcggctatgtggtcctctatttctttagatttaacaaccacatcatcaatatagacttcaaccaaccagccgatcagatcatgatatatataattcatggctctttgatatgtagccccagcacttttcaaaccaaaagtcattacaacccactcaaataagccgattgcaccaggacacctaaaagttgtcttatgaatatcttctttggccataaagatctgattgtaccctgcattaccatccataaaacttaaaaccttgtgtcctgaggcagcatcaactaactgatcggctactggcattggatactcatcttttggggtagctttattcaaatccctgaaatcaatgcacacccggaccttgtcgtttttcttaataacaggaactatactagaaacccactcagcatatcggcaaggacgaataaaacaagcatcatataaacgtttaatctcagccttgacaggttcgagcatatcggctttgcatcttctcggaggctgctggtgcggtctaacccctggtttgataggtagccgatgttcaacaattgattggctgagtcctggcatctcacaatatacaaaagcaaagcaatctttgaatcttttaaaagctctatcaacttggttctaaattctggagataagtttttactgataaatgtcggccctggtcgatcgcctggacctatatcaatttcctccaaatcatcggccgacatgaaaccctgtccttgtttgtcatcgagatcatctactgtgtccttggtgtagacgtttgaaccctccacgacaccctcaaaaaaattgattaaaaaaatgtccatcccaaacttttccagataagcaatcaagaccatccatctcccaaagagctaaatcgtcactggcaacattaactgacctgtcagctggcacaatttcaatcttgtcgccttgccactgaatcaagcattgatgcatggttgaaggaatacaacaattggcatgaatctaatcccttccaagcaacaagctgtatgtcacaccctaaaaatccctaaatgtataaatttttgtttaattggaattattagaaatgattttaaaagcctagaagaaaagatctaattttaaataataaattccaatacaaaaatgggctagataaaattttattaaatacttcatttgattctatagttcctagatttttctgggatttatttgagccaaggaagtatttttaataaatggaattgcatttcatgaataatttaaatagaaaaaggttttaaaatccctcttttggctttgggccgaaagtcggcccaaaacccctctctctctctcttcggcctgcaagcgcgcccggcccaagtcagctcgccgagccgagccgccgctctccctcctctctcccgctgacaggtggggcccacctgtcagggccgtcgtctacctcgcgccgccgcagccgtgccctagccgcgcaagccgccgccgcctccttccaaaattcgatcacgccttccccgatcccctcttccttttctcttttggaatctcttgctaattttgtttggaaatcggtggattcgagttcgattcggattcgttttctctcctctaaccctaaactttccatctcgccgccggccaccgtgggccttcatcgccgccccctagcccctataaaaggactcccgggacctcctctatccgccaccaccctcgctttagctcgccatcgcccgtagcaccctagccactagagcccgtgcgccgccgccgtcgaggggagttcagccgtgggccgccgccgctacggtcgtcgtcatcgctcgggaaggccgccgttgggatcgccaagtcgtcgtcctcgtcccgccctccatttccgccgaagatcgccggagcaccgccgtcgtcgtcgacgcaaacgccgccgccacttcgacctcgcagccgtcaccgttcgttgccgtccgccgttgtctgagccttcggtgagttcgccgcatcgccctctacgcgtaggtgccctccatttgcgccgccgcgccgtcgttcgccggcgagcgtgagccgccgccggtgatgacgtcatcgccgatgtcagcgccgcgtcacccgtagacccgcggtagactgattcaatcttggccgttcgttttggattagattcaatctcggccgtccgttccgtagaccgtctccgtgcacccggtccaccataaatccgagcccgctgacgcaataaatcctttttccttctcaaaaataattctttattgcgtcataattcaattaaaatctatataaatgatttaatctgatttaatctttaaaaattcataactaattcatcttagctcggatttagttggtcaagtctctaaatttttctaaaattgagagctacatgttaaaaatatccatatgtactgttcttgattgtttatgtgctgttttggtgattttgctcttttatccttagattccgacgttcccggagagtccgaatttgcaggagaagactttgaagagtttcaaggccagcaaggcaagtcacacagattccaaacaaccctttgagcatgttgatcccgtttaaagctttttttttctattcaactattgcatttatttttgaatgtcattgggtgggaataacccattgccttgttatagcctttttgttattgattacctattctttatcgtttggttaatatttggattagctagaacattatatggttttagctaaagtgcttaggatgcttagccatgcttagagacattagctcatataaatgggataacttatgattcactattatttaatgatggcttaatgatagctcatgatggttaatcatgataggatgattaattaatttgccaactaaaactgataatggtgggttgtgagcacatggttttgatggtcgtgctcatgacaattaaggaccggttcacgatttttggttgtgaaacattaaccgtgccaaccacaagccagcgtgggcaacggctttactttctgtatagtatggttcattgtagagcaccagactgtgaagtggcagagataagcccacgggggtcgctggggagtccatgccttgtttaagggggtgattatgatccaggaacggtgcattgctttgaattgtgttatgcagagggtattgtcacaatctctattcgggtacttgttaagtatcgcgacgcatggttgacatgacgttgagattgtgtcttgtgggtacagtggtacacctctagccagagtaaaactattcgaatagccgtgcccgcggttatgggccggtctaacaatgtctttcgtgattagtttcacacctctcaccataataaatgatgttgtacttggtaataacttgtttagctccaggtttggaatggtatgttcctggtttggagatagaactgtgcagccgggattggttgttcggaatggttgggcctatgcaacgggtatgttgtatagcgatggattaatattgcttaattaaatacattattgttttattaaattctgaagtatttattaaatgccatttatgcaaatgagactatattatgccatcccttgttatcccttgcatttgcatatttgctgcgtggcttgttgagtatgtcatatactcaccttgcaatcattcatcagaggaggaattctacagtgatgccgaaggtgtggtggattaggtgtagccctggtcaagctgcttgtgggatggagtcgtctgcgccgtttatcttattttccgatgcttagaactttattgtttgagaggaactatctaccactgtaatgactttatattcgcttattaattagagtaataattgcactctattatcaatttgttattgtgtgcctcggctgattcctggatgagggtttacacacatgtaagcgtttggaattttcgatagaaattccgggcgtgacactgtaagaacccttcccatcgatgacaaagaatgttgtagggatagttttgctgccaactatcatctccacatttaaaactcctttggtttccgatggattaccaccaaaatctttgagcaccatattcgtcttgatgagatcttcagcatttctacctaacttcttaaatgtagcataaggcatcaaattcactgcagccccaccatcaaccatcatcttagacatcggcttcccattgacatagccaattatatacaatggtttaagatgccgattctctgttccttctggcttctcgaagactgcttgctctggtgataaaatcaacttagccgattcttcttcaacttcatcgacatcggcttgcttgaccccaaattcagcaggcaatatgaaaaccatgttaaccgatgcggtcacaacactttttcctttagccaacatcttcgcttcatcggctgcggcttcatcggctacaggagcttgatttctaacacgccacacctgtctcggcttcgccttcttcaaccgatgattgatttcttgctcaacctcctgaaagcgcttccagttcctcaacctttaaaccc

SEQ ID NO: 8863 - DNA, 1120 bp, Oryza sativa
ttgccttagccgattgcttctattaaatgatcagcttgaaatttctgcaacattgctgcacccaggacagtcctcgatagatggcaacctcataccctcattccagcaaaatctaaagaactcgcagccccaatgaggatcaaaaccgtcatcaccttcttcataacgcctctcctgttgtttgtcatacctcttctgatacttattgataattttagccgaatttacctgaaaacctcttgcatgaccccccatcggctgtccggctagctgtgtgcaccatattgactggaaaaggattgccatcaaccttcattggcctcttagagtcttcaaatttgattttgcctccctcaatggctgcttggatctgcagcctgaaaaccttgaaatcattggtagaatgagacccagaattatgccactagcaataccttctcttgcccaattcttcagccgatggaattgtatgaccaacaggaagttgaatctacttctctcagagtagcaaatcaaaaatcttgtcagccttggtaatatcaaagtcatacctctcctattttccagaattctttacccattggcatggtataacctttttgcttctcacccattcggctgctgctatctcagagtcatcatcattatcatcatcatcatccgatccatatatgtaaggacatacatgattaacctttttgaagttcttcctggcttctgcaaacctctgttcatgcaaggttaccttctgtgcaaaatgtgacaaactatcaaagtcttgagacgagaacttctccctgatcggagcaatcataccctaaaagccaaatcggctaactgggcatcagttaaactcaaattgtagcacttattccttatctctctaaatctctgaatatactcatacacaggctcatcatgtctctgcttgatcgctgttaaatcgaacagtttcatctcgtgaatcccactgtagagatagctatgagagtgcttctccaaatcggcccaactattgattgatccacatggcaaagaagaaaaccaagtgaaagctgatccagacagagacaatgggaacaacctaaacctcaaggcatccacagccgatgcttcacca

SEQ ID NO: 8864 - DNA, 958 bp, Oryza sativa
aattccttgaaagccatctgcagcacctttattactcggttgagccacgccatctggagcttgtttcacttctccatccttagaagaacctgtcccagaaacatcagcaattacttttactttgtacttctgaacaagtgttcccttgcgggtctccgtgaatgagctcaagaactgattccgtgcttgttgcatcattgcctcaagatccttttgctgctcaggtgtcaatttatctagagtgatgagcacaatgttgccttcatcaacctcagatagacccagcttgtggatcttagctttaacagagcgaggctcaccagccaaagacggcgacgctggcggtttctaggccatgaggaaaaacagctgttgtgattctgacttccgatcggtcccaccgggcgtgccaaaagcgtgttgatgtgaaaacacaaggcctgggagatctgcttaactccagtgtaggtccaaaactcaccttcgggtgtgctagcgtgccagttgatttgatcctgcaatcaacaagaacaaagacaaagaaactgcggttgaatccataaacgatagccgatcggctaagtgccgatgacatatcatttatctttgagccgatgtcatatatgcatcgatcggcaatcattaataagtaagaaataacaaaatctactagatcgactatagatattaacgatatataatccttatgtcaatatatacttaaatcaagtgattgggatagatcggtcgccatgccgagatagtataaatcacttagatcgaaatatatattaacaacgagactatatatgttcatagcatagccaatcagatggatctagcatgtatcggctaatactccgatactactctatgtaaagatattaaagcaagtaaaatataccaaacaaagagcctaatatacttaaatgccaccagatcttaataaaagggtaga

SEQ ID NO: 8865 - DNA, 4912 bp, Oryza sativa
gacactgctaccgccttctcgtcctctttgtcgtcgttgttgcgatatccctagcgctgatggggataaggagagatgcaccgcgggtggctgatgtgatgtgtcttggcattgagcttgatgtgccacatgcggccgagcggggcgcggtcgagcgacaccacgacgggcaggaggagaaggggcgctcgaggcggagaatgagaggaggaggaaaggagaaggcaaaggtgtggtggaggcaaaggcggaggtagcgaactggcggaggcaaaggcggaggtaacgaaccggaggctgcttgctcggaggattcgagattgggacgaggagtagtgggttggtggcggctgaggttggtggagagtgcggacggggagggattaaagactatgggcgctttggttttctcttttctttttgttttaatgtttttcgagcttctttcagttgatttttctccaaacgattcgtctcttgtgggcacacatcactgttgctacgtcatcatttataattgtaaactaaatgatactagcgctttgttgcgggatatatgtaaggtattgtgaaatggttaatgatttgggttgaaatattttaaaaatgatttgagaatgatgatttagcatgtgtatgtttagttctagaatgaaataaattgtaaaaataattactatatgctttgcatgtataactttgtgtgtttagtgggttgacgtggcatgcttgcatgttaggttttaggaatgctaataaatgttatgcttgcatgttgagctttaggtgtttagtgggcattagctttatagaaagaagagattagaaataagtagatatagtactattatatatttgacaatatattcttcaggtactaataataatttatatcttctaactacttaaaaaaattagtaatgtttcaattgtcaaaaaaaatcaaacggaaaaggtagttacttaacatgaaaattaaatagttgaatcggtttattcagtattttttaaagaaaaaaaaggtttattataacgtgattgattagctgcagaaattgttttcggtattgctaaaaatatgtcgccacaaattacgatagatttcagtcggttgtttcaaccgtcggatgcagaaatcgcgcatgtgtacgcatatccctccgattctgttctcttctgttctcttatgttgttttaacgtttgtatttgctaagtaggattactaattaaacttaaaagctaaatatttgtgtcatcacaaatttatagttttgggaattacatcaacttacacatgtaattttgagaattacatatgtaattttaggacttacatatgtaattttggaatttacatagtaaatacactaaaattacatatgtaatttaggaacttacaatgtaaatacatagcgactattttttggtgaaaaatatggcgccataaatatagctactccctttgttttttattaaactgccgtcaagtccgatcgagtgacgtcgtctgtccctgcactgattaacacatcgcgtaaggctttccaaaatttttttcttgggctttccttgcgctaaccctgatcgaactcttccaaaaatccctaagggcatcagcgatgtttattcccaaaccaagcagtaagtgtgggcccacctccaaccagcctatcacaagccttgttgtgacttaaaaaagtgaggtgggacccatcatattcccttactaccagcaataagtttgtaatctggtagtaactatttggaaggccctaagcgtcgggcgcccgatttacgtgcaaaaactactttcaagtgatttttctcttaaattacttattcaaatcatgatccgattgtaccattaaattcgttgcaattaaatcttcaaaacaagaccacacatggatatattccgacaaaaaaattttagcttattattgaattatttttaaatgttgcacgatgctccaccgggtatatcagaattgtttcactaagtagatcgaaactgtttcactcgtttaaatcgggtgttgtttcaccttatataaaaacaatgtttcagcaaatagcgaaataatgtttcagttcactgtaacatttgatccatacatagtgatatattataagtacactaggtgaaacatttttcggtggaacaaaaaataaaacgaattcccttaatatagggtttccaaaatatgtgggttttttgttacaatgaagtatttcagttcactgcaatattagatttatacatagtgaaacattgtgagtacactaggtgaaacatttttggtggaacaaagaataaaccgaattcccttaatatggggtttctgaaaaatattgtgaatttgtttatttgcaatagagtatatggtgaagatatgtggcaattagtatgacacatagtggggtcctagagaagcacatgacacgttgtggagggggggagcgtccgattttctccccctcccccgggcgaccgagcggcagcattttcgcaactatttactactctcacaatgtttattacctgataataagcacctatttaatgcttactcctactctagcactacattatcggcgtggattctctaacgggcgagagcaaagtcagaggctgacttaccccctctccgatgccgtccgaactccatccaagggctactgagtccctcaacgtttacagtgtgcatcagttagctcaggcattgttttagcccaaataagggcccagtacgggacacaaatgagcccagctcgagaaagaggatgcagagggttcagaaacaagcagcgcttggtacagaaagaattaagcaagcatttcagtttagaacttggtacagattcatgtcccaaataaccaaaataatatccaccaatggccaaaatggatttgtacatattaccctagagttttgatggtcactgaatttccatcaaaagcactgaattttcgataagtgctaaacacattcatgccaaaagaacaaaagagccttcctcatggagcagaaactaaatcagagatctaaacaagatcttggacagacatatcatcatctcactggcaccctacaaagacaaaacaaaagaattaaatactaataactaataagcatctggatgcaatcggatgcaaacaaaatccatgaatttcgaatgtaaatccaacttacttgtttggttcagcttgtgccatcgaatctccactggaatctggttccaccacctgcgatggcctcccttccaggcacggcaaccacgaaccctccggcgtcccggccacaccgctagccatgcgatcgacgcgcgcaacttcgccctttcctcgtcgccaagccgcgctacgcacgcgttccccgccaaaaatattctgcgcgctctgttccggcgccaaaatggcctctagtggcggcagaggagtctaaatagaaaaaatttgggcgttgggccaacaagcgaatgtgaacagacttgctctgatagctgaacctgggcacgcccttggatggagcacggacggcatcggagagtggtaagtcagcctctgactttgctctggcacgttagagaatccacgccgctacattatggatgtcctaacgaaacacacacgaacatatcctaaaatcccattaaacaatcgaatctctggaaaaatcatgacttcacctggcaaaaataggcaagtaacttcaactaaacaaacagatggaggtgagaaataaaaaccaaacagactgctccttatcgctgcccggaatgatccacgtcgtcggtcgctgttcccaagctctgacgcgcggcgttttgatgggcccacaagccgcgtgatcatctccgccgccgctgtcaagcaaccgttgcctcccaagactagatccggcaagcctcaggacggatctgacgaggagggggcgaggagtaatcgtcggcagagaaggtcgaactgtcgccgtcgccgccaccgttgagggggtggcattggcaaagggggaggaagagcggcgccatcgctgactcggtggggggagagagagcagcggagaggggaggaagaactgcagctcgcgatgggggaggagaacagtgctggcggtgggggagggagagtgaccctggtggtgggaggcagggggagcggcggtggtgaggggaagggttggagggagtgagagcaaccgtatgagggagggtgaatttattttgtttatgcttttagggtgtttgaagtaaaattttggatttctctacaaattacaaaatacgaggactaaaaatagaaaatgataggggttgacaagcaaaattagaacacccctagagccactttgcactatggaagaaactgatttgagtccgcagtcttcatcttatgtgataatctgacggagccattgtacgttatatttgcaaacgaaaagtaatttgtgaataaaccttttatacacgtgttcttagcgatttaaaagcaaaaactgaaaaataaatttcgatgaaaaaacctcaaaataaactctaaatttaatgttaaaaatttaaattttggttgataagtataaatataaggaaaaaaatgaggccgtgagacttctcatagcagtgtcttttgtactgtgaattgtgaatggcctgatggagcactctaccactacggatgcaagatttcgtggtgccatagatatggtctatggaccgttggcattgacacatcgaagctttgaccataaaaccggagggcccattgcacaccgcggtgaaaagtactatctaactttcaggttataaaattttataatattgcctatattcatatggatgttaatgaatctagacacatatacatattcattaatatatatatatatatatataaatatggggatccactag

SEQ ID NO: 8866 - DNA, 770 bp, Oryza sativa
atcgcttcgatctcctcttccctcttgttttaatcttcaaatttgggtcagcaataaattcttcaccattgtacggtggccactgtgtggggtcgaggtatggctcaaagcgacttgcccatgtgttcacaacggctcttgaagagaactaatacggcattcggttgggagattcctcatcaattgcatgaatcagatacacgtggatgagatgtgagcaaggcatatggtagagcaatggcctttggcaagaacatgagttcccctcaccttcaactttgaagactcttgcgccgattctaacaccaccacgcgttataccacccctctctgtgacctcgtatgtctttttctgcttatcgaaacaccttgaagtgtgtttgttcgccttacttttttgcatcttcatcttactagtgaccttggtggaccaacgctcccttaactggacttgcttcactgcttcatcatgtctgttcacaaagtaatcattgcacttcatgaaggtaaatgatactatggccgtcattggaagcttacgaacaccaactagcacgctattgaattgttcggccatgttggttgtcatgtaaccccaccgtcggccatttctatcgtatgcacgagaccacttatctttatccaacaactcatcttcaagccatttacgaggaccttcgggaatacgctgtcttagtgcctcaacatccctctcaaatatccacttcttgtcaatctgacatatccttaggagcctctttgtctgatgc

SEQ ID NO: 8867 - DNA, 785 bp, Oryza sativa
tgcaggaactgagttaacaaggaacgtacccaaaatcacatctggagcatcttgaacctcttgcagcagcaacatgattgacacgggcctttgatgctggtaccgtagagttgctctgggtagggacaaccttcacgcgtcggggcttcggacacttgtcagcataatgtcctgggtctccacagttgaaacacaccacgggcttgctgccttgctccctcttggcaggttgttgctgtgttggagctgcaacaggacgtggagcttgattgcggatgttgttgccagcattgttgttgaagaactgacgctgcggacgaacaacaaacgaagaacctccatgtggcatggactggggtcttaaagtaagacgcggcttctgattattcccctgttgtgtcttgaattgagcaatccgacgtttcttctgctccatgcgattgtatttgtcctcctgacgaatagccttatccactagcttctggaaatcatgataatctccagtcatgagtgggtaagaaagctcatcattaagtccttccaaaaacttctcctgacgctcttcaccattgcgcacatcttccggagcataacgagccagacgattgaactcgtgcagatactccgtaacagagcgagatccctgggtaagcgacctgaactccttcttcttcagagacaccactcccgatggtatatgcgtcttctggaaagcagcggtgaattcaagccagtgataggttcagcagtaatcctattcaggcggaagtgatcccaccattcag

SEQ ID NO: 8868 - DNA, 496 bp, Oryza sativa
ttgaagttcgcgaagacttgacctacgtggagaagccagtgaaaatcctggacaccatggaacgcaggaccaggaaccgggtaatccgtttttgcaaggtccagtggagcaaccaccccgaggaagaagctacctgggagcgtgaagacgagctgaaggcagcccatcccgatctcttcgccagttcttccgaatctcggggtcgagattccgtttaacgggggtaggtttgtcgcgtcccaaaacgactctaaaacacatcctcaaaattatgcttagaagaagtaaaatccttgtgaaagcctccaacaattaaaatgtgcgaagttaaaagtcgaataaggcttggaggatttttgtatatttcctaaaagcctaaaatgcgtaaataaattttagtggaattttcagagcacaaataataattaagaagaaataaccaagttaaatgggtttataaaaagaaaaaccctaaaagtcctttttcccccccccc

SEQ ID NO: 8869 - DNA, 684 bp, Oryza sativa
catgagtagggtagttcttctcatgcggacgtaactgacgagatgcataggcaaccaccttcccatcttgcatcaaaacacaacctaacccaagtttggatgcatcgcaatacacttggaaacccttctttggatcaggcaaaatcaaaataggagctgttatcaagcgattcttcaactcttgaaaactctgttcacattcttccgaccacttgtacttcacatctttctgaagcaatcgtgtcatgggcttagcaatcttggaaaaattctctataaaccttcgataataacctgcgaggcctagaaaactgcgaatctctgaaactgtcttcggttgtttccagttggttacggattccacattactaggatcaacggcaactcctccggctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatctataaagaccaccacgaacttgtctaggtattccataaacaccttattcatcaagttcatgaagaaagcaggggcattggtaagtccaaaagacataaccgtacattcgaacaacccatacctagtggtaaaagctg

SEQ ID NO: 8870 - DNA, 5824 bp, Oryza sativa
  unsure (1)..(5824): unsure at all n locations
attgcgatatctacactgaccacaaaagtctgaaatatattttcactcagtcagatctcaacctaaggcaaaggcgatggttggaattaatcaaggattatgatctagaggttcactatcacccgggcaaagcaaacgttgtggccgacgctttgagttgtaagagccattgcaatcatctgagaatggaagggatggctcctgagcttaaagaggaaatagcccagctaaacctacatatagtacctcgtggacagataaacaccctggacattcaccctcttttgagaacccagatagaggaagcccagaaggacaacgaagtgatccaagaagtgaaggagcgcatggccgctggacgtgcgaaagaattctcaattgatgagaaggaaacgctatggtataagaagaggatctacgtacccaaacagggtggactgaggggattaattctaaaagaagcccaagaatcagcatattcattgcaccccggaagtacgaagatgtaccaggatctgaaggaaggatactggtggcccaacatgaaaagagacatagcagaatatgtagcactttgcgacgtatgccagaaggtgaaagctgagcaccagcgaccggcaggtttgctgcaaccccttaggatttccgagtggaaatgggacgagataggtatggattttattgttggattgcctaaaaccgcatatggttatgattccatttnnnnnnnnnnnnnnnnnnnnnnnnnnnnnnnnnnngacggcgagatttattcctgtcaagccaaactatagcggtgtcaagctagccgagttatacatgaccatgatagtatgtcttcatggtgtacctaaaagaattatatccgatcgaggcacacagtttacctcgcatttctgggaaaaagtacatgaagccctagggagttaccttgcttttagcatagcttaccacccacaaacggacggccagactgagagaacaaaccaggtcttggaggacatgttgagagcttgtgcgttggattttagcaaggattgggagaaatgtttgccctacgccgaactctcctacgacaacagtttccaagctagcctaaagatgtcgccaaatgaggcattatttggtcgacgatgccgtaccccactaatgtggtccgagactggagaacgtgcgttgtttggacccgacataatcaaagaggccgaagaaaaggttcgcctgatccgtgaccgtttaaaggtggcacagtcacgccaaaagagttacgccgacacccgaagaagggacctagaatttaaggaaggagattatgtgtatctaaaggtttctccaatgagaggtacaaaaaggtttaaggtcaaagggaaactagcaccgagatatgtgggacctttccaaattatggctagacgaagagaagttgcctatcagttacagctactcgaaaacatcgccgatgtacaccgagtctttcatgtatctcaattaaagaagtgcttgagagtgccggaggaagcaagctccgttggaagaaattcatattagcaatgatctcacgtattcagaacacccagtccggatattggatgaagccgagaagaggactagaaccaaagtgtggcgtatgtacaaggtacaatggagtaatcacactgaggatgaagccacttgggaaagtgaagaattcttgaggactgatgtcgggacccaaaactaacaacttggatccgactgagattaatgtatcaatccctggatcagtaaaggttgatacatacaatataactggttcttcattgcatacgttaaagtcttacaatatcaagggttttacaataataggtattcttctaactgattgatacacagcggaagtttctatacattctgactagtgaggtataacctttagggattttctaaattatcgaggtcttcgtagtaatagtcataagggtcctcctcttgacccaaatctgaaaaagggggttataagagcaaggatgagtattcacaatactcagcaagttatctcggaaatatgatatgcactgacatataatagggttctttgcaaaaagtagtattggacaatctggaagaattatagcaggatttataaacatataaactttaggtttctaaccagggtaccatatgagtcccggtactcaattccatgagtacggctattcgaatagtttcaaagatattctactgcagtagatgtacgctttacccgcagtccacgacttgctgataatcatcggcttcagtcatggcccagtattaagtcattaacaattgtggcacctgttccatgaacttatatcctcatatgccctgaacgtaatattaacagcagcaagaggagttctggcgttcccgaggtatttaaggggaactgatcgtatgacaccatgtcatctcgatcagggtttagaaatataaccataattataattgagctcaataaaccaattacctgtacatggtaatggtagaaattgcccttcgcggctatagttgcctcctgcgcgaggacttaaaaaaaagaaccactatacagaggtgccatattgccaattaacctaataactaggtctgtccccattctagaaactgcggtcgtactcgttcgttcgacataagtacctggtaaatcttatatcgattgagacaatactagccacccggaaatcatccaaatcttacgtattgtcccaatctaagtataggatattttaaccagattgtaagcaaaataagcaatactaaattgtctgggtttctataattgatttatgcatagaaaatagaatattgaatagaaggctataaataaataatttgtaaaatataggcttaaatgatcaaaaggtgtatagtaacttgccttgctcgatgtcctgagattgattgatattatttagagtgtcagaggaatcctcaagacctagggttagacatataaaatccaaattcaaaaaggagttttaaataaaatctaaaaataagaaagtagagaaaataagataaaatgtaaaaataacaaaaaggggtccaaaagatagagagtgattttagaagaatattggtccaagtttcactggaattggatctatattttaaaagatatgggcttctaaagtttgaaaattgaataaaagagaaatggcactgtgagcgggtcccacctgtcagtctctctctctcttctcttcttcaacctccggccgttccccagatcgggccggcggcgttagggtttaggattgcggcggcgctagaggataaaagtagttgcggccgaggaggggagggagctagggatctccggcgacggcgagcggcggcggagaagttaatttggtgcgtggacggcttagcggctagggcggcggtggcacggttaggccgagatagcgatcaagatgataagggttagacatggctaggggaggggttctagagcatctacgaggtatttagagggattccgacagcttgccgacctttggcaaggtgcggagaatagttgccgacgagcgcctccataggcgacggccgtgttcacgtcggcagctcagagggtgatgtgttagtgcaaagggattgctaaaatagaatctaggtagtatgtagatggttgaaacggaagaactcaccgaaatcggttgaaacgacggattgcggccggaaaaacttcgcggcggtgaagaacagagcagcgcgggggcggcgatgctcggcttgatgcggcgaggtaaaactcgacgcagagctttggttagggcttagtatgctagaacatggctgatataaggtgttctatgaggtatttagggcggaggatggatggagaagggtgaagtcgatcgcgcacaaggtgttcgaccgacgggcgagggtggttggtgagatgggttgatgaagcagagcttcggggttgtggggctatggtcgtggatgatcgatgatggacagggaagggattggggtcctatttatagggctaggagaagcggatgagctcgggcaccgtcatcgccatggatgagcttgagctttggatatggttagggcggcagaggctgagagagggcgggcaagatcgatttgagtggcgggaggccacgttcgaatacttaccggcgaaggattgacttgaccgcggttggaatcggctggcgacgtgttggcgccaatccgagcatgacgcgcggcggcggcgagggtgaaaacagccggcatgggggtgaatggtttgaattgagggaggggataccaccgtctatcttcaatctaaccgtgcggcaagaattggcgcgatttatcccgggtagaaacgaaatcgcacccgacggcggcttggacgggagtgtacggcgtcgagcagtgatttcatgcggcggtcgtcgtcccggctttgtcgtcgtcgagattggtgcggcgacggtgggttgaaggcgttggacgggcggcagcgcgccaaggcggttgggcacgcgcgatcgatcccgagaccgacgcgcggcggctcggcgcgcggcaaagtcggctgccagtcggcgcgcgtgaaagggaggaagaggtaaaaagaaccacggttttgagtgggatgtggtcccctaggaccaattctaaactttgcataagattgggttggagttgggctgctctagctgggctgggcattctgtcgagcaccttgagtgcaatgaacagtagatttcaggaattttgaatatttccctagaaaagatttgaattcaaactaggagtttggaagggtttcactagggtttaaagtatggcaaatccttactaacattagggtgaactaagaaaataatctatggtttgaatttgagagaatttgctcaaattcactagggtttagaataaagggaataaattggaagggttctaataatacttgaaccaattttgttaaataaacaagaaatagatttttgaaccaaacaaatttaattaaaagccagcatgatgcagtcaaattttagtttaaaatttgaggatgttacaactgaataccctcatctgttcaacaaccggtaagaaatctcgggacgagatttatttaaggggggtagatttgtaacaccctgaaaaatccgacggacaaaatcgaaaccctaaaaatacggaccttcaaaaactttttaaataaattgcatcatgccggttttattcgcctatttcattggattttgatttcggagttcattaatcgcaaataaagaataactaacgaggaataaaccttaaaattaattttgctaaataaataattgaaatacaatttaaaataaagattaggagtggatagaaataaataaaatattatcgtagccatattggtaacaattaaatttatgtgtgagggaataagaattagccctaattaaaaattcaaataaattatataacaataaaatgtgggtaacattaatctcgggtgaatcttttggttaaaataacacaaatattgagtaaacttcatcggtgcaaaaattggaatttatagggcaagatttaaataggaaataggctaaattagggttaaataagagctagcactgttcattgcgcggtagatgctcgatgaggtcccctagctctgccccctcttctgcctcgcgcctgcaccccgccacgcgtcgtcgcgtcgccgtctcgagccccgcgccgccgtcgccatcgccacgtgccatcgccgttgcccgctccgagccccgcgccgccatcgccatcgccgtcgccgtcgcgccgtcgcgtcgccatctcgagccccgcg

SEQ ID NO: 8871 - DNA, 8148 bp, Oryza sativa
ccccccccccccccccccggtcggtcgccgtttccgccccgggtaggaagagagccaagagaggaagagaaagaaaaagaaagggaaaagagaagagagaaaagaaagagagaaaaagaaagaaaagaaaataggaaagaagaaaaggaaaaataaaagagaaattaggggagagattaggaggatttaggaaataaaaatggttggggtttaatcgtagattatttttggaaattcctagagtgtaatagtatttcgatcggaattccgggttaattataggaatatatttctcgatcggattttattagaattggtggtagtgaagtatttgtaatttcatgaaatattttaggatgtataaatcgaaattcgatttgcctatttcacgagtagtataattaatataaaagaatcgactttcgcattcgacttctatttggatttatttggatttttatttgaattctaaccgaattcaaatcgaattttcgcacgtaattttagagcccgagggagttgcggatccgagcgaggaccaagacccgcaaagcttcgaacaaggcaagtcatcactattccttgaacatgttgatctcatttgcaaaattattttgtttacaaataaaattgcatgcaatgatgaacatcctacttgtgattatgccatgtcttgattattgtttacccttaaatcctataacaatgatttacgtataagtccctagacaactatgacaaatgcttagaaatgctactctagatttatgcatactcatatttatcaaatgctatgtgcttgggcaattacctttgggaaggtaattgagatgcggcatgtggagacatgagcgccacattgccataatattaatgacatgatttgtgaaaggaaaataaaactaaacaaatgttttcgactggggcggatggaggatttgggtggtatccggaaaaggctagtgccgtccctggtcaattaaggaccgagccatgaagttaagcctgaaacgactcccgtacaaccgtacttctcgaatgggtatagacctagcggattagatagccgagcggaggcagtatccatgcatagtggtttctcattgagtgaggcaggtgcgctacggtgggacagccgttgaggtagggccgcgaggcgtgccctacatcggtgtcgccattggtaggactgccatgagtgtgcgagaaaaaacttaactttaaaccataacttaatatgtgtgtgagacttcttcccccgggagcgccagaactcctcacactgctagaaacatggacgcctagagtgtatgaggatgtaaagttcatggcgcgggtactgccaatgcgaggttatcgaaaggctttgccgtgatgcgtctcatgtgttgggacgaggctcatgtgttgggcagtcgcggagtgcgggtaaagtgtacatccactgcagtgtgagtaaaccaattctattcgaatagccgtgctcgcggttattgagcaccgggacatgtattacacttggctagactctaaattcttaacttgtgtgggatgggatactgcatgaagatttttttatgctgatggagccacttcctgagaggagggaaggtggacgtcctcagaaaaccatgacgactcaatgaggggaagctatccttgtgatcacaatggatggtggacagaaccgtcgttgtctaatgtgaacactggtattaaaacttgatcagtctatgctaggtcttaggcttgtgaaaagaattacaaaacttgctttgtgcaaaagaaccatagccattctttgaataccctctatcatgtgcattgttgctgtggtggtttgctgagtacggttggtactcacccttgtaatatacaaacttaatcagaggtcggagatgaagcttcggaggatccctacgcttactaccaggagggtgatgaagacgatggcgctcagtaggtcttagttacggtcgttgcctatggcgatggcgtgccgctgccttaactccgctgccttatctacttttgcttttggaatgtattccggaccgttcggtcctatgttctaagactatgcctgggggcctatgatgtaataattcgcactagactctcgtgtatgtgcacttggtatttcagctatgaactcgtgagtaccagactacttgatccagggaaatgatactgtttacacgattgattcctgttataaaaacgggggtccacagagctggtatcagagccatacgactgtaggaaagaccaaatggcaccccacccctttctagttggccaagggagaaattcccatttagtaatactttcaaaaaaaaataaaaatgctatgtttacaaaactctatacgattttcatcttactcttaactattttcttcacaaaacaagttttacttttagctgactttggtttttcttaaaaatagatgacagatcaggattcacccactacctgggagatgggcgtaccccactcagagggatacgtcattgagctacatcggttgatgaggcgcctacggtaccccagatttccgatctaccgagtgagacagtgtggacccgtttgggaggcccagattgaggctcatacacgagttccttcagagtcaggctacagctttccgacacgccaccgtcgcgacttaccggagaccgcgatgcaggacgcagcccgggaggccttcctccgacttagctctattcaccgagctgagttggcgagtaccgagtttgctcaccacccgtttcgagaggagagcaactccgtctgcacagtccaggacacaccttgctgctacaacccgatagtgacttgactgtcccgatgtgctgaggcagtagacaacttcgacgaggaggctctgttagagatcgacgaccagcagaggcgtgtgggacagttagagaccgaggtgactgacctcacagtgcagcagcttcagctagaggaggagcatcaggcttggggcagtgagatagactcactgaaggcacagctctaggtccatggtgaccagtttcagcagctatctgatcagtgcaacgatcgccgcgggatgatggatacacttgaggagcagctgagagaaagccaggagcacgtcagccaacttgaggagcaactatagttagcaccacgagagcttctacttccacagcagtagggcgttgtcacgcccagaaattcactagtaatttttgaacttatttgtgcgtaaaatcctcgtccaggaatcagccgagggacacaaactgacaattttatatacaaatccatcataataataacgttacatacttacaaaagaaaagaaaacagcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacatggataccaaaggatggcataatgtagggctcatttgcaaaatctgtatttagcaaacatttgagaattataaaacaatagagtaattaatcatcaatattaatcaacactgaacagcacacccatgctgcacaggcccaaccatcctgaacaaccatacccggctgcacagatctatctctaaaccaggagctaaacaaattattaccgattatattatcatttattatggtgagaagtgtgagactaatcacgaaagacattgttagacccgcccatgaccgcgggcacggctattcgaaaagttttactgtggccagaggtgtaccactgtacccacaacatgtcaccatgcgccacaacatgcgcctcaataccaccacggtacctctgaaaggagctgtgacattacccctcgcacaacacaatccaccacagtgcaccgttcccggatcatagtcacccccttataaacaaggcatggactccccagcgacccccgtgggcttatctccgccacttctcagtctggtgctccgcaatgaaccatgctatacaaaaggtaaagccgttgcctacgctggcttgtggttggcacggttaatgtttcacaaccgaaactcgtgaaccggttcttaattgtcatgagcacgactctcaaaaccatgtgctcacaacccaccattatcaagttttaattggcaagtaattaattaaccaatcacgattggccatcgtgagctatcattaagccatcattaaataatagtgggtcataagttatcccaatagtgtgctaatgtttctaagcatggctaagcaatcatatctaatatctagctgaaccaatatatatatagcccaactagccaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccatgctggccttggaactcttcaaattcttctcctgtgaaaacgaactctccggaaacgtcggaatctaaatagaaaagagcaaaaacaccaaaacagcacataaacaagcatgaacagtacatgtggatatttttaacatgtagatctcaattttagaaaaatttagagacttgaaccaactaaatccgagctaagatggattagttatgaatttttaaagattaaatcggattaaaacacttatatggattttaactgaattatgacgcaataatgaattatttttgaaaaggaaaagggaattattgcgtcagcggctagggttcacggtggaccaggtgcacggcggcgtctcacggaaactaacagccgagatctttccatctaaaatgaacggccgagatcgaccggtccacggccggacaacggcggacggcaacgatgatgtcggcgatgacgtcatcaccggcgacggctcggcctcgcatgctcgccggcaaacgacggcacgacagcgcgtacggaggacaccaacacgtagagggcgacgcggcgaactcaccggtgaccaaaacaacggcggaagatcaacggacggcgacggcgtcgaggaagagcggcggcgacgatcggcttgacgacgacggcggtgttccggcggtcgacagcgacggcgtagggcggacgaggacggcgacgcgatggcgaccatggctgtgacctccccgagcgacgacgacgactggagcgacggcggcgcacggctggagcggcggcgacaacggcggcgggaggctacacggtgctagggcgctaccgacggcgagaggcgaatgcaagggtggcggcgggtagtggcgggcttgggggtccttttaaagaggcaaggaggcggcggcgaaggcccacggcgaccggcgacgagaaggaaagattagggttcgggagagagatcgatccgaatcgaactcgaatccgcgaatttccaaacgaaattagccgacgattccataagagaaaagatagaggggatcccggggatcatttcccctctactgatttcatcggaaacggaaaggggcggccggattttgaaggagacggcggcgcagctcggttagggttcggccggcggccggccggaggttgacaacgaccctgacaggtggggcccacctgtcagcgggagagagagaggagagcgccggctcggttgcgggccggcttgggccggggaggagagagagagagggttttgggccgactttcggcccaaagccaaaagaggattttaaaacctttttcaattataattattcatgaaatgcaatttcatttattaaaaatacttccttggctcaaatatatcccagaaaaatctaggaactatagaatcaaccaaagtatttaatgaaattttatctggccccattttatattgggatttattaattaaaattagatcttctcttctaggcttttaagatcatttctaataattcccttttagacaacaatttataaattaaggatttttaaacaagaaaagcacttaacattataattagatcattaattgattactaattacttaactgttctttgtatcatttaggaattgagctccgaaaaaatccgagaaaattttagagagtataattaatcatggagaatttaataaaaattaaatccacccatgctttatatttaggaaattttatttcccacattaaacttcacttgtaaattaatgaacattaaatataaattctattaatttataaaataatttataaatcctgaaacgaaaatcaggatgtgacaggcgtgaccgctacttcttccttaccccgccgtacccgccagcgttccacgctctgttgggagaggttgatatgctagctaccgagtcagcaccttacctggtggacccgacagtgacacagccacctgccccggagattgtgcacactccactgatctccactccttcaccgcagctgggttccagtttggagactccgatccaggtcgactccaagacagaggggaccgacaccgagccagagatagagccggacatcaccgacccttcagaggacgagactcctgtccaccgcatcacctttgtcggaggccctcgtaccctcagcactgcctgcaagagcacacgaccctcgggcaagaagcccaagctagatccagagacccctacttccgagccgtggggactcaggtttgcacgagccagcgaccaccctcttcctgccccaggttcctgcggatggttggatgactagactggaggactattgcagcttcgatctcgcttcagatggtttttggatagcatgcgagacacacccccctacctagattgacgagtagcttgatgattagttcgatgtaccatttggatgaactttatttggactgcgtatatgtgcagtcgattgtatcatgatttatgtactatctgtggaactctgtgttgttatttatgatattttactgttgtgttatgaatgagtttattccaccatgcttgcaaaacaaagttcacatcaaaacaatttccttaacggaataaaaccataagggctagttaggaaactaggttacttacctaatcggcctacacagatggcaagccgacgtcgggcatcaaccagcaatgaagagactcaagcacccgacctaaccaccctggctggcgttatggccacccaaacccaacttctgcaaaccattgcaaacaatcaaggcaaccgtcgaggatcgaatttcactagtaatttccgaacttatttgtgcataaaatcctcatctaggaatcagccgaggtacacaaactgacaatttaatatacagattcatcataataataacgttacatacttacaaaagaaaagaaaatagcagcggaattacggtctagcgaagctccggctccactcccacaggcagctcaaccggggtataagcaattatgtctaacatctagctgaaccaatatataaagctcaactagtcaaattataataacccaaggtatcaaggaatagagtaatcaatgcaaattggccataacaaaggaataggttcacaccacccagtgacattcgaaaataaatgcacagttgaattaaatagagaatttaaatataggatcaacatgctcaaaggaattgtgtttaggatctgtgtgacttgccttgcaataacgggtcttcaattaatcttcttgaacacttccggcgcactcgcgaaccttcggaacgacggaaacgacaagctaacacgcaaaacgagaaaaaagactaataaaaaccaaataaacaatacataaaaagtaaacaaacatgtagatcatgattttagatgaattatgagacttgaacggcctcattctgacttcatatgaattaattacgaattttacaagattaaatctaattaaagcccatttaaaaaggattaaataaatttaattcaatttatggataattttaatatgtagatatttattttatacaacttttgaaacttggaccacattaaaccgagttacaatgaat

SEQ ID NO: 8872 - DNA, 4349 bp, Oryza sativa
taaaccgagttacaatgaattagttatgaatttttaaagattaaaccggattaaagcatttatatggattttaattgaattatgacgcaataataaattatttttgaaaaggaaaaaaggattattgcgtcagcggctcgggttcacggtggaccgggtgcacggcggcggtctatggaaaccaacggtctagatcaaccctatccaaaacggacggccgagatcaatctaatccattgcgggtctacggctagcgtcagcgctgacgtcagcaacgacgtcatcaccggcggcagctcggcaacgcacgctcgccgacaaacgacggcgcggtggtgcaaatggagggcaccaacgggttgcaggcgacgcggcgaaccttaccgaggcacgaatggcggtggacgacgacggcgacgaggaagaagcggcgacgacggtcgggttgatgatgacggcggtcttccggcgatcctcggtgacgacagaggggtggacgaggtcggcgatgacgtgatgaacccgacggtggccttctcgagcgacgacgacgaccggagcggcggcgacgcacggctggactcacggcggcggcggcggcgcacgggcactcgtggctagggcgctacgagcggcagcaagctaagacgaggttggcgacggagagaggaggtcccggggatccttttataggggctaggaggcggcgacggaggcccatggcgaccggcggcgagatggaaggttttagggttagaggagagagatcgatccgaatcgagctcaaatccgtcggtttccaaacgaaactagacgaagattccaaaagaggagatcccgaggatcatttcccctcaattgatttggccggagaaggaaaggagtggccgaattttggaagggtggcagcggctcgggcggctagggcgcggttacggcggcgcgaggttgaagactactgacaggtgggccccacctatcagcggcaccgagagagagaggagggagggcgcggcggactgggccggcttgggccgggcgcgagcaggccgaggcgaagggagagacttgggccgacttgggcccaaagccacaagggagattttaaaacctttttctatttaaattattcatgaaatgatattccatggattaaaaatacttccttagctcaaataaatcccagaaaaatctaggaactatagaaacaagagaaatatttaacaaaattttttctagcccacttttatgttgagatttaacaaattaaaattagatcttctcttttaggcttttaagatcatttctaataagtccttttaaacaacaatttataatttaaggatatttaaacaagaaaagcacttaacattataattagatcattaattgattaatttaatgattaactaattactgaaatattatttgtattattaagattaggatttgagctttgaaaaatccgagaaaatttcagagagtataattaatcatggagaatttaataaaaattaaatccagccatgctttatatttaggaaattttatttcccacatttaacttcacttgtaaattaatgaatatttaatataaattctattaataatttattagataatttataaatcctaaaacgaaaatcaggctctgacagaccgacaccgagccagagatagagccggacatcaccgacccttcagaggacgagactcctgtccaccgcatcacctttgtcagaggccctcgtaccctcagcactgcccacaagagcacacgacccccgggcaagaagcccaagctagatccagagaccactacttccgagccgtggggactcagggttgcacgagccagcgaccaccctcatcctgccccaggatcctgtggatggttggaggactagactggaggactattgcagcttcgatctcgcttcagatggtttttggatagcatgcgagacacaccccccctacctagattgacgagtagctgatgattagttcgatgtaccttttggatgaactttatttggactgcgtatatgtgcagtcgattgtatcatgatttatggaccatttggggaactttggtatggttatttataatattttactgttgtgttatgatcagtttattccaccatgcttgcaaaacgaagttcacatcaaaacaatttccttaacagaataaaaccataagggctagttaggaaattaggttatttacctaatcggccctacacagatggcaagccgacgtcgggcgtcaaccagcaatgaagagactcaatcacccgacctaaccaccctggctggcgttatggccacccaaacccaacttctgcaaaccattgcaaacaatcaaggcaactgtcgaggatcgagctttggagtttatgaggactaagccacacacattcgctacggcagacaagcctatggaggcagaagattggctatgcatcatagagaagaaactgacccttgtccggatgcgcgaagccgacaaagtgatcttcacagtaaaccaactggagggaccagctggcgattggtgggatacttacaaggaagctcgggaagaagatgctggagaacccacttgggatgaattcactgcagcttttcatgagaacttcgtgcctgctgcggtgatgcgtatgaagaagaacgagttcagaaggccgcgacaaggaaacacaacggtgcaagaatatctaaaccggttcactcagttgacccgctacgcaatcggagacctcgcagatgaagaggaaaagatcgacaagttcatagaagggctgaatgatgagttgcgtgggcctatgattgggcaagatcatgagagtttccagagtttgatcaataaggtcgttaggctggaaaacgaccggaaggttgtggagcacaatcgtaagaggaggcttgccatgaaccgcccacctcaggtggcaactcagcatcctaaaggagctgcctcatcaggatggaaaccaacggtggtaacaacgaaccgtcctaccgcacatagcaacttccacaggccggttaccactcagaaccgagctcctgcaccgaatcaggccgctactggagtaatgaggccaggaagctgtttcaattgtggagagtatgggcattttgccaacaaatgtcctcatctaaacaagacacccattcgcaccggagctaatgcaatggctattcacggggctgctacccctgctggtggacgaggtctgttcaggactcctcagactaacaggaccgccccggatttggacgcggacaagtgaaccatgttcgagctgaagaggcccaggaagaccagggcgtactgataggtatgttttctatcaattctaccccggttaaagttctcctcgattctggtgcatcgcattcattcatatccttggaggctagtcaacagcacaacttaactctggtaggagttagaaagcctatgatagtacactcgcctgggggtgaggtaaccgtaagccatgcttgcatcgacgtacctattcatcttagggatgtggtgtttccctccaaccttatggttttgatacctcagacccttgatatcatattgggcatggattggttaacaaagaacaaaggaattatcgactgtagacgtagagaggttaccctgaccacgccctggggatcggatatgagagcaactatggatcaagatcctagattgactgaacgtgccggaggcatattcaccatgctacctatgaaaggaatgcccgtagtgcagcgattccccgatgtatttccagaagatttacctggaatgccaccagatcgtgacatagagttcattattgacctgatacccggaactgcccccatatcgaagagaccatatcggatgtcagtcaatgagttggaggaacttaaaaagcaaatcagagagttgcaagagaagggatttgtacgccccagttcgtcaccttggggagccccagtgttattcgtcaaaaagaaggatggtagcatgagaatgtgtgtggactaccgctcactgaacgaagtaactatcaagaacaagtatctgctaccacggattgatgaccttttcgatcaacttaaaggagctaaggtgttctctaagattgaccttcgatcaggataccaccaactgaagattaggatcggagacatacccaagaccgcgttcttaacacgctatggattgtacgagttcacagtaatgtcgtttggtttgaccaacgccccggtatactttatgaatcttatgtacaaagtgttcatggagtacttggacaaatttgtggtagtattcatcgatgatattttaatct

SEQ ID NO: 8873 - DNA, 956 bp, Oryza sativa
gtggtccatcactgttgtgtatgggcctcaattggaagccgataaaattgcctttctctctgaactcgaaagcttacaaccctccatgaaacgggcttggttgattattggtgattttaacctcatctataaagcttcagataaaaacaaatgaccgcctcaatagaagaatgatgcagcatttccgtggcctcttagacaaaatccgggtgaaggaattgaatcttcctggccgccgtttctcctgggcaggacaaggcgcaaatccaacacaaactaagattgaccatgctttcgttaccactgactgggatttaatgtttgatgggtccaacttatatccactgtcttctgcgtgctctgaccatgcacctctccttttagttggaaatgagaaaagaacgaaatttccaaatttcagatttgaatcctgatggcttaaaattcctaggtttctggggattgtgcaggattcttggcaaaggccaattctcgccacaaacagcctagccaatttccgcttgaaactacgacgtcttgcccgcgacattaagagatggagccgtaatcaagttggagatatcaagttacaacttgctgttgcatccgaagtgatattccaactagaggtagcacaggaaaccaggaccttgtccaatgaagagcgtcttttgatctctaatctcaaaaccaaattttggctctcttagtcctaaacaaaattcagattaggcagcgctttaggcaaacatggcttaaggagggagatgtccactcaaaattctttcacattaaagtcaacttcaggaaagaagaacttcattccatcgctgcatacaccttccgggatagccatttccaccccagataaagaaggggaattgttccgtttcctcaaggaaagacctgggacatgttttcaaaaaaggccaggaatcaattggaatatgaaggaa

SEQ ID NO: 8874 - DNA, 10540 bp, Oryza sativa
tgcttaggtctagaatcgtgttccaaaatagcttttagcaactaagtacctctaaatgttgtttactgcaaaccctaacccctttatattataactccttggtactcccttgcatttattctgcacttgtgggtgtgtcttgttgagtacggtggttgtactcagtcttgctcgatttttcccaaccccagaagaggagcccttgaagatgaaggctttggtgtctagctcgtgcctgccgtcaagcgcctgtggtcgtcgccctagtcttccgctgtttctcgtttgtctctgtgtgtgctgggccttcgctgcccatgtaataaattaactattcacgcttccgcttgttaaactctgaattgtatcaacttttggtgtaccttgcctcctgggacaaggattaatgcacgcacgtaaggaacgcccgttgggttatttccggtcgtgacagcggggcaccagactgagaagtggcggagataagcccacgggggtcgctggggagtccatgccttgtttataagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaaagatgcttaaattggtaataatttgattagctcctggtttggaatggtacattcctggtttggagatagaactgtgcagccggggtggttgttcagaatggttgggcctatgcaacagggtatgttgtatagtgttggattaatattgtttaattatcacttaactgttttataattctcaaatgtttattaaatgctgtttttgcaaatgaaaccctactatgccatcctttgttatcctgtgcacttgcatatttgctgcgtggcttgctgagtatgtcatatactcaccttgcaatcattcatcagaggaagagttttacagtgatgctgatggtgtggaggattaggtgtagccttggtccagctgcctgtggagtggaaccgtttgccccgtttattttattttccgctgcttagattttattgattgagaggaactatttacctctgtaatgacattttattggttaattaattaaagtaataattggactttattatccatttggtaatgtgtgcctcggctgatttctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttgttagtactgtacatctattactgtactaacgactcattcatcagcaaaagttttacaatattgtttcatttgatcttgctacaataaaataaatttagcatgttgattttataactttcttttatttcttttgaaacctgttattcaaaagtacaaaatttgtaacctcgtttccaactgttttaaattatcttgcaagcttggtttactttacttacctttttactttgaatttctaaactttattcaaattaatccaaaaacttgtgctattaattggataaaggtcttaactctctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgaatcaaagtcaccttgaacagcaatagtgaagatatcccctcagtgatgttcgaagctggaggaagaaactacatccatgcatgtcaggaagtggcaaggatcgccataggagggctccgtgatcgctacagtgatcagttggccgacactgagtatcgctaccatcctcgtcaacctcagggaagtgatcgtggcagttaccttgagactgaaggaattgagaatgatgctaccacaaggcatttggttgagatgttgtgggctagggatgaaagccgtgcagagactgtgttagcagctcaagatcgtgaagatcggaatcgtggtaagatttgtaagctagaagacaaggtggatcgtttggaaaaggaattagccgcattgaagggagaagcaccgccgcagaaggccaggattcgtcttaccgcaaggaagagagctctatttgtccctcgttatcaattggcgccaaaggttcgtgtggtggagaaagaagttgccccaaccctagcggatcctccggtcatgatcataagtgatgatgaagaagaagaatccaagcgcaacaattccaagattgagtgggtagcaactcaagatgatgaagacgagccaaatgagccttcaatcgacctccgatgcttggaagaactagagtagcttgttaagccgttgtcttagatcgttgtgttagtttgcttgctttaagttggttgtgtgtgtgggtcttgcatgtgctttacatcagtggtgggatgtaagtgcatgcgtttgtttgcttttgagtgttaggaagttggtgagtttagtggtgtgagagtcttcagtttgtaataatgaaactcagttaagatcaataaaagctaaagtaattctctgtcctaaatagtttcccctggtttctcttcttgtgccctgccagatggtgaatactcgcagcaacgggaatggtcccaacaaccccaataacaacaatggagagaatcccactcttgctcaagttcttgctcaacagacacagctaatgaacatgatgatgcaacaacttcagaatcagcagaaccaaggaaataaccatgtacctcctcagaataagttagcagaatttcttcgtgtgaggccgcctattttctctagtaccactaatcctgttgaagctggtgattggctgcatgccatagagaagaagttggatttactttagtgcactgatcaggagaaggtctcatttgcatcacaccagttgcatggccctgcctctgaatggtgggatcacttccgccttaacaggactactgctgaacctatcacttggcttgagttcaccgctgctttccggaagacgcatataccatcgggagtggtgtctctcaaaaagaaggaattcaggtcgcttactcagggatctcgctctgttacggagtatctgcacgagttcaatcgtcttgctcgttatgctccggaagatgtgcgcaatgatgaagagcgtcaagagaagttcttggaaggacttaatgatgaactttcttacccactcatgactggagattatcatgatttccagaagttagtggataaggctattcgtcaggaggacaaatacaatcgcatggagcagaagaaacgccggattgctcacttcaaagcacaacaggggagtaatcagaagccgcgtcttactttaggaccccagcctatgcctgtcgcgaccgggaaaattgccttttcccgaacgctagtgtattaatccccgtcccaggaaaggccggggtacaccacacaaacatgatatagaagacacatctttattacatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcacaattaatgcaaaggagtacaaggggataataatataggggttaagttttgcagtaacagcctttaaaagtcacttagttgcccaaagccattttataaagacgatcctagagctacacagtattattaaacaaggccgtgaaccctcacgaacctgccttaacccaaggcctacgatggttcagaccgaactggcaacccgaccctgggtcccagctcgtcccaagccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccgacccaatcccacctacggccgggatacccgggacaggcaggcggaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccattagacatgtggaagtacggtagtgctttgcaacagaggcccaagcttaatccttatagtacccgaggtacgactaacaaaacccaaccacgcacctcgagcccagcctaaaccattttgggggttttgaaaagagggggaggtgtgtgtccaattccaacataagccaaccattccatagtgtccaaatgatatgagaattcccaaagtctaaagttataaaaccacctaatgttgcctaattaaattgcgaagcatctacctaaaattaaactagtggtgccatgagtagagtgtccactagttggggttttgtttactctagggtgaacaaggaaataataacaatagcaataataataaggtcataacaagggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcgacttccacgaaaagcggatcttccgaagctgcagcgtctacacgaccaacggaaaagaaaaggcttacacactaataaactccaaataacaagcaggaacaaagcacaaaaatgggttcttgacttcttaaggaaaaattagagacttgaacggtccaattccgagttcaaatggccaagatatggccctttgaagtttatatgctctttaaatggatatttgcgaatttcttcatttaaattttaattaaaaatcccatttattgcgtcagccgagggaggggacgcgcggaccgggtccacgggggtgggggcccacgcgtcagccgctcggtccacggtggaccgggcgcacgcggctggcggcggtcggcgccgtgggtcccacgcgtcagccgcacccgcgggcgcgggcggctgacggccgggcccacctggcagccgcgagggcgcgcccgagggcggcctcgccggcacggccgacgggagcggcgcgcccgcgccccgatggtcaccgccggcgaccatcggcgcggtggagcggcgcccgagagagcggagggaagggggaaagcgaacggcggtcttcggctcaccccgggacaacgacgacgacgagaacggcggccggagcggaggaaagcggcggcgcggttcgggatgacgatgacgacggtgctccggcggtcggcgggcgaagcggagcggcggacggggtcggcaaccactcggcgaagccgatggaggtggcgccgagtcgggaggaggaccggagcgacgacggcggcgaaacggagctcggcggcgacggcggagagagaggagcacggcgcgggcacgaaaccgacggcgagagcgagcggcgagcggcggaaacggaagagcgaagcacgagggacgattttatagcgtcggaagggagagaaggcggccggggaggaaggaatcgcgcgcggagatctcggccgccattgaagacgccggcgatgattgcgggattcaaatcggacgaatccgagggagagagagagggaaaagagggggaatcgggagagggaaacgcggggagtaattcgcccctctttatggcgcgcggggaaggcgggaagcggcggattcggcggcggcggcggcgctagggcacgggcggcggcgggcgcggcgcggggagggagatgacaggtgggtcccacccgtcagcgagagtggcgggcgggcccgcctgtcagcggcgcgcgcgcgcgggggaggccgatgggccggaggggaggagagagagagagggagagaagtgggccgagccggcccaagagaggaaggggggggaaaaaagaacttcttttagggttttctttttataaaaccttttcaactttgtttatttcttaataattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacaaatccaccccccttacaggaatctcgtccccgagattcgaggatgggttgggcggtcttctcttcttgtctgacttcttccgtcgcgtcttttataacaaacttgcctagcaaaacttctccactctggactgcttggctcgatctcctattgcagatggaatcttctcttcacctgacttatccctggttgaacctttagctgacttcgactgggttgcggcacttgaagatggggattcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagggaaccaacttatcccacttgatatactttgacgtcttcccaaatagttttactgctggacttcttattgtctgatcgttatccggccaaatttgaagcttcgttgttagatgtgattttactctgacctctgtagactatcttcgatcatatcacttggttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctcccaagacatggcgtcgcctggtaaccggggcttgcacttttcactccgtgtagcgtctgataccgagttgaagatttcactccttgccttcatagaaacacttttacctaggtcatcttgcttacttaatgacaaggtgactgttgtggggcaattacaattaggggtcttccttgagcgatgcagagcatgtttctgtttatcaatcacctttcggcctacttctttgatgctagagaacatctttgccaatctcttttatcaatcttctttcggcttatctctaacagggggtattctttaatgtggattgcggacgcttctggggacgatgaggtcctttggcttgctgcctttcagtgaaaccttgatggggttcgtcaaaaactatactgactgtctttgcctttgatccgaaaaagacacatctgaaactcttagtccaaacaaatgtctctttggttgatcacttgattttcttttccatcatcaggttgggtattaactcgaggttagaacatagttcctctgaaatgagaccctaggtctcctttgacagtaaccaattatacacataatcccatatcagcatcttccaaaagaacccccatagaacttgtctgtattacacatttctctccttattacatgaatacaaggcactgctttaaacaaaaagggaaggtgcttaacatcggtacattgtttctgctatggattctgattaacacaaggcctcacgggtacggtgtttgctccagtgaccacaatacgattgggatgtctgattcttgtaaattggcggtaatgtggaggtcgattttgccttggttgcaggcagtccctcgagtaatgccctggttctttgcaattgtagcaaatcaacgtcttctttgctgagctatccgtctgaggacgatcattctgacttggagttggaatcggtggttggaaatccttgctaacattggcatcagtggtaccatagttgctatcaccattggagtctttctcagtgtcaaaattgctaaggttgtcattctgggttccaacattgatactatcattgacatcttggtgaatgctactgacattgcacgctttattcgagtggtcactaatggggcaagaaccatggttgttggtggtatcatcatcattagtattgctagtgttgttgtctgcatcgcgtccgtcttcttggagcaggaactcttgatgcacaacagaagacccggtgatctgaagtggctcagtgcgctgcctttggttaccacatggaattactgggatgttgacaatccttctcttgcagttcgtcattcgattatgctcactttcgagttgcatggctttgtccacaagtttctcaaaatcttcataatcctctaggagtagttgcactgcaagttcatcttttaacccctggagaaacttctcttgtttgtcttcatccgtttccacatcttctggtgcatagtgagccaaacgatagaactcgtgcaggtactctgtgacggtcaaatccccttgcttcaggtagcgaaactctcgttttcttagtgtgatcattcccgcgggaacatgtgatctcctgaatacagaggaaaactcgttccaggtgatggtatgtccttctggccgtgatgcctcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggtttcgttgatgcttctctcattcccattggcttgggttcttgagtcatcggatccatcattcccatagcctttgttaccagtattatccatctgtcacaaggtagaggttgagagggaaagcatacaaggaaagaatagaccagaactagggacaagaccttacaggaactaactctttttgttgatgtgttgtttgttttgcttattctgcaggttgattaagcaaacaacctagcatggttacatcacaacccactgatgcaaaccacgcgctacacacacaagcaaggaacacacgactaacaacactaccctatagggtggcttaggttctgcgacgggttcccaagatcttcactccttcacagctggcttcactgcttcctgcactttctcaagcggatcctgcagtcttccggagcttcggcaaacaactgacgacatcttcttcttcgcaaagctgaccatctagtactaattgaaatttgaagaaggaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaggccggggtacaccacacaaacatgatatagaagacacatctttattacatcgataatatttacattattacaaaggcgcttcaggcctgacaatcaaaaataaacagcagcggactagcgggcctacggctccatcttcacaggcgctcaactgggggtataagccaggactccacctaagacatcttctccaaa

SEQ ID NO: 8875 - DNA, 12301 bp, Oryza sativa
tggcggcgggcccgcctgtcagctgcgcgcgcgcgcgggggaggcccatggtccggaggggaggagagagagagagggagagaagtgggcctagccggcccaagagaggaaggggggggggaaaaagaacttcttttagggttttctttttataaaaccttttcaactttgtttatttcttaataattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacaatgccacagggaggttcttcgtctgttgttcgtccgcagcgtcagttcttcaacaacaatgttggcaacaacatccgcaatcaagctctacgccctgttgcagctccaacacagcaacaacctgccaagagggagcaaggcagcaagcccgtggtgtgtttcaactgtggagacccaggacattatgctgacaagtgtccgaagccccgacgcatgaaggttgtccctacccagagcaactctaccgtaccagcatcaaaggcccgtgttaatcatgtcgctgctgcagaagctcaagatgctccagatgtgattttgggtacgttccctgttaactcagttcctgcaacagtacttttcgattctggtgctacacattcattcttatctatgagttttgcgggaaatcatgggatggaagtagaagatcttagacgtcctttgatggttagtaccccaagtaattaagcactctctttgcaacgtagcccctcggtcagaatagaaattaaaggagtaccatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttctgagtctttaaggtcaagattaaaccaaataactttggaagagattcctatagtccgggagtatcccgatgtgttcccagatgatttacctggtatgccgcctaaaagggatatagagttcagaatagatttggtaccaggaacaactccgatccataagagaccttatagaatggcagccaatgagttggcagaagtcaagaggcaagtagatgatttgcttcagaaaggatacatcagaccgagttcatctccatggggagctccggttatttttgtggaaaagaaagaccatacccagagaatgtgtgtggactatcatgcattaaatgatgtgactatcaagaataagtatccgctacccagaattgatgatttgtttgatcagcttaaaggtgccaccgttttctccaagatagatcttcgatcagggtatcaccagttgagaatcaaagaggaagatatacctaagacagcttttaccactaggtatgggttgttcgaatgtacggttatgtcttttggacttaccaatgcccctgctttcttcatgaacttgatgaataaggtgtttatggaatacctagacaagttcgtggtggtctttatagatgatattcttatctactctcgaaccaaagaagagcatgaagaacatcttcgccttgcattagagaagctacgagaacatcaactgtatgctaagtttagcaagtgtgaattttggttgtctgaagtgaagttccttggtcacgtcatctcagcaggaggagttgccgttgatcctagtaatgtggaatccgtaactaattggaagcaaccaaagacagtttcagagattcgcagttttctaggcctcgcaggatattatcgaaggtttatagagaatttttctaagattgctaagcccatgacacgactgcttgtcacgaccggaaataacccaacgggcgttcttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaaggtatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaaaacacatcttcctcatgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataactagactgagccacaaactaagccttacccactagacatgtggaagtacggtagtgctttgcaacagaggcccgaaaaccggtccttatatggccgaggtgctactatcaaaaccatgcaccccgagcccagcctaaaaccattttggggattttgaatagagggggcggtgtgaagccaattccacaacaaccaaaccattccaaagtgtccaggtgatatgaatattcccaaagtctagagttgtaaaccgcctaatgttacctaattaaattgcgaagcatctacctaaaattatactagtggtactatgagtagagtgtccactagttggggttttgtttattctagggtgaataaggtaataataacaataacaataataataaggtcataacaaaggtaaataggcatggctaaataaaacagtgataacgcgggaatttaaataaagcgataatgcaataatttaaatcaacctaattttgtaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaaccccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcagcagcctcacggtccacggtggaccgggtgcacgcggcttacgccggccggcgccgtgggtcccacgcgtcagccgcacccgagggcgcgggcggctgacggccgggccccacatggcagccgcgggacgcgcccgaaggcggccacgccggcacagccgacgggaggcggagcgcccgcgcccctctggtcgccggcggcggccataggcatggcggagcggcggccgagagaggggagggaagggggaagcgaaacggcggtccacggctcaccccgggtcgacggcgacgacgggaatggcgaccggagcggaggaaggcggcggcgcggctcgggttgacggggacggcggcgttccggtggtcggcgggcgaaacggaggggtggacgaggtcggcgaggtcgcggcgaacccgaaggaggcgatgccgaagcgggagaaggtccggagcgacgacggcggcggaccggagctcggcggcgacggcggagagagagagcgacggcgcgggctcgattccgacggggagagagagcggcgagtggcggaaacggtggagggaggcacggggagtgtttatatagggttgggagtgagagagggcggccggaggagaaggaaaccggcgcggcgctctcgggctccatcaatggcgccggcgagatttgcgggagcaaatccgcccgtttgaacgcgagagagagagagggaaaaatggggggaaagggagagggaatcacggggagtgatttccccctctttattgcgcgcggggacggcgggaggcggcgggattcgcggcggcggcggcgctagggcacgggcgaggcggcgggagcggcgcgaggtaggggatgacgggtgggccccacccgtcaacgagggtggcgggcgggcccgcccgtcagcggcgcgcgcgcgggggaaggccggatgggccgcgggggagaggagagagagggagggagctgggcctagccggcccacagggggaggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttcttctaagcataattttgaggatgtgttttagagtcgttttgggacgcgacaaacctacccccgttaaacggaatctcgaccccgagattcggaagaactggcgaagagatcgggatgggctgccttcagctcgtcttcacgctcccaggtagcttcttcctcggcgtggttgctccactggaccttgcaaaaacggattacccggttcctggtcctgcgttccatggtgtccaggattttcactggcttctccacgtaggtcaagtcttcgcgaacttcaatttgctctgagtcggcctgctcggatggcactcgaaggcatttcttgagttgcaacacatggaacacatcatgcacgttgcccaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccatacaacgcttcatagggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatctgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgccacgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgatcgctctcgccgtcggtttcgtgcccgcgccgtgctcctctctctccgccgtcgccgccgaccttcggttcgccgccgacgtcgctccggtcctccgcccgactcggcgccacctccatcggcttcgccgagtggttgccgaccccgtccgccgctccgcttcgcccgccgaccgccggagcaccgtcgtcatcgtcattccgaaccgcgccgccgctttcctccgctccggccgccgttcttgtcgtcgtcgttgtcccggggtgagccgaagaccgccgttcgctttcccccttctctccgctctctcgggcgccgctccaccgcgccgatggtcgccggcggtgaccatcggggcgcgggcgcgccctcgcggctgccaggtgggcccggccgtcagccgcccgcgcccgcgggtgcggctgacgcgcgggacccacggcgccgaccgccgccagccgggtgcgcccggtccaccgtggaccgagcggctgacgcgtgggcccccacccccgtggacccggtccgcgcgtcccctccctcggctgacgcaataaatgggatttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagccttttcttttccgttggccgtgtagacgctgcagcttcggaagatccgctcttcgtggaagttgaagccggcgtttgggaaagcgagcaaggcaagtcacgtcacccttgagcatattgaatcccagtttataaaattattttgatttaaattattgcattatcgctttgtttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctccccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcagctttgcgaagaagaagatgtcgtcaattgtttgccgaagctccggaagactgcaggatccgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacatcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattcctcccgaggtgcacaacagttgacagagcatcttttagctaatggaggtagagtgtctggtagtgaagattcagatcaagtctcctcagatgatgaagatgcgaagtctccccaaggctttaaccagaataaaatagaacttaaggcatgctctcgttgtggagaaatcggtcatgttgccagctcgtgtgcctctacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaaggtcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacaggggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgctcaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacataaatatattcatgtctataaacagtgagcttgctatgcttatggatgattcatattgagaatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacttagggtctcgtgtcagaggaactatattctaacctcgagttaatagccaacctgtggatggaaaagaaaaacaattaaactgtgttgggttaaaaagctaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcagacaatgtatttccctgaaggtagtcagtgcagctttttgacgaccacatcaggtttcaccgaaaggcagcaagccaaaggacctcatcatccccagaagcgtccgcaatccacattcaa

SEQ ID NO: 8876 - DNA, 587 bp, Oryza sativa
ggctcggggcgggcgatgtgacgggcggcgacgcgacgggcgacgacgcgacggcagcgcacggggctcggggcggtgacgcgacgggtggtgacacgacgggcggcgatgcgatggcggcgacgcgacgggcggcgatgcgacggcgtcgcatagggctcggggcggcgacgcgacggcgacggcaacggcgatggcgacggcggcacggggctcgaggcggcgacggcaacggcgcgacggcgacggcgatggtgacggcggcgcgcggctcgaggcggcgacgcgacggcgcgacggcgacggagatggcgatggcggcgcggggctcgagacggcgacggcgacggtgtgcggcgatggcgatggcggcgcggggctcgagacggcgacgcgacagcgcgcggcgataggacggcggcgcggggctcgagacggtgacgcgatggcgcgcggcgatgggacggccgcgcggcggggtgcaggcgcgaggcagaggagggggcagagctaggggacctctgtcacgtcctgataaattcatcccgaaataaaaatcattttctaaaaggaataatagaattaat

SEQ ID NO: 8877 - DNA, 956 bp, Oryza sativa
tcccaataatccaacaattccaaagtgtccaggtgatgaaaaatatccgaaagtctaaagttgtaaaaccacctaatgttacctaattaaacagcgaagcatctacctaaaatcatactagtggtaccatgagtagagtatccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactaggattcaatatgttcaaggatgatatgacttgccttgctcgctttcccaaacgccggcttcaacttccacgaagagcggatcttacgaagctgcagcgtctacacgaccaacggaaaagaaaaggcctttactctaataaactccatataacaagcagaaacaaagcacaaaaatgggttcttgacttcttaaggaaaaattagagacttgaacggtccaattccgagttcaaatgaccaagttatggccatttgaaggttatatgctctttaaatgaatatttgcgaatttcttcatttaaattttaatttaaaattggatttattgcgtcagccgaggggagagggcgcgcggaccgggtccacgggagtggggcccacgcggcagcctcacggtccacggtggaccgggtgcacccggctcacaccggccggcgccgggggtcccacgcgtcagccgcacccgagggcgcgggcggctgacggccgggccccacgcggcagccactcggcgcgcccgagggcggccaagccagggtggccaagccagcgcgggaggcggcgcgcccgcgtcccgatggtagccgccggcgaccaccggcgcggcggagcggcggccgagagaagggagggaagggggaaa

SEQ ID NO: 8878 - DNA, 5646 bp, Oryza sativa
ggtgcatccccagttggctcccaacctgcctcatacatctacacgggtattgaggatgatgaactttctcgttcgttccttgtcatgttgcgcgtctccttgtatgttccacctgcacgagattcttctatggtctgcaggggaatggttacttcatggcagttgtacaaatgatatcccgcatttggcaacggaatttcgtttgtacaaccagggaaaaagtaaatcaaagatccatctgctacatgtttcacaatatgcccttgcactagataagtctcatcaacacacggacgagcggctgagataaaagcaatttggtcgccaatgacccctagcccttttgctatctgagtaatcagagaagtgcactcaacaggagcagagaactttatactttctaaccattgccttgtcatacatttcactggagcaattttgatctttctaaccatggcaaacatgataatcaattcatctcctctaatgggtctcagatcacctctaggaaacaaagtcatagcaatccatttgtgcttgagcctaagtgtagtattatggatatcattcgtcctaggtttcttgcaaattggagcaccagaaatatcttcccaaatcctattttctcgaacccagaaattcctttctggagatcgattttacaggaatcgtgaaaacccaagaagtgtacttaagcctttccatgtaagtgtaaacacttcacagaaaaagcgaaaggaaattccatcctctatttctttcaaagtgcacaaaaattgcaaagtaagcaaacgagaaccaggctcatctaccacagcaaatctctgccaaccaacagcttctcaaatagtacgaaattcagcatctatacctatcttttttagcaactccgatgagtattctcgcgtgtgagtatactcctagtcgctcagaatgcagtaggcccgtactttatcctgatcatggagcattgttccatcctcggttgaaactcaaacttctcttccttcccattgatgtggaaacagataatccccattcccacgtcaatgttggctcctgcggtgctaaggaaggtgcgccccaggatgagcggcgtctctttccccgtatccatgtccagcatcacgaagtcaaccaggatgaagaaatcacgtatcttgactggcacatcctccgctatccctgccgagtaatagactgacgaatcagccagttgaaggcgcattggtgttggtgccaacaccgtgaagttgagcttgtcgaagacgtcttttggcatgacgctgacactggctccaaggtcgcacaaggccgggtcaaactgttgtgccccgatcgagcaggtatcgtaggacaccccggatctttcttcttctccgggagcttgtggagtattacgttgctgcattgttccatcagcttgaccacctccattgttgggagctgtctcttattgttgagtatgttcttgagataacaggcgtatgttggcacttgtatagcatccaacaacggcacgttgatgtggattttctggatttcttcaataaaacgagcaaaatgcttgtctactgacgatttcctaatccgttgaggaaatggcagcaaccgcgtgtcgcagtactcttgcggcactgtcttttctggctgaacatccttgtcagccgagtctttagatggcgcttcttttgatatcccattaattcctgtagggttaggatatggcggatcacgagtggacttacctcccctcgtcgtgattgccttaacattttcaatggaggagtcgggttgccccggaatcctcctagtttcatttgtaaggactaaggatgccaactgagttaactgggtttctatcattttattaaagctcagcttattttgaaaagcagaagcaaagccatctaatttgatatttatgttttctagaaccttgtcattggttgcaagctttttgcttagcgcatcggtggttttagcttgcgcaaaaacgagatccttcaaggagggctggttagaaaagttaccgttgttgttacctccttgataatatgggcgtggttggttccaccccagacctccttgtggaaggtacccgttgttgttgttgcccatgtacatcgcctcctcatgggtttccgggcagtcattcccagaatgacccgtgttgccgcagacctcacatgtgacgtgggagtccaaggccttgacggtgccttgtggccatttctcatggtcgtccaatcgcttcatgaggagatccagcttggcagcaagtaactccgtctccttgacggtgtgcatgcctcgctaacgggtctggagtcgttcctcgctccaacccatattggagaccatcttctctattagatcaacggctccttgaaccgttttagagaagaatgctcctccagctgccgcgtccaggtgatctcgggacatcggggtgagtccgttataaaagttctgcaggatcagccagtcatccatccaatgatgaggacaggcggccacatactcctacagtcgttcccatgcttccagaatagactcgtccctcatctgctggaaacttgaaatccttccacgaagggcattggttttgcccatcgggaagaatttcgagaggaatgtcgtagagcatttgtcccaggtattgacagcagcacggttggcatagaaccactacttcgctctcccgagaagggagaacggaaacagtcgcagcctgacgacgtcgggactgacgcccttgatggtgtacgtgctatagatctctaagaactgttgcagatgagcattggcatcctcattaggcttgccacagaacgggttagcctgcgccatcgtgatgaggctggacttcaagtcgaaatccatgtctcctatattgacctgcagcctaatggccacattgtcagcagagggagcagcgaactctcggagagtcttgttagccatagtcttgaaggtcggtggccctggtacggccggtttatctgtcggtagagttttctgcggagcagcgacttgcggcctgacgctccggaagaaagcttctagatattctttgaagttttccggcaagttgaaaccagtcatgcactaccctgttttcacaacaaaagtgaaaacaaccaaggttaacctacaaaggaaaatgattatacagaagcaaatataaaatattagtccaagtaatctctattatgaatctttcctggcaacggcgctagaaatgtttgttggtatttctcaacgacattactataaatataattcccagcaatggcgcagaaatacttctgatatatattatggttatagagttcatccgcaagcgcacggatataccattgtaccatttcacctgagagtattctaggggtatcgtatttattttatcccgtgggaagatcatgtagagagaacttaactaataatctatatattgcttgtgacagtcatattctaagtaggggttaagataatccaagagtagaatgacacacaagcattaactactgtcacaccctgaaaattcaaaatatataaattgttgtttaaatggaatttttagaatttattttaaaagcctaaaagagaagatctagtttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagtccggcccagtccgccgctgcgcgcgcgcgcgtccgcccgctgacaggtggggcccacctgtcagggtcgtcgtctacctccggccgccgccgcccgaaaccctagcgcgccgccgccgccgtttccttccaaatctggccgctcctttccgtctccgaccgaattgatagaggggaaacaatcctcgagatctcctctaccttttctcctttggaaacatcggctaaatcggtttggaaatcgatggattcgagttcgaatcggatcggcttttctctctccgagctcgagctttccatctcgtcgccggtcgccgtgggccttcgccgttgcctcctagcccctttaaaaggacccccggtgtctcccctacccgccgccaccttcgccttcgcctctcgtcgtccgtagcgccctagcgccgtgtgccctagcgccgccgtcgccgccgtcgctccagccgtgcgccaccaccgttccagacgtcgccgtcgctcgggaagaccgccgtcgtggtcgccaagtcgtcgccgtcctcgtccgccgcttcgccaccgtcggagaccgccggagcatcgtcgccgtcgtaaaaccgaagaccgccgccgtttcaacctcgtcgccgtcgccgtccgttggtcttccgccgtcgctttggtcgccggtgagtttgccgtgccgtccgctacccgttggtgccctccgttcgtgccgaagcgccgccgttcgccggcgagcttgcgccgtccgagctgtcgagccgccgagccgccaccgccggtggtgacgtcatcgctgacgtcatcgtccccgtcccccgtgaaccggtcgtggaccgatcgatctcggccgtctgttttggatggattgatcttggccgtccgttctcgtgaaccgccgccgtgcgcccggtccaccgaaaccctagcccgctgacgcaataatccttctttttccttttcaaaaataattcattattgcgtcataattcaattaaaatcaatttaactgttttaatccgatttaatcttcaaaaattcataactaattcatcttagctccgatttagttggttcaagtctctaaatttttctaaaattgagatctacatgttaaaaatatccacatgtactgttcaagcttgtttatgtgttgttttggtgtttttgctcttttctgtttagattccgtcgttttcggagagtccgttttcgccggagaagagtttgaagagttccaaggccagcaaggcaagtcacatagatcccaaacaacccttttgagcatattgatcccgtttaaagctactgtttctattcaactattgcatttattttcgaatgtcattgggtggaattaacctattgtttgttatagcccttttgttcttgattaccttattccttgataccttgggttattacaatttgactagttgagctttatttatattggttcaactagatattagatataattgcttagccctgcttagaaacattagcacactattgggataacttatgaatcactataatttaatgatggcttaatgatagttcacgatggtcaatcatgattggttaattaattaatgtgccaactaaaacctggtaatggtgggttgtgagcacatggttttgatggtcatgctcatgacaattaagaaccggttcacgagtttcggttgtgaaacattaaccgtgccaaccacaagccagcgtgggcaacggctttatcttttgtaaagcaaggttcattgcggggcaacagactgagaagtggcggaaataa

SEQ ID NO: 8879 - DNA, 1355 bp, Oryza sativa
  unsure (1)..(1355): unsure at all n locations
ttctcttttatttaaccaaactaatggcacatgcacttcataatctcttttaatggttctcattcaanatttattccagtgttattagtactgtacatctattactgtactaatggctcatttatcagcaaaagttttacaatattgttttatttaatcttgctgcaataaaataaatttagcatgttgattttataactttcttttatctcttttgaaacctgttattcaaaagttcaaaactggtgaccttgtttccaactgtttcaacttatcttgcaagcttggtttactttatttacttacctttttactttgattttctaactctattcaaattaatccaaaaacttatgctattaattggataaatgtcttaactccctcctttcacttgtctttagatgccgcgctacaagcctgagtacttgtttggggttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgttatagtgatcagttggccacactgagtatcgctaccatcctcgccaaccccagggaagtgaccgtggcagttaccttgagactgaaggaattgagaatgatgctaccacaaggcatttggttgagatgctgtgggctatggatgaaagccgtgcggagattgtgttagcggctcaagatcgtgaagaccggaatcgtggtaagatttgcaagttagaagacaaggtggatcgtttggagaaggaattagccgcgttgaagggagaagcaccgccgcagaaggccaggattcgtcttaccgcaaggaagagagctttatttgtccctcgctaattaaatacacagatatagatagatagatagatagatagatagatagagagatagataggattacagacattattgtgaccgaatcagtaaaaatccacacaaagaaatattgcattggagtccggccagaggagatgctccatgacatggcttcaccaaggcatgctctgtgcgattacttgtgccagccattgggatcttctttttttttttttaaggaacacgacggcagaagctgtgccggaatttaattagaaggagagaaaagtgcttacagtccagagaaaaacattaacaaaccctcaagggggcctaaaaaccgatctacagagatccaggtcttgctttacaa

SEQ ID NO: 8880 - DNA, 16209 bp, Oryza sativa
tggtgggcaagtgtgaagcgtgaaatcgcagaatacgtaccagtatgtgatgttcgtcagcgagtcaaggcagaacatcagaaacccgccggtttgttgcagcctttgaagattcctgaatggaagtgggaagaaatcggtatggattttatcactggtttacccagaacgtcatcaggccatgactctatttgggtgatagtcgacagacttacaaaagtagctcatttcattccggtaaagacaacctattccggaagtcggttagcggaattgtatatggcaaggatcgtgtgtttgcatggcgtccctaaaaaaatagtgtctgatcgaggcagtcagtttacttcaaatttttggaagaaactttaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtctacagatggctccgtacgaagcactgtatggtcggaagtgtcgcactccgtacgaggttgcctatcagttagagttacctcaatctttggcaggagtccataatgtgttccatgtgtcgcaattgaagaagtgtttaagggtacctaccgaagaagctaatcttgaacagatagaagtccaagaggatctgacctatgttgaaaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacaagattctgtttaaggggggtaggtttgtcacaccctgaaaattcaaaatatataaattgttgtttaaatggaatttttagaattaattttaaaagcctagaagagaagatctaattttaattaataaattccaatataaaatggggctagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatctctcttctctctctcctcggcccagccggcccagtccgccgagcgcgcgcgcgcgtccgcccgctgacaggtggggcccacctgtcagggccatcgtctacctccggccgccgccgccgaaaccctagtttcgcgccgtcgccgtttccttccaaatccggccgctcctttccttctccggccgaattgtttgaggggaaacaatctccgggatcttctctaccttttctcctttagaatctttggctaaatcgttttggaaagagttggattcgagttcgtctcggattcgttcttcccaatctttccttcctcgtcgccggccgccgtgggcctttgccgccgcctccgagcccctttaaatggacccccggtgtctcctctacccgccgccacccttgccttcgcctctcgtcgtcggaagagctctagcgccgtgtgccctagcttcgccgtcgccgccgccgctccagccgtgcgccgccgtcgtttcagccgtcgccgtcgctcgggaagaccgtcgtcgtggtcgccaagtcgtcgccgtcctcgtccgccccttcgccgtcgccggagatcgccggagcctcgtcgccgtcgtcaacccgaaagtttccgccgtttcctcctcgtcgccgtcgccgtccgttgatcttccgccgccgttttggtcaccggtgagttcgccgcgtcgtcctctacgtcttggtgccctccgtttgcgtcctagcgccgccgttcgccggcgagcgtgcgccgcccgagccgtccgctccgccgagccgccgccgctgtcggtgacgtcaccgctgacgtcatcggggtcgtccgccgtgagccggtcgtggaccgttcgatctcggccgtccgttttggattggatcgatctcggccgtccgttcgcgtgaaccgtcgccgtgcgcccggtccaccaaaaccctagcccgctgatgcaataaaccttcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatacttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattatttctattcaactattgcatttattttcgaatgtcattgggtggaattaacctattctttgttatagcccttttgttcttgattactttattccttgataccttgggttataataatttgactggttgaactttatttatattggttcaactagatattagatataattgcttagccctgcttagaaacattagcacactattgggataactataattcacttttatttcatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcgtttgtatagcatagttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacgatgacgtcagcggtgacgtcacctccggcggcggctcggcgactcggcagctcgggcgcacacgctcgccggcgaacgacggcgcggcggcgcgaacggagggcacccacgggtagcggactgcacgacgaactcaccggcgaccaaagcaacggtggaaaatcaacggacggcgacggcgtcgaggaagaagcggcggcgaccttcggcttgacgacggcgacggtgctccggcggtcaacagcgacggcggaggggcggacgagaacggcggtgacttggcgaccacgatggcgacctccccgagcgacggcgacggctggagcgacggcgaagcacggctggaccgacggcgacgacggcggctcgaggttacacggcgctagggctcttccgatggcgagaggcgaaagcaaaggtggcgacgggtagaggagacaccggggatccttttataggggttgaaagacgacggcgaaggcccacggcgaccggcgacgcgaaggaaacctcgggctcggagagagagaccgatccgaatcgacctcgaatcaaacactttccaagcgattttagccgatgattccaaaagagaaaaggtagaggagatcccgaagattgtttcccctcaattgatttcaccggagaaggaaagatgcaaccaaatttggaaggagacgacggcgcggctcggctagggtttcgggcggcggccgctggaggttgacgacgaccccgacaggcgggacccacctgtcagcgaccagacgcgcgcgcgaggcggctgcggactggactgggccgacttgggccggggagagagagagagagggttttgggccgactttcggcccaaagccaaaagagactttttaaaaacattttttaatttaaattattcctgaaatgcaattccatttattaaaaatacttccttagctcaaataaatcctagaaaaatctaggaattatagaattaagcaaagtatttaataaaattttatctggccccattttatattggaatttattaattaaaattagatcttctcttctaggcttttaaaataaattctaataattccaattaaacaacaatttatatatttttggatttttaggatgtgacagcggtcctcggctcaccctaggtcgacggcgacgacgaaaaaggctgtcggagcggaggaaggcggcggcgcggctcgggtcgtcggggtcgacggcggtccggcggtccgcgggctcagcgaggggttggacggggtcgacggcagtgcggcgaagccggaggaggcgacgccggggcgggagacggtccggcgagcggagaaggccggccggaggtcgtaggcgacggaggagagagagagcgacggcgcgagctcgattccggcagggagacggtgcggcaagggcggaaacgggcgagggaggcgcggggagggtttatatagggttggaagggggagagggcggccggaggggaaggaaaccggcgcggcgctctcgggctccatcaatggcgccggcgggattaggggagggtttccaaacgaatccaagggagagagggggggaaaattggggggaaagggagagggaatcacggggaataattcccccttattgattgcacgcggggaggacgggatgcggcggattcggcggcggcggcggcggcggcgcttggcgcgggcggagaggcgggagcggcgggaggaaggggatgacgggtgggccccacccgtcagcgagggtggtgggcgggcccgcccgtcagcggcgcgcgcgcaggaagaggctggatgggccgcgggggagaggagaaagggggagggagatgggccggattcggcccaagagagggaagagggatttttagggtttttcttttttaaaaccttttcaactttgtttatttcttaataattattatttgtgctctgaaaattccactaaaatttatttacgcattttaagcttttaggaaatttacaaaaatcctctaagccttatttggcttttaactttgcacattttaattgttggtggggttgggttggtactcttgtttatggctaggatgggttggaaactatgtcatgtcttccgtccggataccgtggtggtatgtggccgcgccctcggttatgggcaagccgagcaatgtacccaagttagtgtttttaattcttaacacctgcttaacaactaaaatgtggaatggttggcctgggttggcttgggacgagctgggacccagggtcgggttgccagttcggtctgaatcatcgtaggccttgggttaaggcaggttcgtgtgagttcacggccttgattaataatcttgtatagctctaggaccgtgtttacaaaatagctttgagcaactaagtgtcttttagtgctgtttactgcaaaccctaacccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaaccatttacgcctccgcttgataaactctgaaatgtatcaacttttggtgtaccttgcctcctgggacaaggaataatacacacatgtaaggaacgcccgttgggttatttccggtcgtgacatatttctccgtatttagccccggttgtatggttatgacgggctgtcgtaaagaactcggcagtcaggggtggctcctcgaagtaccaggagggcatcggaaagagggtattagctagtatgttggttaactagaatgtatgtatactatgtatattagaagtatagtaatagattatctttctattttcttcctacctagcttagataatatattataagaatgagtagcttatgcttgtgtgttactctacccttggattatcttaacccatgcttagaatatgattatcacaaataatatataaattgttagtcaagttctctctatatgatcttcccacgggataaaataaatacaatacccttggaatactctcgggtgaaatgctacaatggtatatccgtgcgcttgcggatgaactctgtaaccataatataccagaagtatttgtgtgccattggtgggaattatatttctagtaatgtcgttaagaaataccaacagaggggagaattatacccgaacgagtaagctctccgcagccgcgcaccctacgccgaactcattatgctcggtgatgggactagggccaccagatggcgaaataatctggcagaccccttcaacaaagggaccgatctccggtcgggaggtgaagtcggcagagacaaactggggcgcggtgagtgtcatatcagacactgtcatttagatcgccactgcctggccctctcgctggcgactcgccgaaggcaatgtcacagccccaccagcgccagaggctttcgccgtcgccagttgcaatgcctggtccgaagcaacagcgttggccgaagtgctgcccccggttggcgcgtcggcatcactagcaggcagtggagacaggagcctcttttgtggaggtgggtgtcgtggcgccgacgaagttggcatcccatccgaagatgtttcgctgtccgagaagccaccggccacctgcaccacccctttcttcttcctttgggcggcggcaccggccttcgacgacgagccagtgatggttagcaacgcattagcactagcgatgttttgaggacgcgtgggcgaagcgctagagccggccccagccttcgcccgaacagggcttggggtatagccgtgtgacccagcatcgtcgtccgacccgtcttccctctcatcgtcgttgtcgtcgtctgcgttggtctccacggcgtccttggccactcgccgagttcaaacctggcttctcttggccacgtcgcgcttccacttttttgacgtcccaacgtcgtgatcgactctcgcagggttcgcccggctggctagcgtgccgtcgtagacgcgattcgcctgtccattggactgttactgaagcaggcgagcgtactcggcggtaattaaacccccgatcattttcgccgactcagctttggcatcctccagcaaacgaactaattaaaaaggggaaagatgacaaaaattatataagcccaaacaagccccaagatgtgagatatcgaaggaggggagggaagcttatgattgatgccaggaggaagcacgaggcgggaaagaccgagcacttcttcaccctctgcggtagtaatcccccaatctcgcgcgaggggagaaatctgtagcatgcaaaatttttcgcagaggtcgcgggtgctcaaccgatgcgcaaccttgcgaagaaggatgagccgtgcctcaagcacgccatcaacatccacgttcggcttgatgatcatggcgatagaaagacgccggaagcgaagccacttcgccttgtcatcttcggcggaatcgtctttggagaagtaggggttgtcgatgtagaaccatttttgcatcgaattgcggtcccactttgccatcgacacaaggacaggccatgcatccgagcgctttggccgaagcatgaagtttacactgccaaaaacagtcttctttggccccgccagagtgttgtcgtccttggtcgccacgcacaccatgaacagggtggcgaagagctccgcggtaggagtaaatccacacgtccggcacatccagacgaacacgaccaagttgagaaatgccgatgggctgagctaggggagcttgatttcgtacaactccagcactgatggcagaaagttgtcacatggaaggcggagcccggcggtgaaaaaggcggcgaacaccaccgttcgcccgtccccggtcgaagggacaacgtcttcgcccgcacaggacacctggcgctccgcaaggacgctggagaggacaagctcggccaggtcggcctccttgacaagaaacttgccaaggtagcacgaccaaccatcgctgaggctgccagggtcttcgccagacgatccggccttagtaggcttgcgaggagccatcgaatccgcgatgaaagaggtggcgaagacaggaggcgaaaagctagagcaggaatgatagggctgaaggcacgagagtctgacagcggtaaaaacgagaagtggggaggagtgatagcgacctgggatgagggttgtatagcccgatcgcacgacggttcgactcccacccaaccacagcctgacacatgtcaaatggtagacggaacggtaaattcccatcgagccgggccacacagtggcaggctagaaccaaggaaaaccaagaggcccacggagcccgatactgttcactttcaatttcaaaccacctaaccatttcgccataacttgggcgaaataagaaaagattactaacacaggaactaagctctttgtaggtgcaaaaggataggtttcagtaggaacatcggccgaaagggggcgcctcatgccataccacacaatttgcatttgcacggtatcggccgaagctccctacttacccttgcccgtgaggggcttgttggaggtataccacgagggccttcggccagacctgccgaaaccgttgtcacaccctgattttcgtcttaggatttataaatcatttaataaattattaatagaatttatattaaatgttcattaatttacaagtgaagttaattgtgggaaataaaatttcctaaatataaagcatggatggatttaattttttattaaattctccatggttaattatactctctggaattttctcggattttttcggagctcaattcctaaatgatacaaagaacagttcagtaattatttgatcaataatgatctaattataattgttaagtgcttttcttgcttaaaatccttaaattataaattgttgtttaaaaggaattattagaaatgattttaaaagcttaaaagagaagatctaattttaatttggtaaatctcaatataaaattgggttagataaaattttattaaatactttgcttgttcctctattttctagaattttctgggaattgtttgagcaagggaagtatttttaataaatgaaacatcatttcacgaattattttaattggaaaagtttttaaatcctcccctaagtcgttgggccgatttcggcccaactcttctcttccccgcgcggccgaatcggcccaagccggcccagccgacgccgaccgcccctcctcctcgggtcaccgacatgtggggcccacatgtcggacccatcttcctcctccagccggccggctgcaagccgagcccaagccgtcgcccgagccgccaccttgcgccctcaaatccgcatccaatccggccctttttcttccgtttgtttgaggggtttttatccccacatcctcttctatctttcccctcaagaatcggagcaaatcgttgggtattttgcccgaatcaaactcgttttcgagtttatccccaaaaaccgagtttagattttcccggagcgatttcttgcgggtggagtccgatctcttcaatccaaggctataaataggaccacctcgtcgccctctttcgtttgccccctctcccgtggtctcccgtgcatcgtagctcgccgtcgacgtcgcttagtccgccgccgccgccggccgggttgcagccgcgccgccgcgtcgctttcgccgttgccgccgcttgccgtcgccgcccgtaggtgcgccaaggggtggagaagcctggccgcccgtcccccttcgccgccggccaccggagagccgtcgccgccgttcaaccgagccgccgccgcctcttgcgtcgtcgccggccgtcgtcggttgtcgtgggacgttttggtgagtaccatcgggttcgtctcgtcgtcctcttcgcgtaggtgcccttggataggccggccgacctctctatcgccggcgaggtcgtctcccgtgtcatgccggcgatgatgacgtcagcatgacgtcatgattccttttttccagttttttctaatagattaaatcttctgaaaatcatatctaaataaccgtagctccgtttcaggtggttcaagttactaaatttttctaaaataaagatctacatattaaaattgtccataaattgaattaaatttatttaattctttttaaatgggctttaattagatttaatcttgtaaaatttataataaattcacttggagtcagaataaggccgttcaagtctcataattcatctaaaatcatgatctacatgtttgtttactttatatgtattgtttatttggtttttattagccttttacttcgttttgcgtgttagcttgtcgtttccgtcgttgcgaaggtttgtgagtgcgtcggaagtgatcaagaagattaattgaagatcgattattgcaaggcaagtcacagatcctaaacacaatcctttgagcatgttgatcctatatttaaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattatgatggatttgtatattaaattgtcagtttgtgtacctcgactgattcctggacgaggattttatgcacaaattagttcggaaattactagtgaatttccgggcgtaacaaccgtccacccaatgaaggatcaagccagaggcgtcaacttcgacaaaggcgaaggcacacggcgaaggctatgcggcgaagcatgtgggcgaagatcaagggcctggctccgagcttcgcagttcgaaagaccacatgggcaaagggtatatggcgaagggcatttagcgaagcatatggacatcacccaagacgggccctgggcggagaaggcccaatgggccactatgcgcccgggggccctttcgccatggctaggccaagcttgttggcccgttaagagcccatatatgtaaaggacacagtatgccctcaataatgtccctatcataagggcaaccatgtaaaatcccctataatcataaaccctagaagaacagagcctataatagggttataaatagccccctaaggccatgtaatggggggatccccaaaaaatttctaatcaaccaatacagtcgtctttatttccaacctgttgagagagccacgtcgttcgacgtgacgcagttatcgttcgacaacaaaaactaagcaaggaaatagaaagtggtactctatgatctgttctgtctctcaattgcctaaggtggtgacaagcgtgtattccacaaatgttagtcgtaagggtaagcctccgtgcatatttaattaacatgagagagagtactcaaactgtgcgcttgtacattttagatatacaccattgtagcaactcctgattaacaaccaagtttttgtttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccgccagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccgaaagagttttggtatggctctagcagctcttgtattctcttctgaatactttccgaattaatgaaatactcatttttatacatcttcggtattttgttcagtctgagtactggtcttacattatatctgtgttatattaattatgtgggtagcctaccagagaggtgtaatggtgcgggtttaatgtttggtttaccagttgctctatgtcgtgtgcgcgggtatagagtagtatttagtaatgtaagtgtggtacttagattattaaatatcattaattgggcatatatgtgcgggacagtagaggtgggccgctgatggtgatagctcagtactggtattcctccacgttagtatatattcctaagacaaattcctggggagggactcctccgtattttaggccccggctggacggccatgataggttgtcgtaagaactggccaacccggggtggtctctcgatgttaccaggaggacactgtgggggggtattggccatatgattgtatattagcagatgtaaactaggaattgagtgtatgttagaagtatagtaattgagtgctttctattttttcttccacttagttagaattattttattatgaggagttaaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagtgactactgtgacgacatgggtatcaagctctgcttcacctcacccgcccaccccaagagcaacgttcaagcggagcgtgccaacacggaaatcctcaatggcctcaagacgaaaacttacaacgtcctcaagaagctcggggactcatcgatcttggagctgccggcagtgctctaggccgagccgcgcaataggagaaactccatgtttcctcgtgcacggggctgaggcggtcctcccatccaagctgaccctggggtcaccctgggcatcactgtataacgaaaatgatcaagatcagcttcgacacgacgacctcaactaccataaagagcgaaggcaacgtgcagccttcgggctacccgttaccaacaaagcctgcggcgctaccatcagtgcaacgtccgggcctggtcactgcaagtcaaagaactcgtcttgtccacgtcccaacgcgtgcaagattgagcaaactctcacccatttgggatgatgttgagggtcgttagcgatcaatttcgaccat

SEQ ID NO: 8881 - DNA, 4384 bp, Oryza sativa
cccatggttcggggttcggccaaaacccacctggcgctgttgaatgcagggtttcttttgaacggcgtggatcactccccaatgacagttggagggcaattccgaccattccaactgccacaaccgtcattggcagcctatttaaggagctcctcttctctcttcacacacacacctcgagcaagagctctctcatattctctcaagttagtttagtagtcttaagctagtggagtaggaatagagtagaaatcggagtccggaagccttcggaagagttcgggtatggctctagtagctcttctcttctcttttgtaagctttgtacttttattaaaacactcttctttatacatttatggtattgaaatactttccgagtacatgaatgctaactttatattatgttcatgttatactgattatattgttagcttatctgggagatgcatcggtacgggtatagtgtttggttatgcaattactctatgtcatgacgatgatactagagtagtttctggtagtttaggcgtggtgtctagatttggggatatcattattttgggttatatgctgcagatgagacgtgggccgctgatggtgacggctcagtatgggtattcctccgcgcgtgtatatagtcctaagttaatttcctggggagggtactccttcatatttagccccggttgtatggtcatgatgggctgtcgtaaggaacttggcagttaggggtggcttctcgaagtactaggagggcatcggttcgagggtattagctagtatgtcagataactagaatgtatgtatactatgtatactagaagtataggaatagatttcctttctcttttttttcacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtggattttgatttgaagtctagcctcatcacgatgcgcaggctagccctttctgtggcaaccaaatgagaatgccaatgctcatttacagtagttcctagagatttgcagcacatacaccatgaagggtgtcagtccaaacaacgttaggctacgactgtttccgttttctctccttgggaaagcgaagaagtagttttatgctaaccatgctacgatcaatacctgggatagatgcttcacgacattcctctcaaagttctttccgatgggcaaaaccagcgcccttcgcggaagaatttcaagtttctaggagacaagggacgagtccattcctgaggcacgggaacgacttcaagaatatgtggccgcctgtcctcatcatgggatggatgactggctgatcttgcaaaatttctataatggactcactcccatgtcccatgaccacctagacacggcagctggatgagatttcttctcaaagacggttcgaggagccatcgatttgatagagaagatggtctctaatatgggttggagcgaggaacgactccaaacccgtcagcgaggcatgcacaccgtcaaggagatggaaatgctcgctgccaagatggacctcctcatgaaatgattggacgaccatgacaaaaggccacaaggcatcgtcaaagccttggactcacacgttacatgtgaagtctgcggcagcacgggtcattctgggaatgattgcccggaaacccatgaattggcgatgtacatgggcaacaacaacaatgggtatcgtccacaaggaggtcaggggtggaatcagccatgcccatattatcaaggagctaacaacaacggtaacttttctaaccaaccctccttgaaagatctcgtttttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagcggactcctccattgaaaatgttaaggtgatcaccacgaggggaggtaagtccacttgtgatctgccatatcctaaccctgtaggaactaacaaggaagcgccatctggtacttcagctgacaaaaagattcagctagagaaggttgtgccacaagcatactatgacacgcaattgctgccatttcctcaaaggaacaggaaaccgtcagtggacgagcagtttgctcgttttgttgaagtgatctagaagattcacatcaatatgccgtagttggatgctatataagtgctaacatacgcacgttacctcaaggatatcctcaacaacaagagaccgctcccaacaatggaggtggtcaagctgatggagcagtgcaacaatgccatactccacaagttcccggaaaagaagaaagatccggggtgtcctacgatcacctgctcgatcggggcacaacagttcaaccaagccttttgtgatattggagcaagtgtcagcgtcatgcccatggacgtctttgaaaagctcaacttcacgatgttggcaccaacgccaatgcacctgcagctggccgactcattagtccgttacccaacagggatagcagaggatgtgccggtcaagatacgggattctttcatcccagatggtttcgtggtgctggacatggaaacaggaaaggaaacactgctcatcttggtgcatccattccttaaaactgcaggagccaacattgatgtgggaacgggaagtatccgtttccgtattaacgggaaggaagagaaatttgagtttcagccaaggactaaacactgctccatggtcagaatcaagtacgggccaaacctacaaaatatcctggtgaagttcatgcaaaatttcctggaaaaggaaaccacgtttcccaggaaccgttattggaacacactggtaaaacctagtgttccggccaagaagctagagcagccggcttagaagaagttgtctcccgcaccaaagccaaagaaggtgtggaagaaaaagccaaaggcgcccgctccatgacctctagagataggttgaaaatccgcgaactgaactgaaaggaggtacgatcttgcacatcggacctaaaatgacgcgaccttcgccacaggtaaattggtatgtatctgcacatttattttcatcaacttgaatttttgcattaacacatgtttggatttcaaaaaaaaaatcgcatttaggatttttgaatttttgagcaaaccaaaataaaattttcaacgaaaatttattgtgccacgaccacattgaccgttgaaacccaacggccaaaagtgcggccggttgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaagttttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcga

SEQ ID NO: 8882 - DNA, 10951 bp, Oryza sativa
caagctcatggatataacattgtagcatttcatccgagagtattccaagggtatcgtatttattttatcacgtggaaagatcatgtggagataacttgactaatagtttatatattacttgtgataatcatattctatgcaggggttaaggtaatccaagggtagagtgacacacaagcattagctactcattctcataatatattatctaagctaagtggaaagaaaagagaaagataatataatcctatacttctaatatacatagtatatatatattctagttaaccgatatactatctaataccctctatccgatgccctcctggtacttcgagaagccaccccttactgccgagttccttatgacagcctgtcacgaccatacaaccggggctaaatacggaggaataccctccccagggaattaacttaggattatatacaagcgcggaggaatacctgtactgagctgtcaccattagcggcccacctctcatccgcaacatataaccccaaataatgatatcccgtaatctagacaccacgtctaaactaccagatactactctaatatcatcatcatgacatagagtaattgcttaagcaaacattatacccacaccacagcttctcccagataagctagctgtatattcagtataacatgaacataatgtaaagtaggtactcatatactcggaaagtatttcaataccataaatgtatatagaatagtattctaataaaagtacagagcttacaaaagaggaaaggaaagctactagagccatacccgaactcttccgaaggcttcaggactcctgatttctactctattcctattccaccagctagatactactaaactaaacttgagagaaatgagagagctcttgcttgaggtatgtgtgtgaagtgagaagaggagctccttttatagctaaactacgacgattgtgacggttggaatggtcggtaataccctccaactgtcattggggcttcatctcaaccgtccagccaaaacctggatccaacggaggagagggaggttcggccgaaccagggcccgccccaactagcccacctttcggctggcggcctcctctatttctcctttatgcaactagcccacctttcggctggcggcctcctctatttctcctttatgtagatttgtgaattttggcccagtttgacgtgtcaattctgagttcttggcccattcatgcataagtttgattgtcgacatcgtccgatggacttatcttctatgttgatgtcgattctcctccactttattgtcattctctgcaaaatgttagtagacctaattctagtagaatattattattctgacatatttatgcattgcaagcatcactagttctcctctattttggtaatattgacggtcgaaactgatcgataacgactgtcaacacctgtaccggtggcgcggtgggaagtcggaggtgggcatgatctgggagggcggtgtagaaccagtcgttcttccggtcgtcccactttttgcgcagcatgcagttgatgtagcggtgcagcgtgtgggcgtgtggctggaagaagctgccgcaaacctccatcgctggggacaccagctacaaggtgaagaaccagcggaagaggcccaatgaacatctcgcacagatgtgcgaagatggccagtatcatcatggtgttgggggtgtggtgcgccatctggataccatagaaatccaggacgtcgtagaaggaggagaagggcaggatcagccccgccatggcgaatgagaggaagaagactgactttccggggtagcacagagccgggcgcgccgcaccaaggatcaccgcctcccgcctgggcagtgttggcatggatttccgcggcagccccacctgcctctcgctgacgatgcgggagggaggcagtacgctgtcgtccagtggtgtggaaccacgcgccatcgcactggcggagcagggacaaagcgagcgagtgtgcgcggcgagagaaaggcgaagaaccgagaaggctagggcacggtaagcgtggaagattgaagtggcgaaaggaagggaaggaaatccttccgcggcgccctgttgtactcccctcacccacgcctggctccttgtttctcacggccactaactccaccctctcatttcccgcgcctgcttctgacacacgcgtggtaggcgtgcggtcgttgcggtcaagacggggcgagccacgcccgccttaattgcgcgcggttaccaaaagaatctgtcacatacctgaaattctcggacttaaaaatttctcgtcaaaatagtttgaaattaacttttccaattttgacagccaaaaattttcgttttaacttaggtaataaccgacctaaaccattgcatgattaaaatttgagaacaaattaaaacctttttcatctctaacctagggcatagatgcaaacgtaagagcaagcatgcatactcgcataagacatgttttgacttgagtcttcttagtgcatttggattttggttggcattgcatattaggactcatgaacataattaagggaaataatttcactaagcaaaacaaaagttattcatgaggtataattttaaaagataagataaggaagtcaaaataatgccatcacaagtgaaagaagtttaatgtactttacataaaaatctttagatgcatttataaagtgggacatatatatagaaagatcctgctaattatttaaaataaaatatgcaaggtaaaatcatgggaaaatttatgtagtctctatttaacacatacaacttactgtaattttggtacaacttaataactaagtttggtgcctcaaataaattagtcaaaacagtcacatagtagactaattataatcctttattggctaaaaccatacctcacccaaaaagtgaattaaaatgcataaaagtgtatactttaaataatttatttaaatactagattatttatcataactaaatataatttttctagaatttttatcctctttttagacctcctaaaaattcaaactagtttccaaatagcccatattcctcaattttctgtgagcaacctatccataatttttaagtgcaaccaaagaaaatggaaactaggtacattcatccacctgcaataaaatccacatgaacacatctgcaacacaaattaatatatgaattaacaaaaaaggggaagagaaataaatcctggaaaatcgtccaaaatcaagtctacctttgtttctacccttccctttctccctaaccttggtgtcatcgatttgggcccacttatcagtggctgtggctcgtcctcaccctgtgcaatcctccaaccgaccagcaggcaagagagaacgtgagagaggaaagatcggcgccaacaactctcaggtgcgttcgatgcgtggcctcgacgtggcaacgtcgagcctcgtcttcacttcctgccagctgcatcgcctcctccccattacgacttctgatccgggcaaatcgagggaacgagctccggctgctcctttcttcctcatctccatcgtcggccaccaagaagacgaaggtcgccaacgaaatagagcagcggccgtttcatcttcttttgcgttccttaatctagtctcgatgccggttccatcccctctaatctcagcccctatcatgcagtggttttatgggaacgcggacctcgccatcgttgctccgggttcacgtcgtcgttccaaccgaactgaaccaccacaagccgaacccttgcgccaccagggtcgcctcgacgtccccttcaagattcctcaagaaccacatggatcggtgaatcgaggagggagatcggcgtcatcttctccaactccggccgccggcatcgatcttcgattcctgccacttcggtgagccattgttcgattcctcgcgcacaaaccatccctgtaacctcactaccctcgtgcatgctgttctcttgcagctcatcgtcccgttcgagctgtcgtcgttcacccgcggaaggacgccgtcgccaagcggttccgcaagtcgccgctgctgccaagacctcgacaaccctcgttagactcacagtgagcatcctggagacctattagttacatgcatgcactccattcacctagatctgacctctaaatcaacctgcatcgtcaccccgaggactgccgccgctcgcgccgccattgccatcgattctgaccactgcagctcgcaaaaaggataccgtcgggttcgcatttatgtaggctaccttttctcttttggatgcacaccgacatgggccgccgttcatcgccggcgccggcgagaaactcgccgagccgccgctgctctgtccgccggccaccgtctcactgacgagcgggccccatgtcattaggcactgagaacctcatttagagaaagtttaaatcttgtaaggtttaaaatgtaaaatatgttagacttacatgtgggacaacggactaattagtaatgaattaaaagaatctgaggactcttaatgaatttggttcatcgcacattttggactgcagattgattccttgaaacctcaagggccttcctgcatattagtctctcactgacttgtggacccaactatttaaaaactggaaaaaggataaaagaaatacacaaactaataatttgatatcaagaaaacacctaaacttgtaaaatccatataaaattaaatatagctcattttgagatgattcaaacttctgtagattcataaagttattaaatttaatatagaaatttataaaatgcatataaaattcatctcaacttagttttgaacaaacttaagttccacagattcatcaacttacactctctgattaggagaaataaaagtatataattacttcttttccaaatgcctttaaaactattatctttaaaataataagttttagataagttaaactttagaagttcatataaaattcatcttaactcctctttgagtaaactcaagttctgtagagtcaccaaaacatgtatttccaagttgtaaaataaaaatataaactttctgtataataaaaacatctaaatatttatataaggaaataaccaacttggggtagcctttaatttgtacaacttatagaaaattcatccttagtccagaaagagtgaaccaagtttctatggagtcagaaaaagagtgaacttaaatttagtaaagtaaaatgtggcactttttgtacaaattatagctctgaaccttaattggataaaattggtgctaatcatatagtgttgattaagcaaaacataggtatgtatatatatagatgtagtctagctctaattaaacctaactaaaatttgttagaccagaaaagctataaattcatcctcattcactaaaacctagatgaacatagcttgtgtaacaaaactctaggttaatatgtaaagtcattaacatagaacattccctaagttacaaaatgtgtagtagagtaatatcaactcaaagtttgtgaactaaaatttgattagtagactaaatcattcattttaaacatcactagcaagatgaaacaagttctggacctaaacctctaaagccatgaacctatataacactatacagctataaaaagttgtaacttctaaaatacattagaaattcatagaaactctaaaaattgtgaaaccaaatgttctagtcttagaaaactcatctcttcacctctgtgaagtcaaatttaattaaaatcaatttatagaaacattttataacactgcctaattaaacactactacataccgacataacttctaaaattcataactctcaaatggaatgagacaaaatggaaattctttcacctaagttcattttagatcagtacctacttattatgcacaaatcatacattttagagcattttagatttttgactatttcggtgtttaattgcataacgtgtattttatttagataattgcataagcggtgaaggaatggattaggtgcaaacatttctcaatatcaaggcaagttctcctcccatcctttgaacacattgaatcccatgatttgaggaatgaaaatatttgtttgcaaagttgcatatgaacttaaactataccgatatttaaaattgggataaggtagttatgacctatctgctgcataccctaccttcaataattgtgatccttgctgcttaaacccctagaaatggttagagtacactctttgtgctcaaataggtttatatatgctctatgtccaactacttgcttagccatgcttagaaacatgcaaatgctcattccatctataattaaaatatgattttgacgcatgaacctttgctggaataaaatgaatatgataggtatttgtgaactaaaataagtaaaatgtgattttagacttgggcggcaagtggtgtgcatatgatgttagttgcataccgatagggggagtgtttgcccgagtccgtaaggactgaacttgtgtcaccaacttaaagttattcgtacatccacatgtgctagtatgggatggactaagctgattaatctatttagaactagccttgcattctggtaggccggtgtgtatgagttggaataattcagaggagcttcctatttaccccaaagtggtagtttaggtgactaaacatgtccaatacaacggtattgtgccacgtggtgggttcccatcgtggtagtttaaggcgtgggcctgctacttagcggttctagacatattccaagaatgtctaggatggaggaacacgtatcgtgctggtgcaaggctagattctaagtagtgtgaaggcttcgttgtgacctctagaatgtacttaatgcgtatagtatggtggtaccgacgggtaccgaacaaactagagcgattcagatcatgtgggtaaagctgtacaaactctgcggaattctctaaactaatcgattagccatgctcacggtcatgagcgctttggtgaagtgttatgagtatagactatgttttaaaatgagaacatgtaacttggtttgaaattgataaaatgtgttgagttctgtgagtgtggtgatatattatgacttgttgtcaaggatgacaacaagagattgattatgatggaattatgatgaacttaatgataaaagttaaaacttgtttttgatagttgaattgccaactccattacaaaagatttgtgaaacaaaacctctttatgccgaaaataaactacataatgccttcctttgaatatatgccttatatgtagtatgttaggattgtcttgtgcttgccaatacattaatttgattaatatactaactcttgctgttggaataaacttttgcttgcaggatttagacttagtctttgagtgatgcatgtttcgattgcttcttctaggatgagaacttgatggggtatacccctagtcggtgtgcttgtatttgggtagtcaagcttccgttgttctatatttatgtctatttggccggtcggcctatgtatctatttagttgttgtaagtccttaagttcctttcatcttaattgtgtttgctatgtatgtccatgcttaagatgaaagtgtgaatctagtgcacatcctggcaactagattcacatgagtatgagttaagaatatttgagatgttgtagatctttagccatttttgtcagctctcctgaatgtgtaacacatctggtcgccaccttcgagtggattgacgggtacatctcaggctaaagttgactggcaggctaaaggcccagcaatgtctctaatattcttctctcgaggcgtcagatgtttcattatgtttgtatgatgatttgaattattcacatcatctctcaaatataatggaaggtttagagagcctacgacagaatcgccatcattattcgctagcgaagccactgacgcatccgctccgcgcgccaccccaggcgatgtggcaattgcgaggtgacggcccatcattgccagggatgcggttttccactgcgcgctgggccgcgatcggcgaaatgtgtcatgactcaaaaaatactaggcacacatgtcactggatcagaagaatggcgtcaaacctggccactcatggaagggttcggctagggttaacgccgggggttactatcggtaatataggctagggcgtatcgagactaaagggaggaggctgccctcagtacccatgtggcattcccccgagggagtcgggcccggggtagagcagcagccgccccctccgtgcttggggttcgggctgccccggttattattggtgatataggtcagggcgtatcgagactaaagggaggaggctgccctcagtacccttgtggcattcccccgagggagtcgggcccggggtagagcagcagccgccccctccgtgcttggggttcgggctgccccgaccccctctgcatggccgccacgtgtgcggacttaggtgggcgccgcatttaaggcggcctgggcaggcgcgccaaatgcggcgtgccacgcacctgctaaatgacggataggacggtggtagggctcccacaccttgaccgtgtgttaggcggctgttggtatttctcaacgacattactagaaatgtaattcccagcaatggcgcagaaatacttctggtatattatggttatagagttcatccgcaagcgcacggatataccattgtagtatttcactcgagagcattccaaggttatcatatttattttatcccgtgagaagatcatgtagagagaacttaactaataatctatatattgcttgtgataatcatattctaagtaggggttaagataatccaagcgtagaaagatacacaagcattaactactcattctcataatatattatctaagctaagtgaaaagaaaagaggaagataatctattccaatacttctaatatacatagtatacatacattctagttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaaatctaagcagcggaaaataaaattaaacggcgcagacggctcgactccacaggcagcttgaccaaggctacacctaatcctccacaccatcagcatcactgtagatctcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatgtaccattccaaaccaggagctaatcaaattattaccaatttaagcatcttttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggccgagatcgatccaatccaaaacggacggccgagatcgaacggtccacgaccggctcacggcggacgaccccgatgacgtcggcaatgacgtcaccgacagcggcggcggctcggcggagcggacggctcgggtggcgcacgctcgccggcgaacggcggcacttcggcacaaacggagggcaccagcatgtagaggacgacgtggcgaactcaccggtgaccaaaacggcggcggaagaacaacggacgacgacggcgacgaggaggaagcggcggcaaccttcgggtcgacggtgacggcgatgctccggcggtcttcggcggtggcgaagcggcggacgaggatggcgacgacttggcgagcacaacggcggtcttcccgagcgacagcgacggctgaaacgacggcggcgcacggctggagcggcggcgacgacggcaaagctagggcacacggcgctagagcgtttccgacgacgagaggcgaaggcaagggtggcggcgggtagagaagagctcgggggtccttttaaaggggctcgaaggcag

SEQ ID NO: 8883 - DNA, 2149 bp, Oryza sativa
attcctggttcttctctcatttgtttccaagatacggattggtttttcaacataggtcagatcctcttggacctctatctgttcaagattagcttcttcggtaggtacccttaaacactttttcaattgcgacacatggaacacattatggactcctgccaaagattgaggtaactccaactgataagcgacctctcctcttctactgacaatcttataaggtcccacaaaacgcggtgccaattttcctttggtgtgaaaacgatgaacccctcgaagaggcgtgacacgaagatacacataatctccttcttcaaaactcaaatctctacggcgattgtcgacataactcttatgacgcgactgggctacacgcaatctttcttgaatgatctttaccttttcttctgcttcccttaggatatccgtcccgaaaacctgacgttctcccgtttgatcccacaaaagcggagtgcaacacttctgaccatacagtgcttcgtaaggagccatctgaagactagcttgataactgttgttgtacgaaaattctgcatagggtagattcttatcccaacttccaccgaaatctaaagcacaagctctcaacatgtcttccaaaatctgattcaccctttcagtttgtccatctgtttgcggatgataagcagtactaaagttcagcttagaacccatctcttcctgaagtttcttccaaaaatttgaagtaaactgactgcctcgatcagacactattttcttagggacgccatgcaaacacacgatccttgccatatacaattccgctaaccgacttccggaataggttgtctttaccggaatgaaatgagctacttttgtaagtctatcgactatcacccaaatagagtcatggcctgatgacgttctgggtaaaccagtgataaaatccataccgatttcttcccacttccattcaggaatcttcaaaggctgcaacaaaccggcgggtttctgatgttctgccttgactcgctgacaaacatcacatactgctacgtattctgcgatttcacgcttcatacttgcacaccaaaatctttccttgagatcctggtacatttttgtactaccagggtgaatagagtataaggtatcatgagcttttttcagaattgcatcttttaaatctttgttgtcggggacacagattctctcgcccaaccatacagttccttgctcatccttcaagaaaccgatagcttttcctcttctcatattcttcttgatctcttgaatatcaggatcattaatttgggcttctctaacttgatcaattagagtgggcttcgcttctaaggcggcaacgaaacctctactgacaattcccaaatttaatctttcaaattccttgcataattccaatggcaactgtcgtccttctgtagcattgcaataacctttcctgctaagagcgtctgctacaacattagcctttcccgggtgataatgaattcccatgtcataatccttaattaattccaaccatctcctttgtctcatgttcagatccggctgagtaaagatatactttaaactcttgtgatcggtatacacctctgtacgagtaccgaaaagataatgacgccaaattttcaacgcatgaattactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggcaaaatcaaaataggagctaatattaagtgattcttcaactcttggaaactctgctcacattcttccgaccacttgtacttcacatctttctgaagcagtgtcgcgtcccaaaacgactctaaaacacatcctcaaaattatgcttagaataagtaaaatccttgtgaaagcctccaacaattaaaatgtgcgaagttaaaagtcgaataaggcttggaggatttttgtatatttcctaaaagcctaaaatgcgtaaattaattttagtggaattttcagagcacaaataattattaagaagaaattaaccaaggtaaaaatggtttattaaaaaaaaaaccc

SEQ ID NO: 8884 - DNA, 9012 bp, Oryza sativa
  unsure (1)..(9012): unsure at all n locations
gttcgttgggttcacggccttgataaataattgaatagttctaggatggtgtttccaaaatagctttgagcaactaaatatctttaaatgctgtttactgcaaccctaaacctttatagtataactcctttgtactcccttgcatttattctgcacttgtgggtgtgtcttgttgagtacggtggttgtactcagtcttgctcaatttttcccaaccccagaagaggagcccctagaagatgaaggctttggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactttgaattgtatcaacttttggtgtaccttgcctcctgggacaaggattaatgcacgcacgtaaggaacgcccgttgggttatttccggtcgtgacaagttggtatcagagccacccttgaccctaggacgagccgtagatcccaagccatagcagtattttcgaaataaaaatcctttgtatttgtgaaaaccctctagtctctctctgtcttgctgcttcatttatcgccaaaatctgacctttttaaatgttgcttttctttttgtttttgtttgtagatggccggcagcgtcagccgtcgtggcttggacatgactggtttcgtcttggagctgcggggcatgtgcgttgtcctggggtatccgcatggagtggactaccaggccaggccgcttccggatcaggagggtgacgatgcagagccccacgctgcgtgggaggttactgcagtgatcctcactggctctcccgagcggacttcgctggcagtcaccgcgggtggagattctttccccgccgcttaccagaacgccgctctcctcgccatcggcactcttcaccagcgctacccggacgagttgtagcactcgccctaccgctaccaccctcgccgtggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacttgaagatcctggagctgcatcaggagaacctgcagctcaagaaggacctagacgcagtggaggcgcagctgcatcagctcaagatcgcccagggagaggtctgccgccccaagcgccaccgcgtctaccgcagccagaagatcaccgcccgcaaaagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttattcgtctaagcaacttgaactttaatgaaccaatttaatagcagtaataaattcaagaattatggtagtcgtgggtggttagctttaattgtcagctctctctctgtttgctggttctgtgtggggttttcagatggtgatgaccaggagaagtgctaataccggtgatggcaaccaacctgaaggcagcaaccacaaccaccagggcagcccacctccacctcctcctccgcctccaccaccaccaccagataccaacgccattctcacccaaatcctcgcccagcaggccaacatgatgactgctttcctccaccacctccaaaatccgccacaacagaatgctccaccaccacccccacaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccgtttcaccgccgctttccggaggacccatgtgcctgccggagtcatggcccttaagaaaagggaattccgggagttgaagcaaggcaaccgctctgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacaggatgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccgaagccgaggcgccagcaaggccaagcgcctccccgctccaacaatggtggtaaggatgttattcggggtcgtgtgaaccatgtgacggccgaggacgtgctgacaactccagacgtcatcgttggtacgttcctcatccattccatccctgctaccattttgttcgactctggagcttcccactcgtttatatctgtgccattcgtggggagaaatcagttgggggtagaaaggcttaggaaccctttgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgtgcgagacgcacggttactctgtaccgagggccggaacaaccggttgttttctttgcacccccaacctctgtcagaagttcagaacttcatcagatagtactgtcagaaatccccatcgtcagagagttcggagacgtgtttccggaagaactacccggtatgccgcccaaccgggagattgagttccggatagatcttgctccaggaaccactccgctgtacaagcgaccctaccgtatggcagcaaatgaactggccgaagtcaagaaacagttggaagagttgaaagaaaaggggtatatacgtccgagtacttccccctagggtgctcctgtgatttttgtggagaagaaagacaagacgaagaggatgtgcgtcgactacagagctctcaatgaggtcaccatcaaaaacaagtaccctcttccccggatcgatgatctgttcgatcagcttaaaggtgccacggtattctccaagatcgatcttcgttccggatatcaccaattacgcattcgtgaagaagatattccgaagaccgcattcaccacgcgatacgggctgtatgaattcacggtgatgtcgttcggtttaaccaatgctcctgccttcttcatgaacctaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaagaagttgctgtggaccccgaaacagtgaccgccgtcactgattggaagcaacccaagaccgtcactcaaattcgcagtttcttaggtttggcaggatactaccggaggtttatcgagaacttctccaaaatcgctcgacccatgacacagttgttgaagaaagaagagaaatttgtgtggagcccgcaatgcgagaaggcgtttcaaactctcaaagaaaggctggtttcctcgccagtgttagtcttgccagatactcgcaaggatttcatggtgtattgtgacgcttcgcgccaaggattggggtgcgtgctcatgcaggacggtcatgtggtggcctatgcctcacgccagctacggccccatgaatgcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcagaggagatggttagaactcatcaaggattatgatgtgggaattcactatcatcctggtaaggccaacgtggtcgctgacgctctaagtcgaaagagctattgcaacactcttaacgtccgtggcattccacccaaacttaatcaacagatggaagccctgaacctaagcatagttggtcgcggattcttggctgcgttggaagccaagcctaccttgctcgatcaaatccgcgaggctcagaggaacgacccggacatgcgtggactcctcaaaaatatgaaacagggtaaagctgcgggtttcacagaggatgaacacggaaccctatggaacggaaatcgagtatgcgttccagataacagagaacttaaacagctgatacttcaggaagctcacgaaagtccttattccatccaccctggcagtacgaagatgtacttagacttgaaggagaaatactggtgggtcagtatgaagcgggaaattgtagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggtgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattattaagaaataaacaaagttaaaatgattttataaaaagaaaaaccctaaaaagtcctttttcccccccccttcccctcttgggccggctcggcccacctccttccctctctcctctcccccgcggcccatccggcctcctccccgtgcgcgtgccgctgacgggtggccccgcccgccaccctcgctgacgggtggggcccacctgtcatccctatcctcccgccgttcccgccgcccgcgccctagcgccgccgccgccgcgaatcccgccgcctcccgtcgtccccgcgtgcaataaagcggggggaaatattccccgtgatcccctctctctttccccccatttctccctctctctcccgcgttcaaacgggcggatttgcccccgcaaatctcgccggcgccattgatggcggccgacctcccgcgccggtttcctcccttccccggccaccctctctcgccccggctctatttaaaccctccccgcacctcctccgtccggttccgcctctcgccgcccttcctcctcgccggatttgagctcgcgatgtcgctctctctctcgccgtcgccgccgagctccggtccgccgccgtcgtcaccccggaccgcctcccacctcggggccggctccttcggcttcgccgcatcctcgccgacctcgtccacctctccgtttcggtcgccgaccgccggagcgccgccgcccccgtctacccgagccgcgccgccaccttcctccgctccggtcgccgttcccgtcgtcgccgtcgacccggggtgagccgtggaccgccgtttcacttcccccttccctcccctctctcgggcgccgctccgccgcgccggtggtcgccggcggcgaccatcagggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgcccctccctcggctgacgcaataaatccgattttttaattaaaatttaaatgaagaaattcgcaaatattcaattaaagagcatataaacttcaaatggccataactttgccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatgatctttgaacatattgaatcccagtttgtaaaattatattgatttaaattattgcattatcgctttatttaaattcccgcgttatcactgttttatttagccatgcctatttacctttgttatgaccttattattattgttattgttattatttccttgttcaccctagaataaacaaaaccccaactagtgggcactctactcatggtaccactagtatgattttaggtagatgcttcgctatttaattaggtaacattaggcggttttacaactatagactttgggaatattcatatcacctggacactatggaatggtttggttattgtggaattggcttcacaccgccccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcatgtcttccgtccatatgccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacgtgcttaacaattaaaatgtggaatggttggcctgggttggcttgggacgagctgggacccagggtcgggttgccagttcggtctgaatcatcgtaggccttgggttaaggcaggttcgtgtgggttcacggccttgattaataatactatgtagctctaggatcgtctttataaaatggctttgggcaaccaagtgacttttaaatgctgtttactgcaaaacttaacccctatattattatcccctcgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtatatattatcgatataataaagatgtgccttttgtatcatgtttgtttggtgtaccccggcttttcctgggacggggattaatacaatagcgttcgggaaaaggcaattttcccggtcgcgacaacctcatcgagcacctaccgcgcaatgaagagtgctagctcttatttaaccctaatttagcctatttcctatttaaatcttgccctataaattccaatttttgcaccgatgaagtttacttaatatttgtgttattttaaccaaaagattcacccgagattaatgttacccacattttattgttatataatttatttgaatttttaattagggctaattgttattccctcacaaataaatttaattgttaccaatatggctacgataatatttatttatttctatccactcctaatctttattntaaatgatttcaattatttatttagccaaattaatttaaaggtttattcctcgatagttattctttatttgcgattaatgaactccga

SEQ ID NO: 8885 - DNA, 1072 bp, Oryza sativa
aaaggaaaagactggaggaggaaaactaaacacggacaaaacaagcccactccaactaacaaattatcattaacctttttgtgactatagagtactttgttttttttaattaggagtacatagtggtattcgtacgggcgtgaccgaattattaactctcttctgatgctgacgtgttgggtcccacctaacgctaacccccacttgtcagtaatgcaaatgatatgtaacggcgagtgccatcggaccacggcccatactttagtcggcccagaaaatactgcttatcttttagacttttaattttggaatacgtctattttatctccctctcacgctcatgttgaatcgtgcccctcaaccgcaaaaccggtataatgtctccctcgtcttcaaaaaccaatgcaaatcaactccttcgatggttttgaaagtggtttctaccaacatggcagtttgatcgcggttgacttgttgaaacaatatgtgggacccatatgttagcaacttccaccttgtatcgtcttctttcccacctcttccctccctatattttctctgttggtcctctctcaccttccatcagcaatgcaggacctagccggtcagttgtgcacactaggaggacctgcccagtcgaggcgcgcaggagaggagctcgcatgccgaccgcgcacgcatagaggaccttgcctactacagtctacggtagaggagctcgttggagctggccaactgtgcacccagggaagacctggtcaattgggcgcacagggcaggagctcgttggccggctgcgcatacagagagggccttgctggtcgtgttgtgtggatgaggagctcagtggttgtccgcacgcacgcggggaggacctggctggccacaacgcgagaatggaggagattgctgatcggctacgctcaagaggaggaatccccgtccatgacacgcgctgggaggagcttgtcgggcggcttcatgcacgtgcactgaggagccctctggccagggggcaaaggggaaggagctcgcagaccggctgtgctcagaggggggggggggggggggg

SEQ ID NO: 8886 - DNA, 2758 bp, Oryza sativa
tatccgggagaaaatatccatattcgtatccgtatccgaaatatccgagaattatccgatccgaaaggtatccgtatccgtttttgtccagagcggacggaaactatccgctccgttttcatccctattgacaagccactggaagatgagataggaggaagacatgaaagagagagacagtgggagatgtaagaagatgagatgaggtggaagtcgctaatatgtgggttacatttgctgatcgacttagcgagtcaaccattgtcaaactgccactctagtagaaatcatttccaaaatcactgaaggagttaatttgcaccggttttcaaatatggggaggcgttatacccagttttgtgtctgggaaaggggattcaactggaagcatacaaacgaaggccaaatagaattattcctttaagttttatcactgctttaggccctgtttgttttagctaaagatttgtaatatggattattgagtcagattactgtaagctggattataataagccgacgtagaataagctattagttgtttgtttctctggattattagctggttgtttggtgttagccacctaataatctaaaaaaacacctttagagtggattactatattatattatattaatctggcttataaattataataatctattataataaggtatatgtttgtttcggcttactcctaataatccagattataataatcctaagctgaaacaaacagggccttagtcggcccaattacactctttatttcaatttattaattcgactccaatcacactctagagttctttctctcttttctttatcatcactcgacttatttatatttctctgtcttttgactcgaattacactcgaatttttttatttctatgtgcttcaccaaccgaaactttttttaaaagtgtggtttgagaaaagtatgaagtcttattatcttctttataatccattgtctcctccagccgggagattaccattcacccgacgcagcgacctcaacagttgcctatgtcctcaaattatctaacgtttgatcttgtatttctcttcttttatctcatgtgtgttttcctttcctctcaaattttgagacatttggaaacaataataaaaaaagaaaatatgaaaataaaaaaattcaccgtcgtcacaactcaagagcaatcactaacaaacttcggttgagtccatcataatcttgtttgttatgggtgaattgccgatagcttcaagcaccttcatattcatcagttttgccaatcaggccaatgtgtgtgcttcaaacatttgcaccgcaagatagaaagaccaacttgtattaggaccgtcctcttgtagcatgcaagtgtgccagcatgataggcatagaaaaaattaactttcacctctggatttggtgaactccactgtctcgattcgtagcaaaaacgactgtcggttatatagaagagtggctaaattgcaaaacaaaacgccatgtctagttgcttcctctcctgccaatgcctaccagcacatatatattcatgctctgcactgctatgcaatgctttagcatatattagatgtgaaatttgtcattccattactgtgatgatgaacaaacaaaatgacttgttggaggaaacaactgaaactcatacatgtgtgtgtccgggtgagggcttcgatcgatcatctaaggaattcatgacagacaatgcatatgatgtaaaggagcagcaaatatgtagaaatgctaataaataaatacattgacgtatgtgttgctttctttttgacattaaacatataaaaaaaattgaggtcagaatagggatatatacaaaatctttcttttttcagaataactttctgatctcagctctaattaatttgtagaggagaatgctcgcccaaaagaatggtagcaaagtccggtttgatgtagcttttcattctcgtttgagcaactcgtccagaattagtattaaacactgtcatttcatttctttcataaacatgattttagagtgtgtttcgttaggcttttcaacctgcttttgcttttgcaaaagccaaaagccaaccaaaggacccaaaagccacagctgcttttgctccaagccagtttttggtgtagtataaatcaaaataatctctaccctacgctttcacctgcttttggaaaaaaaaattacccacctttgccattagaaaaaaacatttcgcttcgttcttttttttctcccgtccgttcccatcgcgcgtcgctcctcctcaccgagccgccgccgccgctcctcctcctcgctgagctgccccgccgtcgccgctcctcctcctcaccgccgcggccgtccccgccctccctgtccccgactccaccacctccttccgccgctgccgccgctcctcgcggacgaggaggagagagtacatcaagcgatggcgatggcgatgcgaagagaagacatccgctcctctactccggcgagccgccttcccacaccggcggggcgggtcagccccagccggcgagtgcggccagccgccggcgtaaccatcggaaaaaaatttggtgcataccggatgcaaacctcaatccgtgcgtacccgagtcagatgtgcgacgcgtggatgaggcgtgcatctggcggccggcctgtaccttgcgcgcacagccgcgtctccgctcggctcggctgatctcgatgcattacgcgcggctcgtgctcgctcctctcggctcgg

SEQ ID NO: 8887 - DNA, 9482 bp, Oryza sativa
ccttcctccacgcgcgggacggtgctacctacctgcccgccggccgcttctctccgtcgaaccgcaccaccgctttacgaacgcctccagccggatagcccacggcgatgccatcttcctcctcgtgcaggaggccgctgctgtcattcctcgtgaaggtggctgcttgacatcccagtatcatttatattcaattgtttcaggaataacaaatagcttcagatgtagtatgattcttcctgcctgataggtggtatgccattgatgtactgcttgttcatatacactcaatttttttccatatacagtcaattgatgcaagcatgccctcaaatcgattgcaccatcctgattcttagagtttgcgtgccctaaaaaattgattgtatattctttagtcatacaggttgattcttccggtcatgggagttggttcccaagtaaattgctcattacatttttacatacaccatctttgcaggtgagatatgtggggtgcagcattgctggtgattcaagattagaaagactaaaatgaacaagaggccgcttaagaaataccatagaacaaccaaagacagaacaatagagtgaagacatgctgctttctgaaggaatttattctgggagctgatgtgtgtggaagtagttagttttgcctgatgtatgtagtctttctttgtaatatgtactatgtatagcctgtacatggttaagagtttgcaaggattgtagtccagatgctataaatttgaaacccatttttttggttcaaattgcaaatatctgtacaatgcagttttttttttatctgaaataagtatgacgtgttggatgctatgaaatctgcagtggattgatgtgataaaaaaattgtggttgtttatctgattcctttcaaaaagaaaatatgcaatattgtgtaatctaaagtcttgatgttcaatctggaatgtgatgtcatgtctagaaattttctgaaacaatatagatgttttcacatttcatacatagctaccaaattcatggtttgagaatgatcagctattatttttttagaatgatcagccatcttactgattgccgaatccaggataagaacctgcaagagaatgagcattgttttcattggtggaatcatctacatgagcagcaaatgctttgcactgaacatgaccttgccgccactgccgtcacctacaacgcccgtggtcaggacgagaacacaggggatgaggcagcggcggcatacggagaggtggccgcatcgatagataacggaggagatagtgaaagagcgagccggcgacgtcgaggagaggcaattacgatccgatggagtcgagatagggagggagatcgcggcggcagcgggaaggggaaagcggagttgcggccggaggaaaggcgagccgtccagctcgttgactccgcttcgttctggttgttggagccgatacgagcgagctgagctgacccttatcatgctgcggctccagccgtgcgtgccggccgtcggatgcacgcctcatccacgcgtcgcacatctgactcgggtacgcacggattgaggtttgcatccggtatgcaccaaatttttttccgtaaccatcccctgctttgctgtgctaggaggaaggagaaaactactatttagacgacatgtggggtccactcgttagggaagaagcttttccaaaagccacgtgtataaagaacttttggcttcctcacaactacttttccaaatctattttttaaaaagttatagcccacagcagcttttccaaaagctgcaacacaaccaaaaacacccttagtaacattctcctttcctatcaaatttcaggatatatagagacgatctcatcaatcaaatttcaggatatatatagaaacgatcttaaccgccagtcggcggtcatcttcatgctcatctgccaacatcttgtcggtccgctattatttcgcattggttagtagttagctcaataaaaacaatcctcaagaaaaaaaaattgaaaatggagctgatgaccactatcgcaattcacgagtgatcactagtgaactttggttcagtccatcacgatcttgttgcttgtgactcatgactgagttgtcgatggcgccaagcacattcatcctcatcattctcgctaatcaaacagatgagtgtgatcaacatttgcatcgaatgagagaaagaacagctcagatcagaacgagccgcttgtagcgtgcaattgcgccaaaactaactttcgcttgaggattaggtgaactccactatctcatagcaaaactagaccgtatgtagcgtgcaagtgcttcagaggcatagagtgaactaactttcgccttcaaatttagtgaactccacaatttcacagcacaactacggtgggttataaatagaagtggctgaattacaaaacataataccatgtctagttgcttcttctcctgccaatgtctacctgcacatgcatattcatgctctgcactgctatgctatgctttagcatatattaggtgtgagatttgtcattccattattatgataatgaacaaaccaaataacttgttagaggaaggccttcgtaagaaatgaataactgaccatgcatgcatatcagggcaaaggagcagaaaatatctactccctccgtcccaaaatataataacttatagcctttagaatttgtctcaaaatataacaacttctccaccaacattctattctcaaccaatcacaatcctccaccattcagtttttctacctacctctatttttcctccaatcacaacactcttccatttaattctaccaactttcttaataaccgtgttcaactctaaacatgcttatattctgggatagaggtagtagggattatgcataagctttttttttttttgaaacggtgacatcatgagctctgcaggatatattgaaaaggaagaggaatgcattagcatatttagtgcgaatagatagaacaatgtttttcttttgtactttttgaactataaaccatatataaaaaaattgagttgagaataggccgatattgtcgaaacaagatttcggcaataataaaaaggggtggctgtcaagctaggaaagtggatgggtttagagacaaggaattttatacaggttcaggccttcttattcaagaagtaatactctactcctgtccggggataattccgccgagtgtgttattgattgtatgattaggagaaaaaagaatcgtcccaagaggaacccggacacctccttatataggggaagggatccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccagctggaatataaccgccatgtagatatggggtaaccataatctccacagtagcccccgagaccttcgcagttgaccaaaatagtcttctcgaaacaaaaaaacaataatccgagtgcttcaattcaacttgctccggctcgccgagtgctaaaagactgtgaagggcgaaaataaaacatggtgcatcgagtagatgcacctaattaggtgtagcccccgactatgtgattagttgaaaaactaaacatatagtcaagaaccgagtggttttatagcgaagcccgcatggtacttagtaagatacccagccgactgtttctcaacttgaacttatcaaggacaaaaaatacaagaagggccgagtgataacactcaaaggtccagaaatagacatgttcgatagaaattgagtaaaaatctcataaaatgatccaccaaacatgatagaaaatcatggtaattaatgactctaatagcctaggctgtgacccttaccataaccaaaataagcatataacatgctaaaagaatggctattaataaatcagtcatctcaaatcaacccaaacagcttttgcagcctaaaaaagcttacaaaaatggtataacacctttctatcgggcaccttttcatatgcatcataataattccaaagaattattgaatcgcgttaaaaaggattttaatagcatcgggccacatcattatgagcacatattgccaaagcaaaaagcgcctaagtccctagggatcacaatgggccacgctgaaaacataattgggctgaagtactgtataggcccaggcccattagtacttccgataccctaaaaacaccgaagtccaaacgtcgtttcgtcttccccgccgagactctcgccattccccactccgtgctacagtatagaaccacgccgacgaagctagggttcatcaatctgctccaacccaccctcaaaaacttcgcgaaatttctccccgcgtccaccgctccgattccccattcctctccagccatatctcagaccaaattaaaccatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgttcggcgaagcattcccgacccccgacacacacgaaatcgtggtatttgctcatttcttctatggcggattttctcttccaacctcaagattctttcgggggattctgaacttctacgggattagcttgcatcacttgaatccaaactccatagtgcatattgccaattttatccatgcctgcgaagcttttctggcattaggcctcatttcgccttgttccgccgcatcttcttcctcaagccccagccaaacaagagcaaaccgtgcgttgttgggggagctggtttccaactcagaggaaccttgagccaaaaatatttctccatgcccttcaaaacctcaaacaaaggctggcatgcaaactggttctatgttcagaatcctaagcccgcactccccgagtactgttgtcttcctccggtctaccaggacacatggaattcattgcctatgggagatgaagctgctcaggcagtggaattgatggaacgcatgctaaaactgaaggaacaaggtttgcagggagaacagatcactcggcacttcatcaaaagtcgattagctccaatcaaagagagatcccgcacggcttttgagtttgatggcaagcatgatccaaatcgggaagatccagattctcttgactttaaggtcatgaaagaaagaatgtacaagatcttctcaaacgctattgttgtcagctattcacatctgctgcccgttgtgccattcaatgcattcaaccctcctccaccggtatgcactcaaacatctcagcctttctcaaaatacagtcttatctgtttgttgaatcagttaacaataaaggatatcacgcccaggaatttgctttgatgaagtcggatcccccaatcgctcaacaccgatctccctaccaccaaactgggcaagggagcggtggaccaagaattcggtctgaaactcaaccaagtgctcctgatccagtcggccagccaaattctcgcaagaggaaggtggttttaagcgacgacgaaggcgacactgctagaaagcttggagaccgagaggcaaccaaaaaactgccgaagtagtctactccaaggaagaaaacatccagtcgtcctgtgccaaagatcaggaagtcttccaggtataactcctataacgatctcccttgcggtgatgcgcgctcggtgcaataataatactgataatcaaacttgcaggaaaccatctgatatagatccttctggaaaagactctgacctggccggcagggaagcggatccctcaaaagaaaccaggccgactgcaaaagatcacctgagtgataatccgcaggcaagcgacaatgtagaacccagcgacgaaccccgactgtgagccagtcggccggagctggagtcggagttcaccaggagcccccgactgaaaaccagtcggatacagggccaagccaaaaaactcccgaggttgaagctcaaacaaacagtcctcccggaaaagaagctggcaacgactcagaaaccagatctcctgtgaggacacaagagtccacccgttctcgaccgggaattatcacaggtaaacacaccatctgagatcatgtcgatccaacagcctttatttgatctcctcacctttattcatgaatacactagggccaatgattggtgatgaagaagagatcctccggatacaagcagttgaggattcacgccctcccattctggtcaagtggtgggatgacaacatgcagcctcaaggaatcgtaataaataagcaaaaagaagacgaggaggtatgcttgctgaaaaaggcactcagccaagccacccgtattgtaaatgtaagctctttggcgcctgacctcaaccgtctcgtttgctatttaatctaggcgctaattaaactgtcttgcagaggattcatcttaggaacgaagctaaaacggcaaccttagagaggctagtccctcatctcgggaccctcgaagccaccaggagtcagctgtacgaaacaaaagagcttgccaggaaaaatgagcatgatctgagggatcgaattgctgagcttcaggaatccaattttgaactgagtggctcatcaaaaggtacgcacaaactctgcccaactaacttgtgccgttgtctttgtaatcatgattaaccggggttaatgtagtgcaagctgccaagatatctcagttggagaagcagattcaaattctggaaaatgacaaggcagaactggcaagacaaaaagacttggctttaaaggaagttgaaggtatcgacaatcaatacttcaaaagccattatcctccatatgctgacttatgaatgtgaatctgtgggccaaccgcaagatcaagtctcaagctcaattcgacgtcctggttggcaagatcaaaaaacttgaaggagcctgggatgaagtgcttaccctggtggcccaattggttcagcgcattgtctttaattaccaccggccgagtgcccttgatgcttttggaatttcgacaagctgagaagtgcttcggataatatttcaagaacatcaagaagctggaagtataggagcagtcttacgttggcaggaccaattttcttatatccagggtgaccgttaatgcctttgatggttttgcaaatggaacaaccgaaaaacttggtcttgaccttattagcgatgcgcagaagccacttgacagatgctgctgatgtagttgagagattctaggacaccgatcatggaccgactggttctgataattgtgatgatgaaaagactgactaactaatgtaccaatgattttgatgaataatgatgatggaggcacaatttgtgcaatactgatgaatttatgttgggcttgatatcttagcttagttcgtgatttcttaaaagtgtttgtcaaacctggttgagcctaaaacccgcaaaagttggtaaaaaactttcagtcctcattgagtaagccaagaaatcaaacagggcaatgatacatcaagtaagcaaattgaattcataaaaatcacactccattattatcatagtagccccctgactgaaaacttcaaggaaaaaacttgaagttagcagtcaaagaggaaagatacaaacgaaatgcctaagcataaaatcgacgaaggtgttcaatattccaagaatgttgatgagagtaccgtcttcgcgcttgagtcgataagaacctggccgagtaacttcagcaattatgaacggtccttcccataagggagataatttatgccgatcctgtgttgtttgaattttcctcagaaccaggtcgccgactaaaaaggctcgcgatcgaacattctgattatgataacggcgcaacccttacaaatatcgagtcgactgaattaaagctgcttctcgagcttcttctagtcgattgatgtcgtctactcggccctcttcatagccctcctcgttgaagttccgaaatcgtagtgattcaaattccacttcactcggcaacattgcttctgcacaataaaccaaaaagaacggcgactggtcggtggcccgactaggagtagtgcgtaaagaccaaagtacggacggcagctgatctacccacttgccagcgtagggacgtagtcggtcaaaaactcgtgctttgatcccttgaagtatcatgccgttagcacgttcgacttgtccgttactcatggggtgtgccacggaggcgtaacaaattttgatgccaaagtcttcacaaaagtctttaaagctccgccagtgaattgagtgccattatcagtgatgatccgattaggtaccccaaaccgatgccaatgttgatgaaaaaatctctagctttatctgctgtgatcgtgatgaccggtttagcctcaatccacttggagaatttgttgatagccacaaagagatgcgtgtaaccgccgactgcccttttaaacgagccgaccatgtcaagcccccagaccgcaaacggccaggacaacgggatggtttgcaactctgggctgcaaatgagtttgtctggcaaaaaattgacaaccttcgcatgtccgcacaaacttgtcagcttcaaacacagttgtaggccaaaaaaaaccttgccagtaagctttgttgacaatggtccgtgcggcggcttgattaccacaaatccagaatgtatatccttcaccaattgtctcgcttcttccaaagacacacagcgctgcagtattcctgatggacttttcttgtacaactcagcctcatgaataatgtaaagtctgctgcatctggaaatccgctcggcttcgtttttgtcttgagggagttcttgcctgctcaaaaattttataaacggttctctctagtcggcttcgatcatgcttatgccttgagtatccatggcttcgactgtctcttttctgggcacggttggttcgtaaaggtgttcgacaaacacatttgaaggagctgcttcccgttttgaaccaaaattggccagtctgtcggctgcttcattattatgtcggagaacatgggtgagctcaagtccatcaatttattttccaacttgtgtacctcttgtcgataagcggtcatattatcatctaggcatgaccactctttcatgacttgattgacaaccaactgagagtctccacggacgattagtcggcgaatacctagagataatgcaatccttagtccatgaagtagcgcctcatattccgccacgttatgggacgcagaaaaatgtatccacaatacgtagctcaatctttctccagtcggggaaatcaagacgaccccagctccagtgcctgtaagcctctttgacccatcaaaatgcatag

SEQ ID NO: 8888 - DNA, 1918 bp, Oryza sativa
tttgaatcatgcgttgataggttgctcctgcgttcttcaatccaaagggcatggtgatgtagcagtaggccccaaagggcgtaataaacgaagtcttcaagcagtcggattcttttagtcggatctgatgatatcccgagtaacagtccaagaagctgagtaactcacagccggccgttgaatcgaccacctggtcaatgcgaggtaaccgaaaagggtctttgggacaagatttgttgaggtcggtataatcgacacacatgcgccattgccccgtctttttccgaaccaggactgggttagccagccagtcgggatgaaggacttccttaatgaagcctgctgctaatagcttggttaattcctccttgatcgcatccttcctgtcctgtgcaaaacggcggagtcattgcttgatgggtttggcgtcttccttaacatgtaaagagtgctcaatcacctctctggggataccaggcatatcggatggtttctacgcaaaaatgtctttattattctgaagaaaggtgatgagcgcgctttcctatttacaatctaactcagcgcctattacagcagtcttatcaggatcggagggatctaagggaatctttttcgtcttggcatcactttcttcggtcttcgtcagcttggttgcaggcacttctccttcgcttgccgtggtcgcagccagtcggatctcttcgcgggcgagagtagtctcgtgggtttgggccatcttgcaactttctttgtcgcatgtgacggcctgcttgatgtcgctccgttgtgatatgactcctcgaggaccaggcatcttcatcatcatgtaggtgtagtgtgggacggccataaatttagctaaagccggtcgtccgagtatagcatggtatgctgtctcgaaatcagcaacttcgaaacaaacattttctgtgcggaaattctctcgagtgccgaaggtaactggaagagtgatctggccgagtggtgtagctgacaatcctgggataacaccgtggaagggtgcattactcggttttaattccgtgcgaggaatctgcatatcgtccagggtcttagcgaaaaggatgttgagtgcgctgccaccatcgatgagagtccgtcggagcttgacattgcgaaccactgggtctagtaccagggggtaccgccccgggtggaccacttggtcgggatgatccgagcggtcgaacttaagtgctatctctgaccaccgaagatattggggtgtgttaagctgaaccgcattgatctcccgttctgttagcttctgttttctcttagactcataagccaggggtccgccgaagatgtgattaagttctttgcgatgatcttgaaaaccagtcggggcatcgtcttcatcgtctttcttctttgatgtgccttgatctccgtctgaaggtttacgtgcgttcttgacgtattgctccgtgaactgtttgtagacgaagcaatctttggccacgtggttggagttgggatgatgcggacattgggagttcattatcttgtcgaaggtgttgacgcgggaacgttgtcgggaagatggagagatggtcgccacaagttcttcgggcttacgcttgcgatccttgtagttgttacttccactccctcctgcagtcggcgtgtccttctttggcttctaagtggtgcccgactgtttggacgcggtgatagcatcttcggctggggctactcgttggctttttcgaacatctgcttaaccgtcctgggaggcttagtccgaacttgccgactaggtcgtcgtggcgaatgcgtttagtgaaggcggcgatgatgacgtcgtcggtgatgtcggagatcttgttgcgttgttcggagaagcgtcagatgtaatctcgaagggattctccagacttctgaacgacgt

SEQ ID NO: 8889 - DNA, 14340 bp, Oryza sativa
aatgggagatgtcttggcagtgaagacagcggccaagtcatcaggaagtttcatcaggattgagggataggacccatcgtcttgatctggtcgcggaagagtagattggatctcgcccgagtggtttgaagccgactcgggagagatgatcttggagtaggcctcggccgagttcggaataccgaagggcacggggacctggtctctccccgactggtttgaatccgagtcaaggagagagatcttgccgaagtcgttggtgatgaagttgaggctgccgaactgaaacgcctgcccgggggggaaggcgaagtcgtcgatgccagaaatgaaacccatcgcacttagtcggcgagaacttgacggacccctacctggcgcgccaactgtcgaaacaagatttcggcaataataaaagggggtggctatcaagctaggaaagtggatgggtttagagataaggaattttatacaggttcaggccttcttattcaagaagtaataccctactcctgtccggggataattccgccaagtgtgttattgattgtatgattgggagaaaaaagaatcgtcccaagaggaacccggacctctccttatataggggaagggatccgtattacaaagtacagtccatatcctaacggaatatgggattacagataaaatacaatcgtaaccgactaggatcccgggtattttcttgacatacaagtttagaatctaacccgagtcctcataaagatattctatctatatttggtaccgtatatccagctggaatataaccgctatgtagatatggggtaaccataatctccacagatatacaattctttttcttaaaaaaaagaacaacgttaattaattaatccattttgctttctgatttcagctttgactagttgatagagggaaatcgtccacccaagagaacggtagcaaaatctggtttactgccgcttactccatatttgtacgatagcagcttcctgtgtttccatcttgtcatcttattcagaattagatattccactcctgtgctttccatcattttaactttgcataaaaatgtaaccattcattaccgaagactggccctctcgatcatattcatcgatcgagcgaagcaatgcaccagccggtaagaggcagaagatgaaatggcatgctgataacccactcataaatcacaccaacacaaaagaagatacatcattatttaagaagcactcgtattgatgagtctcaatctaaagttaatgaaaatttgcataaccttatgcttcaaattaattcaatccccttttcgattgttatactttttttttgttgtgttgtaagaatgggtcaaactattatttctgcataagtatagcatatgcgtacgacggaaccatcgtcacccacctttacaacagaacaagtttacaaagtttagagggaaactcttttaatccctcgatagtatgttttgtagttctaatctaccagttccaaaacctgacccctataacctcgtcccatccccctgacgttgaaacttggtggaatggaaccaaccatgtgggaagcaaagctcaaatacggattatcagaggctcgctacttactacttggtggaacatcttgcaagaaagaaacagaagattttttcaaaatttttacttctcagtaaatgaagtagcacatcttatcaagcaagatttggatttgcgcaaactagcttttaagccccccctgatttactttgcttcttaagctgtatttcatctctattacagtccctgtaaactctttgctaggcttcggccttttccctaatttaaattccagcagaacttatgccgtcgttcttctaaaaaaaagtatgttttgccgttcttagttaaaatttaatttgttgtttttttagaacttatgcagaccgaatatgaacttgcatattggtgaactcatatatcagatattaaaggagtgtttggcatagctctagatccaagatttcttagagctgggtatttcaacctctatccatggacctggaactataattaaattgataacatttgaattaatcattttattttcattttaggtgaaatatagaattttgaaccactataaataaacatacaaacttcaaatccaatgtggatatgagaactgtaattgtgccaaacaagacctaatatgaattgaacatttcctcaattctttattatcatcaaatctgatcaaagaattttacatggctttcaagtatgaatacaaaatttttaaaaaatgaagtattacaaacatgcacttgacacatacataccaaagggcttagcgcctcttgttcttgctgccaaagtgcagcacgatatagaacagaaaccggaaaaagaaaccaaacgccacggtgaccagcaagcacttccacctgccgatgtccgtgacagcctgctgcgccagcacgtcggcgccggtcaccacgcacgtctccgccgtcaatggcgcgccgagcgtggcgccgatggcgtcgagcaccttgagcttgacggccttggacatggcgccgatcggcgtcccgtcgaacatctcgacgccgcgggagaagcaccgcgccgcgtcgcggaactcgttctggagcaccgcctggtacggatacttgaccagcgacaggtagtggaaccagatccagtagctggggatgcggtcgcggttgatgaagaagccggagaagagcaggaagtaggcgaggatggcgacgaccaccgtgtatcccagcatgacgtgcggcaccaccgcggacaggaacgtcacgaacccgctccccgcccagaacgacgccagcacggtcagcgcgaagaaggcgaacgacgcgccaccgccggagagcctgacggcgaagaaggtggtcaccgcgaacgccagcgacagcaccaccagcggcgggaacgcgacggcggtgttggccaccacgtaggagagtctccggtacgcgttgtgcgccgtttcccggaggtagatgtggcgctcctggacgaacaccggcagcgcgtcggcgcagacgtagaacatggtggacatggccatggcgaagaagccgagacgctcctggactcccttgggcgtgtcgtcgaggcgccagaagatggtggcgaggatgaaccccgtcaccatgatcgtgccgagccgcatcacgaacagctccggcatgcgcctcgtgttggtgaacgccctcttcatcagcacccacacctccacgtaccacgggttcgcgtacgtcggcaccgacgtcgatgacaatgtccccgagccgctgccggcgacgagcttccccctcgacacgctctccgcgatggcgagctcgagcggcatggtgcatcgctgactgcggtccttgtcgtccttggtgtccaggagagcgccgagcgatgattgccatcttgagctgaacttgacgagcatggcggcgccgtcgggctggtgctcgagctcgcggatggtgtcgagtgcgaactcgacgaggttctcgttgtccgggatggggtagccgaacacggagaagaagggcttgagccccgacggcgagccggcgtagacggtgcggccgcgggagaggaggaggaggcggtcgaggatgttgaggatgcgcgcgctgggctggtggatggtcatgacgatgacgctgccgctctgcgcgatgcggcggagcacctgcaccaccatgaacgcgctcgccgagtccagcccggaggtgggctcgtcgaggaacagcaggatggggtcgtggacgatgtccgtgccgatggagacgcggcggcgctcgccgccggacacgccgcggtgggcctcgtcgccgacgatggtgtccgcggcgcgggcgaggccgagctggccgatgagcgcgtcgacgcgggcgcgcttcttgtccggcgagagcgcgcgcgggaggcggaactcggcggcgaacatgagcgtctcccgcaccgtgagcatcgggtacagcacgtcgtcctgcatgacgtacgcggagatcgcccggacgcggcggccgtggagcgcctcgccgttgagctccaccctgccgcggaggctcccccgcgcgatgcgcccggcgagcgcatcgagcagcgtcgactttccggacccgctggcgcccatgacggccaggacctcgccgtcgcgcgcctcgccggagatgccgtcgagcagcgccttggccggcggcgcgtccgtcggcaacggcggcagcaggccggcgcggcggctgccgacggtgtaggagaggtcggtgaacgtgagggcgtacggcaccggcgtggattgggcggcggcgtcgtcgatgtcgagcacgacgcagtcgccggggaggatcgccatgtgtgtgttgtgtagagtggcacaaaactcgggcttgtcttgttgacttggatgatggatggatgggagagcgcgcggagtgatggcgatttaaatgggatcgattagtccgaggtggagtccgactcggtcggacgagtccggctcggtcggggctctatagaccgagaccgattcggcacgtcagtagtacaagagagctatattacggcgaaaatgatatacgtgccggtacaaccttgttgtccagctattgtgtcctccatactattctaagtgcaaccataaattttcgtgtttaaatttgatcgtccatgttgtttaattttttttaattagtattttattgttatgggatgataaaacataaataatattttaggtatgattttttttaaaaaataaataaaacgaatgaacaaaatttagtacggaaaagcatgattgtacattaaatgggacgaagagagtatgaccatagccacaatgaaaggctcagacggcaaatgtctcattctgtaatagaatctgacacgcgcaggtgatgccgtaatgaagtcggccatcagtcgaacactggcgtcgtatatatacatccatatatgaccactggcgttcatattactgtggagtagtgctatacatccaactctcatacaactgcgctgaaccaatcaatcacggagttcataagcattcacttggacctgtcaaaacgatttaaaacttgagcttatgtacagtgatatgcaggtcgaacaggtgcagtcgtacgcacacttagggcctatttggttgatgccctcaccaacatgcctgaaaaatttgggtgcctgagagctacctgataggatgataaattttgcctgctcaggcagcctgaacacttgtctcacttgtctgtttggttgttcttccgcgcctgtgaaaactaaacgtgattaagcttttaattattacggttgttataaagtgttagcaaaaaaataaaatatttggatgtgttgtatccctccttgaaagcacaaataaaatatatttgtatggtcggttgcttctacaatttacagtacctatactacattattataagcggtaattaggattaatgagcgtagctgcgccgccctggagctcgcctgactcaggctaataaggctccaaaagagctcaggccagggaaggagaaactaaggtcaggacaccaaccaaacaaggtcccggctggtctcaggcttacgtctggtgtccaaccaaacatgcccttattccgattactgcgtgctttactgcttttaggctctgcttgttaagtgctactccaaatgcccgctgcaaagcgtgttagtgatggtctctttatggggtaactggggtaatcttgacagctgcaaagcgtgttagcgttagtaactggggtaatccttccttatgctctctttatgggcattaattccaagcatgtttctgaccaacagaaacacgagacaagagtacaagacaaatgtagctgtttacagtagctactagctgcacacatttgttgccacgagctgacatgagatgagattcagagtacgaagacgagaagtcgagaacacctgagccaccacaaacttccaaagcagcttctgaggtctacaacaacatttagcacttcaaagataaaaggtaactgccatcgacgtcgttcagcgcgcaaagcaacaaaattttcaatctgaagatacaaatctatctgcaaaaacaatgtgatttggaagttcaacggaccatccatcgtacaccaatagcaaaatacgctgtcgttttgagaaaagaaccaaatacacttatctcgtcttaaaacaggactgtgactattacaaccatagcatgacattcacaaagtaacaaaatacgctgtcgtttttgagaaaagagcaaatacactcatctcgtcttaaaccgggaatgtaaccattacaaccatagcatgacgaacgccatagactgcgattaaatttcaggcttcaggagactcgctcggtctaggtgagcgtgagccaccacggctaccaccgtcaccatttccatccctaggacttcggctaccgttgtccattgggctagggcttccattgttccttgggcttgggctgcgcccgttggcagctgcagggctacggtagccatcagacgggctcctgctgttctccctgccccgggggctgtcaccgtgatctgagccattacgctcagcattatccttgggtggtgggctcacctggtcctgtggactccttggactacggctaccatcaggggtggggctgcgcttcttttcatttgctgctggggagatggatcgcctgggactcctgctgtaactaagactccttgatctttcaagctctctgcgtgccctgggagatccagacagggatctggacctagaccggctgatataaagaatgtaaaagaagcagggtgaggtcaacataacatatctgtgatttggacagacagcatggtgtattataatttgaacatgtggcgtttgaagcatacctgtaactgcggctccggctccggctccggctatagctccgactgcgaccacgtccacggcgtggcgatggagagcatgaataacttctctcacgcctgaaaaaaaaagaagtatgcattggagaaatctaagttaaattattcaaatacagtacctcggaacaattgcaagtgctgctctttatcagatcaacttatcaatcaatacctgagatttcttgggctgttttgacagtttctttctatgtgacctctctccccacagcggtaacatttgttcttccagtcaccagccttgcagtctcttgcccagtgaccatcaatcccacagttaaaacaccgacctgttccaggaggaggtcctctccccatatattcacgtgaaccaccaggaccacgtggaacctgcatgctcaatttgttgaaaagagcatcagtcaacaaaaaatacagatcaattcagcagcagcttcatattaaagaaaaaaaatagaatcaggatgtgcttagagaagcaaccgaagaacagcatacccctttagcaaactcaacaagaatgcggcttccatcaacatccctgccatcaaggttgtaccttgcttcctcagcatcacggggatcactgaactcctgtttggtaaaagagacatccgaaaaatgttggacttgtgaactaaaaggtacaatttagaaaagagagaaaaaaatgagggaagaataattcacatacaataaatgcgtagtcgcgcttcaactccacttcacgtattctgcaccaatggttgccaaacagtaagccatcatgattcaagtactcaaatgcatcaccgacttgcaacgtccactaaaacagtcaataacattacaccaagggcgcccttcaacaaagtcctcgacaaactttggaagaatggccaccaattccaccaagggcaccccttccaccagaccatcacagacctcccggtttgtgtaaaaaaccgaaaaaccttcaacaagatcattcaagtcaaacacacaagacccggggggtacttctacagcatactttaagaattaatagaaaatgccacaccaaaaggcttcaaggaactcgtccacaaagtagctgaaaaaagagtggtaccactgaacccaacaactgctatgagctggcccattggaaagggtaggaaggatccagtgcttactagtctatgctcagcacagaagactcgcacacaatttggaaaggttacaattttaatgggaaataattaaatttctacagtgaaatttgaacgtaccaagttgttgtaatatcaactgtttagcaagtgttatcatagtaatagtgttttacatttatacacagaaaatgcagcttattacaaatttaacagaaaaaaaatccataaacttctgcaaaaaatctgcgcttcagagaaataaaatcttaaggaccatggttctgtccgtaccttccatatctgctgaaatggtattctaggtcacgagaacgagtgcgggaagacagtctaccaacatacaagcgcgtgcttccataacgatcatcatagcgcggcatctcctgaagacaacagcaaaaatacatcagtactattcaaaatctaatgaatgattggaaggaggatgaatactggtacaaatgaagatctacagttagtggatgcttttttatgcaggaaaaactaacggaatagaagtttttgataattacaacatccatttcactacagaatagactcatatttagggggcctagcaagtaatcacattagaggatgagctatggcatgattagataggccttgccgcccagagcagcatacacaagatcaacaggcatagatgcagccattaaagttcacaaagaatcagttaaggcaagtctagccatagcatcccctataagaacctgtaatcttaggactaacatgaaataaatctacttgacgtgcctgcaaacaattcaatgtaactacaaagaatcacaatatgagcaattgtagcatcttaggttgcatgaactaattaacacatagcagagactaaaaactggggcgcttgcactatatgatagaatcatcaatgtccacttacaaagaaagcagcgcgtcaccaacagtctatgctatcattaatactcacataaacctatacataagaggggtttaagcacaagggtgggggtttaaacatatgggtttaagaggcttcacagctttaccctttttacttgagctttctgatttcaggtcaaaaattatctagagcttgttacttgttgccctcggcgaaaagtaaatccaatcagatgcaacatgaccaaatcctctctgcgagcggcacacaggcgacgcgaagctctacaaacccgcgccggcgatcgatggggcagccatggtcgatggcctccaaatctgacatgttcgattccgatttcgctcctatcccttccttccccacactaggttgctataatcgatgaaacaaacgaacctacggcgagcgcgcgcgcgcgcgcgtgcaggaacggaatcgaacaacagcgagagaaaaattgagaaaaaaaaatccggagctcggggaggaggatctcgaaccttggaggagaatggcggcgaaatcctaggtcgggggcggcgcggatgcggcggctgtcagaagggcggagctcgggatgtgggaggaggagggctatttattcggcgtcgcagatctggatggacgggtcagattgtctacgggatgaatggacggacaggattggtttgagttgtcgtgtttcctctcggcggcgcggggcacgtgcacgttcacgccttctatgcttcacaccaacgttcaccgagtcactgaatggtgggccgagcaggcccagagcccagcccaattgtgatgagaatggcccatgtatagttcattattttaggctttgaactttataaatactactcaaattttcatcaagaaatattcatattgatggtgctatattttccatcagaaaatattcaagtttttagacatctgtttatactataaactccatatcatagactacaaattttttatatacttacgatgcaaattccaaattgtacgctacaaatttaaaatctcacactataatttccgtaattctccgtatatagaacagttgtaagaaaagcaattgattgcgcacttgatccataccttacattcttgattacacattgctgactttatcgtgatgagtaaattaaatttgcacagtcgattgtttagcctgacacgagtcttcaagtctgaacccaaatcgagccaaccaaacacgctcctatataaaggccgcgaccaacacgcaccgcaccgcaaactaacaccgcggtgtgatccattctgcaagtgatccgttctgcatggcgacctccgcccacacggtgctcgacgtcgactccggcggcggcgcggcgaccgcggcggccggcccgccggtgccgtacctgctgtccttcaccgacctctcgtacagcgtcaggaagggcggcggcggggtcctgtcgtgcctgccgtcgagccgccgccgccgccacagcaaccgcctggcgtccgcggacgcgccggcgccgcccgacgcgcccaccaaggcgctgctcgacggcatctccggcgaggcgcgggacggcgagctgttcgccgtcatgggggccagcgggtccggcaagtccacgctggtcgacgcgctcgccggccgcatcgcgcgggagagcctccgcggcgccgtcgagcttaacggcgagccgcttcatggggcgccgcttcgcgccatcttcgcgtacgtaatgcaggacgacctggttgtcccgatgctcaccgtgcgggagacgctgctgttcgccgccgagttccgcctcccgcgcgcgctctcgccggacaagaagcgcgcccgcgtcgacgcgctcatcgaccagctcggcctcgcgcgcgccgcggacaccatcatcggcgacgaggcccaccgcggcgtgtccggcggggagcgccgccgcgtgtccatcggcacggacatcgtccacgaccccatcctgctgttcctcgacgagcccacctccgggctggactcggcgagcgcgttcatggtggtgcaggtgctccgccgcatcgcgcagagcggcagcgtcgtcatcatgaccatccaccagcccagcgcgcgcatcctcaacatcctcgaccgcctcctcctcctctcccgcggccgcaccgtctacgccggcacgccggtggggctcaagcccttcttctccgagttcggcgaccccatcccggacaacgagaacccggccgagttcgcgctcgacaccatccgcgagctcgagcaccagcccgacggcgccgccccgctcgccgacttcaacgtcaagtggcagtccatgcacgccgcactcccggcagctgacagcaaggacagcaagcgatgcaccatgccactcgagctcgccatcacggagagcgtgtcgagggggaagctcgtcgccggcagcggctcggggacggcgtcgtcgacctcggtgccgacgttcgcgaacccgctgtccgtcgaggtgtgggtgctgatgaagcgatccttcacgaacacggggcgcatgccggagctgttcgtgatgcggctcggcacgatcatggtgacggggttcatcctcgccaccatcttctggcgcctcgacgacacgcccaagggagtccaggagcgtctcggcttcttcgccatggcgatgtccaccatgttctacgtctgcgccgacgcgctgccggtgttcgtccaggagcgccacatctacctccgagagacagcgcacaacgcgtaccggagactctcctacgtgttcgccaacgccgtcgtcgcgttcccgccgctggtgttcctgtcgctggcgttcgcggtgaccaccttcttcgccgtcggcctcgccggcggcggcggttcgttcctgttcttcgtgctgatcatcctggcgtcgttctgggcggggagcgggttcgtgacgttcctgtccgcggtggtgccgcacgtcatgctgggatacacggtggtcgtcgccatcctcgcctacttcctgctcttctccggcttcttcatcaaccgcgaccgcatcccgagctactggatctggttccactacctgtcgctcgtcaagtacccgtaccaggcggtgctccagaacgagttccgcgacgcgacgcggtgcttctcccgcggcgtcgagatgttcgacgggacgccgatcggcgccatgtccagggccgtcaagctcaaggtgctcgatgccatcagcaagacgctcggcaccaacatgacggcgaacacctgcgtcaccaccggcgccgacgtgctggcgcagcaggccgtcactgacattggcaagtggaagtgcctgctggtcaccgtggcgtgggggttcttcttccgggctctcttctacgtcgtcttgctcgtcggcagcaagaacaagaggaggtagagagagaggggccgatcatgttcagctgatatgatgtctgaattaatgacagcaagaaatgtgtgatatgctagtagtgtatttgtttgtgtaattttctcattttgttgaagatgcagttcatgtatgtgaatgtgttcagttttactggctgttatacactaaaacatacagaattacatgttgatatactgtttctcaatgacccttctgttctgaggctctctctgattttatttttatgccttctactattattattttttcaagggaacggcaaggagctcctgcatttcactatagaagaagagagttgatcaatgataaacagatgttaaaaaatgagtagctctttttgaacaaatgtgcaaaactatatgttctgtaacagtatatgttcaatagtaagaaactatatttcacagctacgataaagaaatgtgcagttgtatatgttgtgtacaactgagagttacactgttattagttaatagttattatcaacaataaatatgtcacacagttaagaagatgggcagcattgaaaatatcaaaagtaaaaaaaaaaaggcatggtatactgaattttgtaccatttgacgtatgctacctaactctgttttaataatcatatatttccttcctctatctgtttttagctggtgccttgctcctggctaaatgataatgacaaggatgcaacaagttgttgcacatttgggtttcctcaaggaaactgaaattaaaagatgttcggttgcattgatccttttgttgaattggtgctgccaaaaaggcatggttttctatcatcattcggatggttagttctgccaaacagtttaaatttgtagtattgaaaaggttgcaccacacatgatttacttgctcaatcttcaggttcaggtcagcagatgggtcagagggagacgtctgtcctactagcttatttggtcagtatgaaatggcggcttaaagtttcagacacttcagctcaaattcttctgatatggtacatgtgtacaaccagctgttacactgtcttcagagacttgtatttccaaacttcctttttcttctgaagcaggttggtgcaaacttaacttctcaactttgccaaatactagggctcttgtgctagtagaaacatctgtcttgtcaagttgaacatgcattactaattcaagaaacttaccatggagttccatgttgctgaaatcatgcaatggattatggatgtacatgtttcagacaccttttctgacagtaagaaaaacccaaaaatgtttcataagattgttaacccagaagtaatagttaagtactattggcagattcgactgtatacatcgatccactttggatgtagaggctgagttttaatctttttttaaaaaaaatgttatagtataaggcagctgaaatgcaaccgtagttttcttgtacacgacatgtatgtacatatatctgtggtcaaatacctgtcgtgacggcgacacatgagactagtggtttggcctgtagctgcaagtcaagagcgaggcaggcaaggcaacctgaattttgagaaacacagatgtcacaaatttgccggtttgttcatcacaaggaaaatgtggcttcagaaaggagaattcgacaagatgccaatgccaaatggatccagagaaagatgatggatagatatccattcgtccatcatgctaagtaggattagtatctatcagctaaatctcatctccttacgtttctcaatgaggatgcaacgccattggctgatccatgttttgttcaggtgtttgggctacctctgatggctcctgcagccacaccttttgccttgctttcaaaagggtctcggagaagaaaccaactaaagctattttgttttaaagaatctagggga

SEQ ID NO: 8890 - DNA, 4730 bp, Oryza sativa
  unsure (1)..(4730): unsure at all n locations
aaaaagaataacatggcgtagctaatcgcagtcatggagtcactttctcatctgcatgaaaaccatcgtaagccgtaggaacatgggcttctttggttaggtttaggtttattggcttaaacttttaagtcaacttattggcttatatgatttataagttgatggatttactgtcctaagtttaatgatggagtcatatatctatcgtacataagtaaaaaccttctccatctaacttttagcttaataatgtttggtttatggcttaaaaaaaccaaacgaaaaaactaggttagacttttcgacttataagctaacttataaatcttgaccaagagggcctatattcaacacatattagtatatgatatatacgggttctggttagcgaataagccaatgtatcagtgtcaaggaggttggttaatcactctatccatctgcctgttaaatttctaacaccaatgagttcatatctctttattttataaaactaaaatggtataaagctatagcttctggcttattcttaattttcagtatgtaatcaatattcaatcgatttttttaaaaaaaaggtccagctacttcatatatatgtatgtaaattaattactgtgtacagtactaggtacattctctagctacatgcatgcaaatgtgggccatacacaataatataatcgcacatgtcaccactgatcagtgttagttacgctatggtgtttatactaccctggcatacagtactttatatgcccatctgtccccataattatttctacctcattatctttgctttgaaaccatgcttaattaattcttgatcatatccggcccaattaattaattaattaattaagtaatttatgccttgcataatgcatcacatgacattatggtagtggtacgtgtatatagagctggcgtcatcatgcaattaaataattaattaagcaggtactagtacatacagttatatactactgatggtgaatgctattactcgcgtgtgtgcatagtttacgtacattctgtttcgttgtcaaattaaagaggaattttctttgctaccaagcacacaactcgtacaagtactccacttgtactgtcgattgatcttccttacaagttttgtttggttggcagtcacagcttgcaaagcgtgatgcgtcgcaattgtgtgatcattaaccttaaattatgttcaaaattaagttgatattgctttgcttttgaaacttatttattttataaagccttggtgatactacatttatatttttcctctacacgaaagataactgcacacatatcgttctacacgcacgacttacatgcacccccggacacacgtttaaagatacggatatcaaccatccatgatttcactgaatttctatcaaaagcgcactcgtgtgtacatagtattcgacgacatcaaaatttttatctttgatagattaagtcatgcacccacgactgcactataataccagcggtgctttctctcatttttttcaaatccaccatgatgaaaaccttacatttctaactctattttttatggtatttaccggattgtgagagcgtacataatggctttctttagcttgtgtcaattgtattataatatagatttattctacctccgtcccaagaaaattgcatttctagctctaaggctttgtcccataaaaattgtatttctagccatgtgggtcctaacaaattgattcatctagataagtttccttaagttctctcagcttgtaattaaagtatgctaattatatgggttaattctctcaaacttccttttaatcatttatatatatggaatgtgtgtatgcaatgggttcattaaataaggtcattggggtcatttttcaatcctattgttttgtcctaaattagctagaaatgtaatttttatgggatggagggagtaaattctctactatacacaaaccccagtatttatatagatatggttgatcaaccttacctcacttagccaaatgcctccaaagatcagtccaaatggtttcccaccatcttaattaaagaaaaagaagaagagttgagagtccaaacagtgccactactcactagtactactactgcttgtttctacttaccaccacagttccataataatcaatttaatcatgcatacaatggtttggtgggcaatgctaattgctatggcatcgggatgcaatcaccatcagtaggtgaagggagttgatccatgattagcactcaccagctagcttagctaatcgctcgccgctgccgctgccgctgctggtggtggccgtgacggtggcgctggtggtggtggtagcatcatccatcatctttgtctttggcatgtgcctccttttgcctttggctccctcctctccttccttccttcccttgtttgccttttgcctttgcagcctttttcgcaagggagcccacgcctccctctcgcttcttctcctcctcctccttctttgaagagcgaagagtgaagtgtgaagagttctctcttcttcttcttcctcagccatgtccacaatgctgccctccaaatccaggtgtgttcttggtagttctctctttgtgtgtgtatggattggttgatgttggtttgtttggttgggggatttgttttttgttgccttgtgttcttggcagatctaaaccggtcactgcgttcactcagatttgtttttattttttttccctcgcgctgttcgttccaattgagtactggattgtgctcgctctcggaatctggaaaatgtggcatcttgaacgaattggataggtttcagttggaacggcttcttgatccgctcgattcctcttgttcttgctgaagtttctgttttttatcccatcgatcgcgggatgaaaatgcggcttgctcgaacctcgttgatttggattggagctttccgtgaatcgcaattaatggcggtgacattgacagatctgggccgaacgagtcccccatcagcagggggcggccgagcacgccgtcgtccaaccaccggccatccacgccgtcctccatccaccgcccctccactcccggcgccaccaggaggagcatcggcggcacgccgtccacgccgcgctcccgcaacaacggcgtcggcggcggcggcggcggcccgttcaagtccgagcccaactcgccgccgtcggccaccgcccgcccccgcctctccttcgaccgctcgccgagatccgtcgactccaagcccgtcgtcgagcgccgggttcccaagatcggcactccacctgatgtaagtgcattcatatatgcaagcattgttgtgtgagttgttgatgctaattgtgtgaattttttgttgtgtgagttgttgatgctaattgagtgaaatttttgttgtgtgagttgttgatggtgattgtgtgaaatttttgttgtgtgagttgttgatggtgattgtgtgaaatttggtggaatgcagaagcagccgaggaaggaggcggagctgcaggcgcggctcgagtccgcgcaggaggatctcaagaaggccaaggatcagctggccttcgccgttggcgagagggatcgccttgtcggggagctgaatgaggcgaagagggttgctgatgagacgcatgagaagctccaggatgcgctcatggcgaagaggtgggccgaggaggcaacggagatcgagaagttccgggcggatgagctcgagcaggcgggcatcgatgaggcgcagaagcgggaggaggagtggcagagggagatcgagtgcgtgcgtggccagcacgccgccgatttggagacgttggtcactacgacggaggagctggagagattcaggcgtgagcttgcgatggcgaatgaggccaagaaagctgcacttggccacgcagacgatgccatgaagatcgctgaggtcaatgcggagaaggtggagatcctctccagtgaagttgtccgcttgaaaggactgcttgattcgactgcagagagcgaggagagtaaaaaccgtgaaaccgaggagcttgttaagaatctggagtccgaggtttcagttctgaagggcaaactagaggaagccagaattattgaggagaggttagccgagacggaaaaactgattgaggagcttaaatcagaggttgctgatgcgaagaaggccgaatcagaagcccgtcagctattcgaagaatggaagcacaaggcaggattgcttgaaatggaattggaggcagttactctctcagataagttcaaaggtgaatcgcttgcctccacaacagaagaattgggtaagatccagtctgcattacaagatagagaatctgaaattgaagtgctcaaaggaaagacaactgccttggaaattgaggtagcaaggcttttagcagatgtcaacgaatccaacgagcaatttgatgcatctcagcaagaggtgtttgggctacagacgactatagatgttctgagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8891 - DNA, 1092 bp, Oryza sativa
aagtgacactaaatatgaaaccctgcccagtcaaagcgtcagacctttgtgccatcaacatcagaagcaaaaacctggccataatcgcccttgtcatcctcatccagatagtcagaccttgcattgagagctagcatctggcaaacaagccagaagagagcagcatcaagggccaggaaagcggctcctccaaagaggccagtcttcgcagtagggcactgggtatccaggtcatggtggatgttgttgcttcggtgaagaccctcggtgaccgttgcccagagcaacattgcaaacgccagagctgagacaagcctgatttcacaagaatagatgatgaaaatgtatcaatggagttagcaggaaaacaaaatgcaatgtcgagattctcaaatatcagcagaattaagctagtcccactaaaaattttgaatacaggtaattcttttgatctgaaaaaaaaatgtgtcattggcacagcttagcattaatctatggaactgtacacgactaatagaactactaacacctttagggtccatctaaggcaatgattccacaaaacaaatatgtattttttttattaattaataattttgtagctaatcataatcaaatgaaggctcgatgaggtggatccgcatcaatgccagatactactgcttcaaatgcacatgaaattgttagctgcagatctgagaatcacttactcagcaataacgaagaacgcagataagctggcgcttcgaaataatgctccgcgaggaacagacttgctcttgtatggatagaagatagcggcatgccctacgatggtggttaacacaagtgacaccacggagaggcttcccattgcaatagttgggtcacttgggaacttgcagatgacaacatcctttcctttgataggagttccataaggaggctgcatcaaagaccaaataaaattcacaacaagtaacaattttcaaaagttcataaagagtggcagttgatgaaagatatagcgcagcagaagatgtgttactaccctgcactacagttaaagtgtatcgggaaattgcaccaagtggtcatcatagtgtctattga

SEQ ID NO: 8892 - DNA, 4579 bp, Oryza sativa
tttcaatttcaaccaaactttcaattttaatatgaacgaaacgcagcctcaatggaatatactaaatgaaattgaaattttatagtcctcccagtctcccatgctactgacgcaagatgtcaaagcacctttctgtctcaaagtgctgagtctgttcctgacacttccaaatccacagctccatcgagctgtctgattcccatgtcgtcggaaggaacagttgccaatgatatcccaccgtccgattcgtgccacgtgtcgtacgcttcatgtatacttgtacatcagactgtatattcatgttagcatgtatgatgtatacgtatctctatgccattcatgccttgcttgaagtatggaccaaggtttgcaacagcagatcagcagagcagagagaaaagaactggtctgaaaaattttgcctttttgccatgaacaatgatgctgtctcatgacactgtattagtactccaagatgcataatcttttttgcctttttttagatcttggtgaaatggtgatcggtgagtgctgtactactactagtctctggaaggaagaacacatcatcaacctggcattgacaagagtgattatctatcagtgacactgaagagagaggcagaactggcaatggcgtgcgtggtgactataatcatatcccatgcatgtgtagtgttgcctgcgccttcttgatgatggccattcgttttcagttcatcatcgatctagtgcttcacccatgtcctttgctttgacacatctttgtgcacaatggtattgtttatctcaacaacttgggggattgcagaaggtcaattgattaaattaactgttgctacttggtatctgttctgaattctgactgaaaacaggtattgctcttctcttgtctctccgtttcagggagggtgcagcaatttatgaaattgagatgagagaaataacaacagagaatgttgtagcttactctctgtttctgttttccaatatacttttacagggggagaagggatagatctcattactctgcttaaagatatgtacgcctgaatcattctgaataacagtgctacctgattattacctacctgaactttcagaaagtccctctatgtaatgtaacacttgacccctgcatatcacacacaatagaatcatcaatgaaacacaagcacacatgtacacaatgcaatagtgttcatgtccaccctataaatatattgacaaatgacagctgatctaagcacctggaaatgctgtcttgcacaacagaaattacttcattgattgatatccccagtctgaataaactaaaccagatcaaaatgctgataaatctagctcttattcctgctgtttttgagattcattttacttttagtccatgcatgaaaaaaaggcatgctacagagacctgttactttcagacttcagtgctggaaattacttaaaaggtgtaccagacttttgtctgtcctgatagctgctcatgcttaatgtttctttcctgcaattgtgcagtactactgctagctattgctcgctggcctaccattaattagtatactgtcctatcccctaactaagccaaataagcaaaggtttataagtagtgttcattgttaatagtcagcgtggttctcggtatacgcaccggcttatggtaattagtacttaaccacaagtgtcaatcatgtcaatccctgctcaattgttccataagcctaccatattttacagatcaatattactctgcaccatcacacagtgttgttgattgcacttgcatgaactgcacaaagttattacacacacaacattacaagctaatgcaaattccacgcaactacgtttaattaactgcacatgttgaataacaatcctgtcattcaatggatcaaaactagcatgacaatgacagtgctctgcttctataacctctcttgtttacttaagctcaaagattcagacagttcaggcagtttgcagaaggccacaaaatttgaccatggttaatcaatcaatcagttaattacacaattactcacatgtatgcatgggccgaccaggatggcattggcattggcatgcatccatgagcagcaatgcagcatcattggaggggatgcagccaccatcatgacaacacataattctcacagcctaaatcgcaacacctttccttgcaaccaaagccaaccttctagctagctagctaatctaagctatagtgtgttgttgtgaagtggagtactagctagctaccactctatcttcttcttcttctacctcctcctttatatcttgcccctcacatgcacgcatgcctctccatctccattgccgtcctagctagctagctaagctagtacactagctaggccatggcatggtggtgatcaagaaagcgagagaggtggagcggcaatggcgggcgggtgcaaggcggcgatcgggtgcgtggacgcgcgtgtgccggtgagggcgagctacgtgagcctgtacaagtggccggagtcggacgcggagttcgtcaggtcggtggccatggcgcggcgccacggcggcgaggcggcggcggcggcgccgccgccggagagccccgccgtgccgaccactactactacaacggcagcggcagcgcgcggcgcggcggcggcgaggggtggtactactgcagcccgaggtggtggacagctactcgtgccggcagatctacctccgcagctacaccttctccaagaagaaggagacggtgccggagcgcacaatggcgtgcctcggccgcgtcagggaccgcggcgccgccgtcttccccttgttcatcccgcaccgcgccggcagcggcggcggcggcggctccgacgccggctctgtcaacagcgcgagcagcatcaccagggagacggcctccaccgccggtgacaggaagaggatcaggcggcggcggagcagcaaggggtgcgccgtggcgcggaggctgcaggaggcgtcgtgcggcgccgtgcgcgcgctcttccaccgcctcctcgcctgcaccaccagcgtcgaggtcgccgacgccggcgagccgacgtcatcacgctgaacactaggcgcgcgcatgcgagctagctgctctagctaagcttgtgtgtttcaccgtgttttttcgtgtgctatacagtaaattaaattaaaattcctcctctcgagttaagttaagtacagtagctagcaagcagtaattttatttatttccacgagtagtaattaaactagcaatatgtatgcttggacacgtatcgatcggctgcctacttgtattgtgaatttgtgatgtaagttatttgtgtttatgttactctatttattaccacttgtcatatatatgtggaatttgcatggataattaaatatacttgtttagcggattcatttttgtcgtgttcgtcataactagtcatttgagaccgtttaccttttgtcacgtgggctaagaggtacttgggctgttgcgcctgttgggcagttggtgtaggcccaggcctacggccgaccggcatatagggtttgtgttataaaaccggtcttgaaatcacatcggaaaccaaacgcgaaagaaacatcataggagatccaaacatgatgacgacaccgaggtacgatatttgataacggagttcagccgaggcctacatctctggggcactgattacgagcgctcctcccctatccagcatatacagcgtatcagagttacaacgactcacggccagtcaccgccggcagccgctccctctcgctatgctatgtcgccatgcggttacaacaggcacgcccctctatttatgagagattctatgacagagtccgactcttactctagtcctaatacctattacaactacaagtcctaaactgtaacggattacgtacacatattcgacacaaactctgacaaactccaccttgacgaatatgccacgccaacctgaattcattacttgtttgaacctttgtgtacccggacttgagttgatcctattttgccgctcacgtcgagcagccccgacaagtctccaccaggctcaccgtgaacaagagactccgctatccctataatttctttctcctgactccacctgcaatagtgctctaccttctctcatatcactacagtcgtcttgccaaacgaaattgaattccttcatagctgtcacatcctaaacttctcgaagaccatgttcaactccatctaccgtcttaaatttgacttgatctaatccatggtcagataacccacgtcatcaccaaatagataaatcaaactcaccagacacaaagagaaccctttcttccttgtcgtcttgtgaccgagctaaaaatccaacatccatgcttcttcgcatccgtagactgagtatccgataatttgagaaaatcaccattgccttgaatcatccgaagatattaccaccatagcgcttactcttctccttcagtaacgtagattctatatatcctcatcatgcaaaccccgcagattctgaatataccctgtgctgctaaacagaccgttgacaccctcaacgat

SEQ ID NO: 8893 - DNA, 6090 bp, Oryza sativa
ctagcccaaaaacttgccggcccaagttcccctctttgttttctttttcttgccggtcaaaaaagaaacgaggttagcagccatctcacggtacatttgactcctgttctcctcggtcaggtaccgaaacgtacatgttcgagtcgatctcctctgcgcctcgacccgcctgcaccaagaagccgtgtccgacctggaaagcacatccgccacatgatccttcaccgcctccaccccacacgggtacgtgctgcttcccttcgccggaaacagcccgcgacgacctccgccagcacctacacgatgacgacaccaaaccgtgttcctgccgcccagacttcatcgcaaataaatccgctccgacctccgattgaccacccgtcaatctagccacgagccgaagccaacaaatcacatgtcgtcttcctagccaccgaacgacccgagcgctacatctagccgtctccgtgtcgaacgcagctcatcgaaaggcctgggccaccccgcctagagtgttcgattccaccaatcgagaacgccgatcgcctctagcttcaatcaaccctgagcgtcacgcctgactgtctccccattgaaagtagctcaccggaaagtccgagccacccgcccggagtgtccgacccaccgactggatcgccaatcgcttccgccaccatcaacccgagcaccacgtctggtcgtctccctgttgattgtagccatcgaacggttcagaccgccgcctgatttcaccaatcaaattccgttgatcgccgccacgctccaccttgcgtccatgtccgtccctggacaccctgtgtagtcgtcgcggcgtggagcacctcccttgtacctctaccatggatctcatgcaggctctaataccacttgttagaaaccgggtccgatttcacgtcggaaaccaatctcctgtggcgtttcttccgcgtttggtctcctgtggcgtttcttccgcgtttggtttccgacgtgaattcggcgttggtttccgacatgaattcggagccggtttctaacagtttgtttagttccacacgatcccctgtgaccaaatggcccagtatcatctgggcctgtcagcccaacacggcctatgaccgcttcagcatttcggcccgatatgcgctgccggaattccgccggtttgattcattttgacaaaaacatatggaagtagagctcgccgggaaggatcaggtggagaataaactgatcggatgcacatccattcttaatttcttagtattattcatagcagttatatctaaattcagcatccattccttgtaataaaaaatctaaacaaaattcaattacatctgcagcataatttctctgaccatgtcgccataagcagagcaagacaaccttgctactactactgctcactccactccaatccaggtattaatcgatcttgtattgatcatgcatatgagaattatccttggcctctctgtcctgtctgctcatcaccaagcaaccaatgcaacctcctgtctgaccctaagccatctaatctaattaactaattaacacaagatcatgagctcatcacacagatcagatcaccagagacaagctagcactcacatggagtactgcactgtactactgtcctgcccattcgtgtgctgaattgctgattataattagcagctctctcagtttctggagcagtaaccaccaaccaagctgcctctgctgtctgctgctcgtgtgcacggcactgtactacttgctcgtaccacacaaggacagctgcactacaacctctaatttgatccataatttagttaattaattaatcagtctcttggcagaattaagctgagctgagctgcatgcctccgagactcaaggttattcctcaacgatgtggttaatctaatctctattattcgagctgttggtttcactccagccatgagctctgcagactctgaactgccactctgtgatgcctgcttaacacagctggcctccctgctcacgtgcggataaactaagcgctaattctgcactaagtactccactgacactatcttaatcactttcgaatccattatgcttgcatcacttcacatgcaaattgtgtactccaatgttcagttctccaatgctaatatgtcagttcagttgtccaatgttaaggtcgaatttgcgattatttgtctactacttgaattatttacttgaatttggatctgttttatttctaggtgcatgtaggatttggacagaaaaagtagtactttcagtcatttatgctgaaaaagatttgagctgttgagcaagtaaattagcaatttattagcagtcactcctcactaacaagtgtccgtacagatagatagggacttaggaagctcacaggaaggagctgcaatggagacagcatccaaccagagaattgttagcctcttaagtcaccgaattaattaaaccaaacaagtaatcctgcagatcaagacgtcccctttgatagacagaaacctaattacaataacattagttgccatgcatgattacacactccttcagatctatagtttgtgccacctttagttgatcattattagaatgatataattgagatcgatctgatccatccaaattaattacatttacatcacctttgcttacatcttatatttgcttgtcatctgcttgatcatgttaattttcttttgcgaaataacgaaagcctcactctcattcttttcatcctttccttttcttacatttactgaactgttattaattcagagatgctgattgacaaggatgcccatgtacataggacggtcgagatcgaggcaaggaagaatcatgaccgttggatcgaaccgggcgtaaactagaaggctcctcgtggccgttggatcgctgtcaatgttcacctactcttttggttctttcgtgtatcatctcatctgaaatctgaacctgaccaagaaattactttacaaaaaaaatggagtaaaataacccattcggttcaagtttcaccgtcttgtacggacattacggacggctccgtacataaaggcatcaatttgatgactgcatttcactgattaatcagttaaaagttcattaactaatccatcacatgcatttcaaaatcatgcaaatctttcttccacaagcaacccaacctgacaggccaatacatacaggtcatcagaccaagagctttctcctgatttatctgccaaattaaacctgtcatattttaggcgtatctttatatgcgtatattcataaatatacaattgtgactaaaatgctagtatttgctattctttttcgtggcatctagcaataccttctccatgctgcctaattaacaagacatttcaaaaatattctccttaaatttcaatgttcaaggtcaacaaatggcgtcgagtatttgcaaacggagagaaaagggaattaatactttcttcatcgcactaacaatcttccaaaaaggacaaatgcatatttcttttagacaaaaaagacgacatatgtgcacatttggtgttatcttgtgagtttcggtgaaatttcaggtgaaagcaatcgctggaatgatgttgaacaaccatgtactcaaaagtactttcaaagcgatgactgatacaagaagaacttaagcaaattggggttcttggaacaacttgttgctcacgtcgacgaattgtcttttttgatctgtgatttgacaataattgaccatgcccaattatccaaaacttgccttttatctacaagatttgttgacttgacatagatgagaattattttagctggaccaaacaatattccaatggtaaaatgttaggcaattttcaccttttattccatgcatcaagaacaaggaatgtgcttaaaatcccccaaaattgaattgtttcatgtgaacaccctactttacaaacattttcacatggctatatttcagcgtatctgaaatgttagtacagtggcaaagttgacaataacatgtgttagtgtgattgctccataacctgtataaaggccaaaataattgtacttaaagaaagcttgtcttatcttccaattggtgattagtgctaatatcaaatagtgtgctccattatgctaatttaacaaacttgatagaatcggagagatccttgttggtgcaccggaactttccaggaagcagcagcaatcagatgagattaatattgttttaattttgtagagcacccatgattgtgatttgggaatcggtaaagtaagattagtgctagtaggagtacctagttttaaatatttattaactaagcctacttgtactttcatccggttaactgcccactaggtttagtacatagttctaaattacgatggaaattggctgtaaattatgttttggagaccatgaaattgacatagcaaaaatgacatgttttagtggtatttgaataactcagatcacctaggacaatctggcacaattaactattattactcagtactaatctatttgtcccttggctgctagttgttcacgcagatacgttgttagattaccagtaattaattgcttccacgatgcttattatggaaggattagtggaaacaaagatgcaaacgtatatacggtcctatcaagaacgtcgtttggttgagtagaacaaaagcaaccagcaaaatgtccctatcgttggtgcctgcctgaatgcaactcccaaccaatattcaccaaactcaacgggtaatgatgttgagacaggaaatactcaccaaactgaaattttacgttgtgcatgtttgaagcgtttttttcatggataattgagacggatttttttacttgattagcatggtaaattgatatttttcagaaataaactttacaaatacttcagaataattggctaaacaatgcagtagaagaattttcttttctaagaaattgtatctttagaagcatgggcaaataatccatgaaaaaattagagagaaaaaaaaagctgagcagaacaagacctagtatatcggagtaatagaaactaagtacacaggaaaaaaaaacaatatttgattatcttaaaaattgagaaaaattaaaacatggtgttaatttcaatcttgcggcaagtggtgacttggggtatttttgatatgacagaaccagaagaagatacaagcaagcaaccttgcatgtccatctatcaaagtcttttgaataaatgggttacttatctatctctatctatctccgtactgttctttcttgcgtccagactcttgacgacgtgtgacaccatggtcttcttgttagacttgtgcaagaaacaaatttttagagatgcagacaaagatggaacccggcaatttttccaaagtctgcacctggggccttaatttctctgtctatatactacctagctacctggccttgctctgtctaaaaacctagccatcaaccaatcttttatgacatacctctctctcctctcgcgtcgtcctccccgggcgactcggaaggcgacgacgccgccgcctcttcgtcttcagcgcctcctcccccgcctcgccgccgcctgggcgggcactggcaaagccgtgcgcccgcaaggacggcagcggcggggcctctctccccttcgcacccggcggctggggacgccgctcgtcggcgtcggtggtgcccagatccgccatggctggccggatctgggggagcggcagtcggcggcggggaatgaaggtggcggcggtggacgacgtggagcgggaggtggcggctggggacgccgctcgacggtggcgatgcccagatccgtgcggtgctagctggatctgggggagcggcagccggcggcggggaaggaaggtggcggcggtggacgacgcggcggcgctggagttggcggtggcggctggtggcgactgtggctggctggcgttcgcgtcggtgactgcggttgtcgacggtggcggctgactgctggcgaggaggcggctggtggcgaggcggtggctgctatggtgactgctgaagcggtgacggtggcggcggctactgatgcaccggctggc

SEQ ID NO: 8894 - DNA, 4068 bp, Oryza sativa
gtaggcatggcggcggggaaagatgcggcgacgggggtacgaacgcggtgtcgacgaccggaaacgggcgttgatgaccgcgaaagggcggcgggggcggtggaaggaggcatggcggcctcagacggctagtcgagggtgtggcagacggctgcatttggccggcgcggcaatggttggaggagggtcggagaccggcttggcgcagagaggcgcagccgatggtagcggaggccggctcggcgcgagaggcgcgggcggcggagatggaggccagcttggcgcgagaggcgcggccggtggagggaggccggattgacgcgaggcgcgtccggtggaggaggccggcttagcgtgagaggcgcggccggcagtggaggaggcgaccttggtgcgaggaggagctgccggtggatgtggcgcggtcttcggcgcatgaaggctggccggcgggggcgccggtgcagtggtcccacatgtcggcagaggttgagtggtggtggagcatctgtgcatgagccgtggattcgcacgtattgagcagcaggtgaaaacctagcccggccttggccgggccggcaacgagggttaattccccctcctgagggcgttgtcgtgctgtctcatccctcacgggtggttgctgggcgaaagcccagtcttggctcctttaagccccgacggacggcggcggcggttttccgtcgtttctcttcttgaagacgtcgttttggcatcccttagccgaagcctctcgatcggtgcaagcatgctctaggagttggctttgtgttggttctgagggtgttcttttgggcgatctcgtctgtattcctttgtcatctagcggcggttagtccggtgttagccttctcccgattatatgtcttggcgctgttggtgtgtgggtggcagtatatttttttctttttcctggttacgaccctccagggttgtaatcttataatttttttcctgctctatcaatacaacttcgcaccgtcttgtgcgagtcgttcaaaaaatcaaccaatcttttcttgtgaagaaattctggagattatttggaggcacgataagtgccgcttgctgattcttcctggaaaaggatgtggcagaattttgttcttgttgcattgccggggacaaataaaaaatacagaagttttcaataattgtaggacccccttaaatatatatgcaaaatggcgcagcgataaaaaagtactccctctatatcagttatatcaggttataacatgttataagtcgttttgactttggttaaagtaaaactactttaaatttgactaagtttatagacgaatttaataatatttataataccaaattactttaatcaatgattgaatatattttcataataaatttgtttgggttaaaaatgttactattttttttataaatttaaaatagtttgattttgaccaaagtcaaaacgacttataaacgtaaaacggacggagtacatgctaatgttcttctatatacgagaggagctgcctcggagctagatgtattaattgtttgattagatcgcattaaggatacacatataaaattaagttttactcacaaattaatttttatagttaataagccgttacggtttataggacacgctcaaaggtagcttgggatggacatttattcaccctatgtcggaaaaaggacttctccatacaaaggactatcaattaaaacatgctaattaaaatattgtgtgatgtgtgtaaagatcggatataaaaatatactctctctgtctcaaaataaatcaacttttaaaatttaaactttatcctaaaataaatcaacttatacattcttatctactttcggttcgcaaaccgaaaaattctattcctttgatatccattatccacctattcactgatactaatttgctatcaataagacgtgttttggactttatctatattgtttgaaatgaatgaactgttagttttttttaattattgagggaagcattattatacatgctgaaatcatctatagttgaagcgatgcaacagtggtggtaaatctgtcacccacaaactctcaataactaccctgaagtcatttaattagtataataaaatattgcttctagagttaatgtcttcttccttctctgcaatataagtttatcatactaaaattcgatggtgaagtcacatactcacatacatatgtagttcaaatgctattttaataattagagtacgtgcatagaattaaaaaaaatctaacagttcattcatttcaaacaatatagctcatgtagcagtgctcgtttttcgtagcaaagctcaaacatttagctagtgatgacgaaaagtatcaatgggagcttgatttgcatatatcagcattttttcattagcacgcacaatatcattcacattacacacacatttatataagggagaatttactatttgccatatataagaggtagctggtctgtgattactttgtacaacaaaagtttcatccttcagagaccagataatacatagaggattaattaaacatacatacataattaagagcagtctacttataaacaccaaacgcctaatatgtaattagtactacttgactgtacaatagttaagtccatctcttgagtccacaactccacaacagccaaagaccacctgaccgaagcctaattaagggcatgtttagctggaaaaagaaaatccctgatgtgatatatgcagacacatatttgaagtattaaacgtagtctaataataaaataaattacagattccaccagaaaactgcgagacgaatttattaagcccaattaatccgccattagcaaatgtttactgtagcaacacattttcaaatcatggtgtaattagacttgaaagattcgtcttgcaatttcctggcgaattgtgcaattggtttttttgtctacattaatttaatgctctatacatgtgttcgaacattcgatgtgacagcacgaaaaattttgtttggaaactaaacaggccctaaacagcatgaacaacatggctacctacatggaaatgaaataataagtacggtcagaagaggtaaataaaactacaactcctagctagtttcataaatgaaaaattaccttagattgggtgtaatagatgaggcgatgaagatgctgcatatttttctactgccaatccaccgtcaggtcaaggcgcccatccagtaacatgaattctattagctcgtccatggcttccaccactactggtgcactaatccatgcgcagaagttgtcacccaacaagatgaccagacgatcatatgcgatggctaagtataatttggcgagaagagctagctaatcccagagctaccaaagtctctaccactacgtaccattatcaagaatctgagagtgaaacagagaacgatcgagagaaccgtgagcagccatagcttgatccagtatcgattcgatccggagtggagtccatggcgatttccagcctcagctccaggtgatcgatcgagtagcagatgcagcaatggatgatgtgccggcgccagatgaggcccaggatggtgccttccaccagcgagaggagagctcggagaggatggagatggagctccggcaatggctgcaggaggaggaggaggatgattgatcccccacgcagcggtggcattaattctgacgccattgatgcctagctcagctcccagcttgtcgacccagcttgtcgcagatcaaggtcttcttccttcacctcgatctccacctccaggcttggaatggtgaccaccaccgacagctcagcttcccggcgaggattcagcgccgccatcttagggcatgtttagttcgcgaacgaaaattgttgacgtgtcacattagatacatggacacacattcgaagtattgaacgtagactaataacaaaacaaaatatagattccgcttgaaaactacgagacgaatttattaagcctaactaatccgtcattagcaaatatttactgtagcaccacattatcaaatcatggagcaat

SEQ ID NO: 8895 - DNA, 640 bp, Oryza sativa
attcctgcagcccaggaaaattttagaagtgcctagatagggaactttttaagtttaggtgctatagagggaagagcaacttttttttgatgctagatagggaattttctctacaatgatcatacttcccatacgggcattgcttatttgactctgttttgaagtctaataactaatttgaccctacttttttaggtttgctcatttaaccctgtttttcaaaattgaagataaaggttgaccctattctgtgaagtctagataacggtgttaactgagtgacgatttctcttttttgcccttgctcgtttgaccctaatgctacattttaacatattcgtaacaaatttgacatagatttgagaaaattttgacatatttgatttcaatttgataaatttagctttagtttgacaatttgactttaatttttttaaaaaaaattaagagcatttctcctatcttatccatcccaaaatgtataaaataaagcaaaaacatggcaaagagcgctgcagtcgccgtcgccgcaatggctgccgctctgagcacgatagcaaccgacgccactcccttccacctccccgagcacagcagctgctgtcgctgctcccttattccgcgtgcagctgccgccgtt

SEQ ID NO: 8896 - DNA, 7366 bp, Oryza sativa
taccaatagttttgtcatcacttctacaagttgtaattgttttgaagatactagtactagtagtagtacgttttgaatacacaaatacaaacatatccatgcattgcttgaacaggactactgaaataatatattgtcaagtttaactaaggtctattgcgtcaaggaaagcttttccaccaataattcgaggcaggtgacattctccttgatagtgtcactattagttaattaagcactgaaagctctgactttgctagatgagcctatttataatgtccaaaatatttcacaaatggggggtttcattttctcaaatccagctagccctctgtaagtctgtatacatccaccattcaccatcaagcaataaagaacataaaactgctggtccctcaaaagaaaatcaaaagaaaaaggaacaaaaaaataattatcattgtgcccatatttctttttcttttaaaaaaattcctgttccatatcccacgtgtcaagcacccattggccaagatgacgaagtggagaaaagtcagaagaagaaaaaaaagacattagaaatggtattcactgtagcgcctttctgtgcaccctccaacaagatggcgcactagccctatggtacacacctttggtgtgtccttgtctgtggggcccacatggaaatcctggaggtggggcccacatgtaaaggtgtgggagcaaggcaggtcaaggcaagaaggcaacaactctggggtcaattccggagtgtgctttacaatgatgtgtgattagtgattactactacaacggcagcaggattgttgaagacgtcagcttctgtaattaaacatgcagatgcaggaggaggaaggatccatgcagtttcttgcgttttattattgcaatttgcaaccagttcaaggaggcatatggacaaaaataatgagaaacctcggcgtttggatgcccatattcgtagccacacgctggtttatttttacataacaatttcgtatctatcccccgctctagtactacgctatagtcctgcatcgtttttaacacgtgcgtttttcaaactggtaaatggtgtgttttttttaaaaaaattctatacgaaagttgcttaaaaaatcatattaattcattttttaaaaaaatagtaaatacttaattaatcacgcgctaatcgctactctgtttcccgtgccaccctcactcccgaacgcaaccctaatggttgattctaaataatgatcattttctcgtgcttttcaatgctagttttggttatattcttttacaattttgtacgggctatgtgctaacaaatatagtattgtgaaaaaaataattcgatgacaaaattactgagatttatgttgcgaatatctaatctagatggtttcaattaaatcaacggtcaaataataaaagagaaatgatatacattttttttcttatgaactctcttaaaaagttgatgtagtaaaatgtgattgcatcttggctttttttttcgcggggaacaagaactttgattactcagctaaattgtcctcccacacaaggtgagaaatggaattacaacttccatgcggccagagtccgtaagggactcacacctggctttattagctagagtatgaccagctaagaaatgtgattgcatcttggcttttaataactaaacaaaatggttaagaaatgtagtgcatatatagcactactcactatttcacttagggcctctttaaatcgcaggattgagaaaacgtaaaaataggaaaaacgtaggattttaattggaatgtaagtgtaaaacagaggattgcaaaacgcaggaaaaacacaggaatgaccgtttaattgaaccgcaagaaaaacgtaggaattggacgagagagatagactcaaaggaaaaataccaagaggttaaagctccgctaaatttcctccaaaatctctataggattgtccattccatagaaatttcaaaggattggatatgatcaaatcctttgttttaaagagcttcataggaaattttcctataggattgaaatcctccaaaattcctatgtttttctccaaattaaagagaaacaacataagaagtaggagtacataatcagctttacacgtgtttactatttcctaccgtttgcctttcttgatacagacaaattgtatgggttaattagcagaatatccatgaacctctattgatatatgcaaaacagaagaggaaaataaatcgttcaatcttggtgtacaagcacaaactgcgcgtggaaaagacgccaaccaaaaaaaaaacaatccagggagctgcatgaatgaatgaatggatggtcatggaagtagtatgatatgattccattggagtggaaaagagtggacaaatcatagaaaaagcaaacccaaaccaaagcaaaatcactgcctttttcgttcctcaattccgtagtcctccaactctactcgccttcacctagcacatcagataggtataggtgcgtgcgtgccacttggctgctgtacagtgttaacaatttttaccggtccggcatttcgaaccatgtcacgatcataaattgctcggtttttcgaccaagtctaaaaaaatgaaactaaaattttagttttttataagatttatctagatttcacccatttggatccaacgaaatgagaatatcgtgaggcggtttttctgtgtttcttcgtacacactaaaaatttatctattctgaatgtaaaacatgatagttattatagtatattaattaagtataagcttaaaaaaattaatatgatgtttttaagtaaatttttataaatttattttggaaaagtaatgtttaacagtttaaattaaggtcaacaaagagataggagcgaggtttacgttaccgctggtaaccgcgcggttaccgggcttaccgcggagtacagtaatataaatacgtggtaaccttcttagattcaaataaatttaaaaaataatttaaatgtttgataaattttacacggttttgtatgatttcacggttaccgtggtaatcgtgtctaccgctggggcgcggtagcctcggccccaggcggttttgggaaaccctggtaggagctgagaaggatgcgaaaccaacggtgctggctgctctgaacgctgttggttgctgctgccccgtggcgacgacacctcaccggaggcaacacaacgcaacgcatcgaaatcgaaccgcagcgatccagcgagcggttgagtgttgccgcatcaccgagtcaccgagacatttttccttttttctttttttgtaattgcagccgcctcgcgaagcttcgtgccaccttcctcccgtcgccactgcgtcaccttccctcttttcaactctctccctctcacacaccgcattgcagatttcatttgctgcaccgccctcccctcccctgcaaatactactagtagcacaagagccccgcatgccgttcacacctgcccaccaccaccactcgtagcccccaccgcaaccacccacacccacaccactctcgatccttcttccccgactccggccggcattggcggtggtggaggaggaggaggaggggaggactctgggctgtgtctctgtcttgcgcggcggcggcgcgagagggagagattggttgtgattttgggagtcccgacgtcgcacgcgcgcgcgtgtggagtggaggaagaagagatcgcgtctcttcgcccgaggatttctcgggatatttttatttgttagttagtatttataaagacgccgccgcggcgagggcgaggtccccgattcagtttggtttttcttctcgccgacgcgcagatcgatcgcgtcgtggactgggaattcttccccccgcattgttgtttgaggtgaggtggtggtggtggtgatcacgatgggcgaggccgggcaggacgcgccgccgccgccggagaagggcgtcgaggtggaggtgttcccggcgtgggcgcggggcgtggaggagtgcagcgcggctgggggtctcggcgtcgcggggcttgtcgtcgcggaggcggcggcacggctgcgggcgcatggccccaacgagctcgccgagcacccgggacccacgctgctgcagctcgtcgcgcagcagttcgacgacacgctcgtccgcatcctcctcgccgccgccgccgtctccttcgcgctcgcgctctcctcctccgccggcgccgtcacgctctccgccttcgtcgagccgctcgtcatcttcctcatcctcgtcgtcaacgccgccgtgggtgtctggcaggagaccaacgccgagaaggcgctcgaggcgctccgcgagatccagtccgaccacgccgccgtcctccgcgacggcgactggctacccagcctccccgcgcgggacctcgtcccgggcgacatcgtccagctccgcgtcggtgacaaggtccccgccgacatgcgcgtcctccgcctcgtcacctccacgctccgcgtcgagcagggctccctcaccggcgagaccgcctccgtcaacaagaccgcgcaccaagtgccccacgacgacgccgacatccaggccaaggagtgtatggtcttcgccggcaccaccgtcgtcaatggcagcgcaatctgcctcgtcgtgcacactgggatggccactgagatcggcaaaatccacgcgcagatccacgaggccgcgcaggaggacgacgacaccccgctcaagaagaagctcaacgaattcggcgaggcgctcaccaagatcatcggcctcatttgcgctttggtgtggctcatcaatgtcaagtacttcttgacgtttgagctcgatgggtggatgccgaggaacatccgcttctctttcgagaagtgcacatactacttcgagatcgctgtggcgctcgctgtcgctgccataccggaaggacttcctgccgtgatcaccacgtgccttgcacttggtacaaggaagatggccgccaagaatgctcttgtcaggaagcttccaagtgtggagaccttgggatgcaccaccgtgatttgctctgacaagaccgggacgctgacaacgaaccagatgtccgtggcgaaacttgtggcgatcggagatgctgaagggaaggtcaggagcttcaaggtcgatgggacgacatatgatccccgggatggtagaattcacgattggcctgcagggaggatggatgcaaaccttcagacgatcgcaaagatttctgctgtgtgcaatgatgccagtgtggcacattcttcacatcagtatactgcaactggaatgccgacagaggcagctttaaaggtgagaatcgataaactgtatgatattctcattctgttaaaatgctccagtttttggtccaagaatatggtgcatagtttgttaatccactagttgcacatttttcaatcatgatttgagcagtctaggaacattgcctactgaaagtaacgttctggcatgtgttggttctaattcagataatgctgcttgatgtttggaaacattctgttgtaaagctctgatataacttttctttattggtttcttctaggtcttggttgagaaaatgggaatacctgaaggaatgaacggattgtccttggatccatctgaaacattaggtaagctagaaatgccttttcggcttagcttagtattacctatcagtttcaactacgtgcttcttaattaggatattcttctaatcacgcactgagctgattatgaaattgtttgctaacaggctgctgccaatggtggagcaatgttgccaagaggattgctactcttgagtttgaccgtacaaggaaatcaatgggagtaattgttaagtccaaatcaggaaggaatgctctacttgtgaaggtgttaattctttatttcttgctatatagtcatctcttactgatctgctggacatgtattgttcactgcatctttttagtatgttccagtggttggcgttgtcattagtgcctgattttgtgttcttaataacagggagctgttgaaaacttgctggagaggagtagccacattcaactgcaggatggttcagttgtgccgttagatgaaaaatcaaggaaagctattttggaaaacctccatgaaatgtcaattaaagctctgcgctgccttggttttgcatacaaagaggatctagcagaatttgcaagttacgatggtgaaaaccaccccgctcacaagcttttgctggatccagtcaattatgcagcaattgagaccaatttgatattcactggtcttgctggcctaagggtaagatgatgcttctcatgatatgttttcaaccagattgtttccttttttttttaactccaatcaaggaaaattcctgtttcttcttggttcaacaaaatatgcatagtaagcacggttatggacttcaaggcatataaggtctaaataagatatacttgactaggagataacagaaaaggctaagcatgaattctgtatagctaggataagctaatccaaacaagtacagtcatcaattatacagaaagtgatttgctggggaccagtatttaagatcaatgatcatcttgtgtaattttcttttcttggcaacctatcttcttacagtattaatgtatctttctcattgatgttttaaatatgacaggatcctccaagggaagaggtttttgatgctattgaagattgcagagctgcaggcatccgtgttatggtgataacaggagacaacaaagaaactgctgaagcaatatgccgtgaaattggtgtgttttcacatgacgaggacattaccttaaagagtcttacaggaaaggagttcatggcacttgaggacaagaagacactgctgcgaaggaaaggtggcctactgttctctagggcagagcctaggcacaaacaagagattgtgagactgctcaaagaagatggtgaagttgttgctatgactggagatggagttaatgacgcccctgcgctaaagctggctgacattggagtagcaatgggtattacaggcactgaggtatgtacttatttcagcaccataggttgttttcagccagtgctttctttctttaatttcctgtgcagaaatatacaggccttaaaattttcatgacatttccctttcagtccttttttggttgttagccctttgtacttgtctgccaatatttcagctaatcatctatactgttctgagttaatttgaacaacattggttagagataacatgaatttataggtcttttattgtcccaaaagtactgatatctgtgacataatttgaattggtatctcacttatttttcttttgttcaggttgcaaaagaggcctctgaca

SEQ ID NO: 8897 - DNA, 6761 bp, Oryza sativa
ttctagctgtctttcttcactgctgcagatacatgatttcctcaaacattggtgaagttgcgtcaattttcctaacttctgctctgggtattcctgaggggttgataccggttcaacttctatgggtaaaccttgtcaccgacggtcctcctgcaactgcattaggtttcaatccacctgataaagacatcatgaagaaaccgcctagaaagagtgatgactcactgattactccctggattttgttccgttacctggtaaatgatctttctgatcttctatcatttatgacaaaaatgattcatctccttggccttacattttgagatgatttctcatgagctataccttattcgcaggtcattggcctttatgtggggattgccacggtcggcatctttgtcatatggtacacacatggatctttcatgggcattgacctcaccggagatggtcacacccttgtcagctactctcagctctcaaactggggccagtgctctacctggaacaacttcacagttacgcctttcactgctggagctaggactttcaccttcgatgacaatccatgcgagtacttccatggtggcaaagtgaaggcgacaacgctctcgctgtctgtcctggtggcgattgagatgttcaactcactcaacgccctctccgaagacactagcctcctgaggatgcctccttgggtaaacccatggctgctcctcgccatgtcagtgtcgttcgggctccatttcttgatcctctacgtgccgttcctcgcgcaagtgtttggcatcgtgccgctcagcttgaacgagtggctgctggtgttgcttgttgcactcccggtggtgctcatcgacgaggttctcaagtttgtcggaaggtgtcaagctcatcaggccccaagaggcgaccaggaagcagaagggcgagtaaaatgctaacagtgattcttcagactcatcagtaacaaaagtcactgaatttgttgtgatcaagtaacaatgatcaccaaatgatgtttattcaatagaaatatgtccaatacaagaaagttcaggaaagagattttctcaaaacaggtcatcactctttgggaagttgataacctttgctgttcttttattccttgtcctaaatggtactatactgagctcacagcaaaccagcaggcagcagcattgttctgttggcaacattttgcttctgtgaattattatatatagatgaaatatttagatcaaattatacacatttctgcctaccttattatgcttctgctgtgtggtttctgagctggttgatctggcaggccaatactcaattaattctccctgtgaattgtctctactatctacgtgtgtattaacacctttatatattaatttttactagaaaagatgctctgttgcgcaacaggtgaatactatttaaatcttattattgttatacggtttagctaatgtgaaatttattgtgggaattcacttggatatttttttgttagaaaaccatgagctgcaattaggaatccggcatttatctcaagttagcatgcgtgtttttaaagatatttcttatacgactccttttgtatttttaaaagatccgacttaagcacgggtccttatttttaaaagcaaacgaacttaaaatccgtctcaaacacggatcagtatttccaaaagcgaacagaatacagacaaaaacatattcaatttttataatagtagagatatgcaccacttcctgaattcaatatgagctgaaactggtagccaggtctgcagaagtatgatatctacaccgagcatacaaacacaactcaaggcataatggatcgaggaaggataaatgagtagattgatccacctctccgttgaatctcgctgggccatcagccacgtgcacaaccgagcgatcaaggtgttacgagaggaaaagggaggacgggaaaaactcaaaaataaagtcgcttatcacctggtggggccgtgcggttgtgggctggggcctgtgggctcgccgctttattgtatcttcgtgagcagccgggttgtctccttagctccatgattcttgcatccgatgcgagcgatttcaacagatgaaaaaaacggaatgaaacgggaacgtcggaagtttacgataactgtgtccgacacgatctcgcagtgacgtactaaaatccttggcaaaaaacaccttgaatttttataataggtaaagaaagtgcgtagtatacagtgttacaattcgattcagttcgtgctcaaattactcaaagaagacaagggcacaaggcccatgggattaaacaagactatatttatatattctctacaccttacaacactgccgcagcgtgattgtgtgttacttatacacttccgcatgaaacatgcaaacaacactcttcactctcatcttttgctgcttgcttaatcttttcactgacgatatgcagagtttcagtaaaacacctgtcatcttacatgcaaccatatacgaaggctatcagcagcttcgaaaataacagtgtaacgtacttcgtataaactggctcaaagataccagcttaaaacgctagttggttttcaggatttcgttcagctgaatattaggctaaagcaagcacgcaagaaaagaagaagacagtgtaacgtactacatataaatcgcaaagggtggtcggagttttaaacgccgaccccctgttaataacagaaacatcgaattaccactcggcccaattgcgattcgttgagtacgctttgagcagctgatctactcaatctgagtcacataacttgatccaacggccagtagagaccctaatagggtcggaaattttgatctccgacccaccccgctgagcttcatgatgtgccttgccagaacgcagccgtaccaaggtcgacaacacacaagaacacaagcagtttattttccggtcgacaatgactttctcttccctcagctggtcacaccttttttttaaagggactgtcttaaaaaaaaaccatctaaatcttcggtttttatttttttaagggaatgtcttaaaaaaaccatctaaatcttataattgttagatcattaaattgctttaagatttatgcacgctcccctaatcctaaccccctctttctttcctttcttctccttcccgacgattcgatgccacgacgcgctccaccgcttcctgccccaccgcctcccatcaagctattgcctggcctcaccggttggccggaagaggtcatcggcgctccacctcctcctcctctcctcctccactttgatggcctaatgtttactagtgacccaaatgggaagtcggagttttaaactccgaaccctgctgcgtgcagaaatggacataaatttgaggcagaagcgctattgttttttaataatatataatagagaagatgaaatatttagatccaacattgctgcctcttgttactttgcttgtgctgatatgatttttgaggaggtttcactggcagctggttcatgcatgaattctccctggtgaatttttatctctacaatctatgtgtatttacactttcattagttgtgtattaattatatcattatcttttaaagtatggttagtacattgttacattatcaattcaggatgtcttcagctcaaagacagcccatgagatttggtcttcctccgccatggccgtgctcggcctcctcgtggcgagcttacatattgcttcgttgagcaagacgtacgaagcaccagtggcgacactacaagaatcaggaattttagctagaaaccgtcaataatagaattataatcgccaatattttatacagtatccatcttattgaccaacctgaaagtaccttaatgtcgcctagagaggggtgaataggcgttcctaaaaattatcacaacttcatagcatattagaatgatgagaactttcggttcaaatagtaacttccgatatgagattggaagttccggtctcaaccgaaaagttcggcggataatggaagaaaacactactagctatgaaattgtagctcaaataaacaaaatgtatatgaataaaaaaggtgacaaataaggtatctaaacaagatataaggtcaccaactaaatcaattaagcatgcaagtagattaggtaaaaacaagctcaagcacaatatgagagaatgcacaaatgggcaaaccaagagaggagacgcgtgatttgtttcccgaagttcggatccacggatcctacgtctccgttgaggagccacaagggccgggcctatttcaaccttttcctcacgaggttgcacaaatgcactcctcggtttcactcttgatttcttcccttgcggaggcgaaattgaagccttcacaaactttccgtggcacaccacaaccttgggtgctcaccggcgacgcctagccgtctagtagatcttagtccccaagagtaacaaacacaatcgaagatttgcttgctatgaactcgagtgctcaaagtatggagtgaagctcactagctctcaacttctcaatcactcaatccaactctttccccttctcaaatccctctcacaaagaggcaccacaaaggatggagtgaagctcactagctctcaattcttcactctctcaatccaactctccccccttctcaaatccccctcacaaagaggcaccacaaaggtagagaaatggggatggctatttggctttgaatgtgtctaatactccccaagagcagcagccactcaaaggaggggtggaggagtttatatacccgagccccttaaaaactagctgttggaggccaagactgtaattttcggagtttccgaaaagcatttttggacaagtccgaaaacttatagaagcaaatctcagattcgcagccattttcggaatgtccgaaaattttcggagtttccggtaatttttcggattttccaaaaagcacagagtaaaacgactataacttttcgctcggataacttttcgctcgggagtctgttttttatgaacttggactctatggaaagctcactcagaggactacccaactcaaccaaaaacaaggtctaaaaccactcaaatgataggttaaatcttgggtttctctcaaggtagcactatgataggtcactttgagcaccaagacatacacaaacacctcgacgttgcatccctcttaatagtacggcattcctagactcaaatgtaaataagaagataattataccattaggaatgcctttttttcatctttctttcattgtcttgagggacgccaatgccgataccatttcaccatatattcttcaaacgattgatgcggttacttgtagcttcaaatggtctcgcacggtccatcatgataaagccgtcactcgcccttcaccaccggatttggttcttcggcgccaagccccttacttgcccttcaccgtcgcatggtccatcgagaccgagcatcgcttgcccttcaccgtcttgccataatagccacttcgtatcacacatcttcaatatcttcactttgtcactcttggtattgttaagtgtaatgatatcacttgaacatcaacacctttgtaatcctttggacctatttctttcattcaactcaataaaattattagtcccaatgatccggttgtcaaccttcacatgttgaccaaccaatcgcatgtataaaagtatatgaataaatgatgagtattaatcaacaccacaagtgtcatatactcaaatataaagatcccaattaaatgaaggtgaataacttggatcgattacatgcataactaaagtataggatttgctccccctaaatgtatgcatacaaaatatttgtgtgaagcaagagtatgcataacaagatattaaacattgagagcttatcctatacaagaatagaaggcatttctcaaatatagatattaaaataaaaacataccttcatcatctccacgttctcaatgtaaatagattaaataagagataatactcaaacaaaacattagtctcacatgcatatgccaatcacgtggaaatattatatacgaacatatcaatatgtacatgaagagaaagattgatacatatagcttgatctccatgcatttcatccttgtgatttaggtccaccaacactccactttcatatccacatgagactaggcaaacaaatgtttataaaaatattagtctcacataattggatttgttattaatcatcaaaaccaaatcaatggcacttgaactttcacaaccatcaagaaataaccgccaagcctaaagaggaaattcaaataccttgtcggctaatcatcagtaaaagttttactggcggttagaccggcaataaaattgcattcatttctaactttcggtagcgccaagaattataaccctgtcagtctggagatgcaaacagattgcaccaccattcgccggcgttagagatgatggagggaggctagtgacccatacgaggggttggagatttaaattcggaaaaaaaatccactttgactctgtcggtgacatggggccgggggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgcccgaccccctgtggttttggcgccacgtgtgtgggtta

SEQ ID NO: 8898 - DNA, 10454 bp, Oryza sativa
ctcctaaccacatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcgacctgtcacacgcctcgccccatcccgtcggaatgatgagagcttcctggctcttgtccctagccggagccggcgtgccaactccaggagttggtatgtcagtcccggtcagattcgttccaggcttcagcgcaagtatggcaaggaagtcgctggccattaaatgaaggttgaaatgggcgtccaccgggaaaagcgggcgagcggggcaggaggcgtgcgctctgctttttagaagtcatttccggctgtagattagccctgattgtaaaaagcatgtttcccttcttaggcagctagaggcccatgtggtgacccctgaccagataaaaaggaggcccaggcctaagaaaagaagaggggggaaaagaaaggagggggagttgggactctggcgaatggttcctagagcctgaactctctctcgctctccgccctctggattccttcacacacagatccaccagaacacaggagtagggtgttacgcttctcagcggcccgaacctgtctacgtcgcccgtgtcttgcgcatttcttttctcgctgacgttcctcagatcgagggcgaagaacctcacttagcgcccccggccgaaccggcaaaggagggcctgcgcggtctcccggtgaggagccccacgctccgtcatctggcgcgccaggtagggggcgcgcgtgtcttttgaagccctcgtcctctttcgtgtgcgccaagcttctcccgctcagcccaatggccgagcgggcagtggcgcacaggctctctccgaacgctagcggtgacgacggggagcagaacccgcgccgtcgggctcgcaccctaccgtccccctctcgccgaaatcttgggcggggggaggcgctcggggaggccggaggatccgcgacttcgccgcccgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgatgtggccgacttggtcatgacggcgcagcagcgcctaggcgccggcgggcggtcctccgccaccgagacctctggcgctgccgccgccggctccatgtcgtcgaggcggagggcgcggcaagcggcggccgttacccgccgttcgtccgccattccctcgtcaacgcctccgacccaaggagatgtgcgtggggggccggatgcctgcctcgacatcgagcgccggcgcgacactcgtcgcgccgcccacgcaacggagggcgcttcctcgttcggagcaccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccggggatgacgacagggtcatggcgaatttcttccccatggccctgaagggtcaggcgtggggttggctaatgaacttgccacccgcgtcggtccactcttgggaggatttgtgctagcagttcaccacgaacttccagggcatatattcgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccccgggtccgccgctcggtcagggcggcgggacaggaggaggaagaaggggccggcccgttccgacgacgagggtcacgtcctcgccgtcgagggcgcttcgcgggccccccgaaaggggaggcctgcgagcgacaaaaagaaggaggccggcgctcccagcagggagcgcccaaccggcaagtggtgtaccgtgcacaacacctccctccacgacctcgcggactgccgcgcggtcaaaagtttggctgattgagcaccgtctcgccgtgcggccgggcgcaaggccggtccggcagaaagtgcggcgacaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattactcccataggaacttattgttacaccacaatgcccttcgggttaaagaatgcaggtcctacttttcaacgtactactcgaatttctttaggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgtgtgttcggtgtgcctgcgggcaagcttctcgggttcttggtctctgcccgaggcatcgaggccaaccccgagaagatacgagctatagagcggatgcgccccccagcaagcttagggatgtgcagtgcatcaccggctgcatggccgccctaagtcggttcatatcgaggctgggagagaaggcactgcccctgtttaagctcctcaaacgctccgggccgtttacctggatggaggaggctgagcgggccttcactcagttgaaggcgtacctcagttctcccccagtcctggtcgccccggagccagatgagccgttgctactctacctggcggcaaccccgcaggtggtcagcacggcgttggtcgtggagcgcgacgaggacaaccctcactccgcgcatccccaccctgcgtcgacttgacccgggagagaggagggaggagaggcccccgagccgaacggtggcccaaggcccccgacggccggagctggccctccgcctgcttgtccgatggtgccaggcgcccccgacccctaggatggccccggggccactgcgggaaggccgcgcctgtcgccctctgaccccgaggtcgtcggcacagaagccgagtgcgccccgcgtggcctctcggacgaagagcgccctggagatgcggcccctggcgaagaggatcggtcccgccgaaaggtgcagcggcccgtctactttgttagtgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagctcccgagcccgtctccgccctcgaggctagctcgggcccctcgcagctgcgtcacaccgcctactgggtgatgcagttcgacggctccctgtctctttagggcgccggtgcgggggtcacgttgacctcgccgagcggagacgtcctcagatacctggtccgcctcgactttcgggcgaccaacaatatggcggagtacgagggactccttgcgggactcagagtggcagctggactagggatccgccgcctcctggtgttaggcgactcccagttggtcgttaaccaggtctgtaaggagtaccggtgctctgacccgcagatggacgcttacgtgcgccaggtgcggcgtatggagcgccacttcgacgggatagaacttcggcacgtgcccagacgggataacgcggtcgccgacgaactctcaaggctcgcttcctcgcgagcccagaccccaccggacgcctttgaagaaaggctcgcccagccgtcggcgcgacccgaccccctaggggagacgaacgcgcctgaacggcccccgaggcccgtcggagtccaggccttgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgctgatgtccatgaaggcgagtgcggagcccactccgcctcacgcaccttggttggcaaggcctttcaccagggtttctattggccgacggctctcaacgatgcggtcgacctggtccggcggtgcagggcgtgccagttccacgccaggcaaacccatcagccggcccaggccctgcagaccatacctctttcgtggtcgtttgctgtctgggggctcgatatcctgggtccattcaggcgggccccgggcgggttcgagtatctgtatgtcgctgtcgacaagttcactaagtggcccgaggcttatccagtcatcaagatcgataagcactccgcgcttaaattcattaggggcatcactgctcggtttggggtgcctaaccgtatcattacggataacggcacccagttcactagtgagctcttcggtgactactgcgaagagataggcatcaagctctacttcgcctcccccgcccaccccagaagcaatggccaagtggagcgcaccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagctttgccgagatgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcatgcctcgggctcgggccaaccccgcacccccctgggcgtgcagggttggccgggggctaccacatgcatatacttaccttttttctcttccgtatctcaataaaagcattttcgatttcttgaggactgtgtctgtgccatcgtttccttttgaagaatcttggcttgaattagcatgctcgtgctcgaccctgccctcggtggcccgggccggctaaaatcgccaaacggggcccagaactgagccgtgccccggggcgtggcgaactccgggggggaatcggcaaaggcccacaatcgggtcatccataaccctcggtcaccgcactcccggcctggccagtctcgacacgtggatctccccaggcactagccctgacccgcgccgtttgaggctgggacctgggcacgagcccttgttcaagccaagacacagaagaaccgcggcacagaccatcctcgtctcatacacacaacaaacagagctgacgcagaaatttcctctttacttgattacagattaaatcagtctatacaagaagggggcccgaaggcctcggaagaagaagcaaaagttattaagattggcgggggcctgagggcttactccgacgcgcccgggtcgtcggcctcgtcgtcgctgtcgtccgcaccgtcgtcaccgccctcctcgtcggagtcgagcgcgaacgcgagccgaggggccgtaccctcgaagctgtggacgatgtggtcggcggcgtcccggacctgcgcgcgtgcgctgtcctcggttccgggagggaactcttccagcactgcccacggggagaagtcagggtccctggcctggtagcttgccagtacaagctccaccgtcccccgggcgaggtccctcgaggatgacttgatcgtcccctcgagctcctcggggagccgctcgagggccccggtcatctctgagaggcgctgggcgaggcccccctggttggcggcgtacttcgcgtgccgcccgccccagaggcccgcccgccgcccggcgcggtctagatgggagacggcgtcccaaagcatgccgggccctacttcgctcgccaagcggagggcctcgacctccccggcggacgagtccagcgcgccctgcagctcggcgatggtgtgttcggcggctgcgaggcgggcgactaggtcgccgtggcccgcggccgccccgccgctgcgcgctctcccgtccagctccttcgcccgcgcctcgagctcagcggcccgctgatccagtgcggccctctcggcgcgggcgccttccagattgcggcgcgcctgctcctcccgcgctgcctcgcggaggaacaggatgtccgccagccgctgcgccgcggcctcggcctcctcgagagctcgcccccgctcggtgagcgcgtcctcgcggaagcggagtgcggactcctcttcggcgcaggcggcctcgtgcgacggcggcctcgcggtccgccaggtctctctccttcgcgtccagggcgcgggcgcgctccttcagcgccgtggagcgagcctcaagggcctcttcgcgccaccgggacgccgcctcgttctccgccgcccgccgttcccgggcagcggcggcgtcaaggaccccccgggcagcgtcgagcttctcctccagctccgccgcccggctcccgtattggaggcggaggtcattccgcgcctcgtcgagcacggcggtggcgatgagggcagtctcccgctcctcctccacctccctggcgatctccgccaggtccctacgacgggcctcgagctctgaggcgtgccggcggtgtgccttgcgacccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaagggctccgtgctcagtggggcagcggaaggccgaggggagagccccctcggtgtgggtgccgcgcggctcggcccgccgatcgacgtgccggactcgggggcgccccccgaacctggctcgtcccaagcgtcgcccgaggggtcgggcccgagcggcgcgcccgcggcctcgtcatgggtggcctctgaagtcgtcgtcgcctcgggcggaatcgagtcgggggtttggcaggccacctggcgtgcgcgcgccgcctctgccacccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcagtcgccgtctcctcggcctcagaccggccggactaggaatggcgggggggggggggcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccaccttgggggcgagatgaggttcccccggcatggtacgatcccccccatcttgcggagccgtttcttctttcgctccccctcgggctgcggcgtcggcacggcaccctccgggcgcctgctgctggcacgcaccgccccgccccctcggggaggagatgggggaggagtaccctcctgcttcctcttcccccgggcttcggcagggcggctgccccccgggcccccgtcgcggggcccagaagcacgaccccctcccggggtagattgttcccccctgcggctcccgcccgcgccatcgtggcctcggggggcccgctccccagacgccccgaccacctgcatgatggtcaggatcttggcgcgctctggatcgcagcagagggggaggaccccttgggggatgagggatgcctccacggagctgagattcagcacccgttggaccaccatcctgaagacctcagggtcccagtcccatttgcacccctggtgggtcctcatgtagtcctcgggcccggtatactcccaggcgccccgggcgcgccgctggagcggcgcgatccggcgacgaaggtagtcgccgaacaccatggcctccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcagcggcgacaccggctgtacggtgaagaaccaccggaacagctggagagatgggcgcaccccgataaacatctcgcacaggtgtgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgcccgggtagtgtggcgccgggcgtccctcgcccagcgcgaccacctcccagccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcaccggaaacgaagagttagagcacaagtggcgaaggcaaggggaagagtggcgagaggaaagaaacgaatccctccctcggcgtctttacacccttgccaacgctatgcccggctcctcgattcccgcgcccactacctcgccccctcgtttctcgcgcccacgcctccactaaccccgctcgcccgtttgcggcgcacgcggcagatgtgcggccgtggcagtcgagatggggcagatcgtgcgcgcattaactacgcccgccaaccgtgaaatgcgccgtcatcatgtctccaggcgaaacaaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccccgaccccctgtggttttggcgccacgtgtgtgggttaggtgagcacagcggg

SEQ ID NO: 8899 - DNA, 3208 bp, Oryza sativa
tttccggctgtagattagccctgattgtaaaaagcatgttccccttcttaggcagctagaggcccatgtggtgacccctgaccagataaaaaggaggcccaggcctaataaaagaagaggggggaaaagaaaggagggggagttgggactctggcgaatggttcctagagcctgaactctctctcactctccgccctctggattccttcacacacagatccaccacaacacaggagtagggtgttacgcttctcagcggcccgaacctgtcctacgtcgcccgtgtcttgcgcatttcttttctcgttgacgttccctcagatcgagggcgaagaacctcacttagcgcccccggccgaaccggcaaaggggggcctgcgcggtctcccggtaaggagccccacgctccgtcagactcccttaagagtcggttgaatctaattcatgctctttaccacaaaaccggatagaatgtctccccgaaatatgaaatcggtgtaatttgactcccttagtggttttggagggtggtttcgctgatgtggcgcttacgtggcggcattgactgggttttcatcacatgtggcgttgacgtgacgcttatgtaatattagaattaaaaatagatatgtgtgacccacatgtcatccacacacaaaatatacaatggacccactgactgtggggcccacatggtcatcctctctctccaacccttcttctttctcactctctcccccttatctctctctctctctttctcttcacgtcggcggccgtttgcgaggaatggaattggagcggcggtggcgggcggtggagcggcggacagggaaacggcccatatcccgttccggcccaacacatatgggccgcactagagttctggtccaacatatatgggccgcatttaagctggaatcttttgctccggtccaactgtagtgggctgccttcccaacggagacgacacaatacaatcatgatgacatcatcatcccaccagagcggggaaggaagaagctccgcgaagtccggcgcggcggcgagcacgagatggtggtgctccacgtcaggtgggctgcagcctcctcctcctcctcgccgccgccaccgtcatcgccggaggaggaagagatggagttcctccacgagtgcgccgcctccacccccgtcgaggacgtggcggccgcgctcgccggcgtcgcggcactccaggcccgcctgctctccctctgccgctcccttcgaggtcaggtcaccgcaacttcttctgcgagacccactcaagccttggctgctgtcatgaactgacgcgttgcggtttgtgttgcagagaggggcgcggcggcggcagcagcggcgggtgaggtcgagagggcggtggcggaggctgaatcctacgcctccaaggtcagcttctcactccgattcggatgctgctcagctcagatagttttatttggttgttacagttttgagcgatttataattttgtgggtttcaaagtatgtcgcctgaattgttcatatcaatcttcttcctagttgctacgattgattgagtacactagccttcaaattgaactccacaggccaaatggaaatggacattggcttcaaatttaattccacaggtcaaatgtatcactagttctctgctactaatacatgttacatgatttttaattggatgataggctgatattgcatctgtcaccacaagtgaccagtaactattctctggtacaaactaccattatgcaattactgttttgtgaaagggaatctaaacttggcatcgttgttctcttcaatcttcatcatttgtcaagctaaattttgtaaggtgtcaagctaattaagcaaatatatgcctgttgcaatcaatgttagagctttcaagttgaaacgacagcccctttccagggtatttccgttcgagatttttatatgtgcccggtttttattccaggagcaagtgcggtacaacagattcttatcccctcgtgctctaagggagcatatcaagaacatcgaaaagacagctgttaccgctctacaggagtctcctgaagcgttgtgcctgcaacagaaatcatcaggtaatgcatgaattgaatttgcgtgacgaagatatgattttccaaatgaaacggtagtaaatgttgtatctggagaaaaataatgaattgcctgctagattggctatttccatcttttgtttgtagttccgtcaatctttataaactgtatcgaccctgatgtgagttgttctgactctgaagttggctatttttttgtcgtaacatggtttttcttccctatttcacttaacacagaatatcatcggcttactgttaacttgttcttgtaagcgatatccaggcgacaagcttgagaatgttcaactttggtgggctggaaaagagctggccatgggcaagaagttatgtgactatattggtgttaatgacaaaacaaaggtaacctgcaactgtagtttaaaatggttccttcaattcgtgttttccttttttacattttctctttttgtattaacttatgcagattatcatcaggttaaagcatgttcctcaatcctcatgagctttgagtgtgcttcaactacccttcattgttcctgcagagttagtttacttttgtttttgggtagtatgctagtagtatgcaagttatccccgttgtaaattattattcatcttcttcagaaaactcctatttttatctgtgccattgaaaacctgtatagacaccttaactgtaacattttcttttgatatcttagtattcaattttgtcttcgagagatgtggccattcaaggaaggcaatagtccagaatttgataaggggttgggaaaacaaaccataagaagcaatgtccatggttaggttcaggctatcttgggtgggcttcagagtttgtatggaaactggacatcaatcaaggctgtctgggaaaagttcagatttactgagaaatgatcacacctaataccatgcttagaggaccatgaaatcaggtgataaccaaactcatttcacaacagtttttgttattaacagtgatgctctatcgattttctttgctaagaaactagagaatggtgcgcagaaaagttgcccagcttgtctagcattgcagcctatatatataaagggggccctaacatgatgggctcgact

SEQ ID NO: 8900 - DNA, 6530 bp, Oryza sativa
tttcacaggattcagtcattttgtgtggttctgggattctagcttgccctaataacaaggtgatttacatgtttcagtttggatctttgggacaaaacaaggtgatgaagttggtgcctcctgtctacaggtataaatcctatttgtcagatctcttgtcctttactggttagaaacaaacattagcacattatattattattgttcttatcatcacatgagctaagttggatgaagcattgaagcctgtcctgccttgcagctgcattttactactccctccgtcccaaaataagtgcagttttagcactatttatgtccaatgtttgaccgttcgtcttatttgaaaaaagattatgattagtatttttattgttattagatgataaaacataaatagtactttatgtgtgactaattttttaaatatttttcataatttttttaaataagatggatggtcaaaacgctgagtacgcatatctatggctgcacttattttaggatggaggtagtaccatcaacataaagtatcatatcttggtcgatttgttcagtgaaacgtttatatattcttttcatggctttgacctgtcagtcaaacaatctgctgccccttctgggctactgctgccgagttaccagatgctaacaacctaacagtacagtaattccattgttcttctgcttcatctgtgccaccacttgatggttgtggtttgccaacatttaatctactagtactgttttcttggtttttcgtttgatgactcattttgcatccaagaacacgacaactgttagctaaggattgcacacgaaccaaagcactggtgagtgctgtcatcatatgaggctcttgacacttttccagttgttttttgcgattggaaatctctctccttgaaactttttctcttttttttcttcttctcctcttgagcaacagaaaggtgaaaactttttgccatggccactttatccaccccaattccccctttttccctctctcatctgggaagattctttggttgtatcctgagagctggtttgacaggcaaatggtttgctccatccaaggtgctgttaacattaagcctgcactgtagtaactttgacagtcattcacaggcacaggtatggtgaaagtatggaatctctcttgtgtttatgccattgcttgctttctctctggctcatcacagggcttgctcgtgctcatctgggcctgtttgtgtgttgttgcatgacccatcccaatcagaagctggctggacaagccatggtggtgggagaactgggaactggcaatcacaaccccaaagctgctccccttttggccacccctactgtgtttgtgtgagtgtgtcagtgaccaatgctaagagcaggtacaatagcaggctctaagccagctgcaaacatattttaaggagataaatgaggagagagagaggagagaagcgggctacagatttatagccagttgtagcacggactccaagacgcaatgtgtgtatgacagatgggaccatgtattaatagtgtagtatataactattgtataaatgagctattagattagctatagatgaattggagccggtagttggctatactattagacttgctctaacaggagggagtatactgcattgctagtgctactaccttgcaactgtttcagatgctatacttactactatctcccaattcaaaaggagtagcagcaaatccgaaccatcttggtaggacagtatacaaaatttttgaaatgatggtttgaagatactagtctggtctttttggacgatgccatccgtaatcgatggcaatggagtactgttagcttgttcttgattttgtttgctcatcactgcatttgctccatctcgatgtctgtctgcagatacatgggacccctaatctcctcttgctagattcctcaaaagcatcaccggccatgagagtgagctcaactgaaagcaagcatgcattgcattttcatttatacatttttcagtgaatacactactactcctactacaaaacctttgttttgaagccaaggaacagcgagatgcagcaggagcgtggcgtggaagctgacaaagtcacaaagagatgtctgcttattaatttgggagcctggactttggcgtgccttgtacaactacacaaaaagatgtgaggtaggtgaagggtaatacatgatgcaatttatacccaaaagattgattggtactccactctactcctgcatgaacatgaggcatatggtatggtcaagtaccgagaagagagtgtacttcgagagaggaatcaaatctgccaccaagtcagtgccaccctagcaccatttatcagtacagtaccccaagccccacaacagtacaacttctacccccccccccccctccctccactgctatggtaatgcaacgcaatgcagtattggaatgcaatgcttctcaacactctgtcaacaaggaagaaaattgtatgaaaatgaatgcatcagaagttcagaacagattcaggatggaagcaaatgaacagagattcatattaataaagctaaagattcatatgctacattaggaaagaagaacactacttcgaaacagggaaaattccactgctatggcaatgcaatgtgttctaaatattggtaatgcaatgcaacactctgcaaacacaaaccaggaatgaagaaattgggatggggatgaatgcatcagaagttcagaactgaaacaaatgaacagagagattcatatatcatacagctaaaatcctttggtccaacaaaacaagaaggggagaatcaaagaagaaaagagtccatgaatcatcacagcaattcattcacaacaaacattgctcatcttcacagggactctggaacaaccaaaacagaaaatgaaacccaagaaaaaaaaatatggtcttctttttcttcttctgttcttgtcaacctcatgagccatgacggtcaaatcaagaagagaatgaaatcatcatcccctgcacatctcctgcctctccccctgggcgacctcgccgccggcggcggcggcgacagatgacaccctgggcgtgttggttaccgagtagaacaccacgtcgctgacgcttctcctctgctgctgtaggtgctggtgctgcgacctcttgcagtgcgcaatggcgccctggatggcgccctcctccgacgacccggcgctgctactccgcttcagcgccggcgccgccgggaagaacctgctcgcgttgccgcaggacggcgtggacgacgacgacgacgaggtcgagcacagcggcgaggtccccggcgccgacgccgacgccgccttcgtcgccaccagccgcacccgccggatgatgccggagaaggacttgcggtggccgcagagctcttcctgatccatcacgccgccaccattgccgccgccgacgacggcgatgccggtcggcttggcggtggccaagaagagggacttgatgtactccctcgacgtccacctcttcatcagcttcaacctcttggaccacgagtacttcttggcagcacacaccttgctcatgtcaaccatgtcgtcgtcttcaacctccttcttggtcccctgcacctgcacctgctgctcctggagcagcttctgcacgagctgcagccgcggcggcaggtggagggggaggagattgcccttgtagaacagctcgtcggccggcgacgcgaacgccttgctgaccacggcgcccgagctgtggaactcgaactcccggaatccgccgccgccgcagaggcggggggaggaggggggcagcggcgtggtggtcggggtgaggtccatgtcgatgtagtcctcttggatcaccattgtgggggccctcgccattgttgccacctttgggtggaggaggattggatggacaaaatgagtctctctatacaagtgagggagaagagtgtggtgagaatggtttatagttgtagggttttgtgttggagtcactctactacttggaatggtaagacttttcttttcttttcttttccatgtgcaacaatttttattttttttatcaagaagaagaaaatgtttttttttgtttctggaagacagtgtgtgtgagctggtgtttggtatgggaatgcaaatgcaggcaggaatggaggatgtgcctcacttgcaacagaaattgttgttgctgaatcacgttactttgcatggctcgttttggtttccttttagttcttgattttttctttttatgtcgccagcttctctctctctctcttttttaaatcccctttcccttttcttgtttggttgtcaggacaggagacaagcttaatactgaagtactgacaattactccttgctctttcaggataacaaggaggttcatttcatattcagcgtttcagcttcaggataaactccatatatagaatgaaattctctgatttgaactaacataagtacagtagtaacttggttgttcagatttcagaatcttttgctcatgcatgcaggaagcagaagcaggggaagaagtaaaatgttccagctgaaaagtcatatccgctctgcagaatccagacacaaacgcaacaacgccttggaacgtcgccattcaattcaacgcaggtttggtttccgttctgttctgcaaaccccaaagaaaaaaaattaaaataaagaaaaaagaaaaggagtagagtgctcgtaggccggagcaacaagcaaagctaacgatgcaggataaaagcagtcaacaaaagacttcaatggctgtggaagtagtaactgaccagcagtaacactcacacccaaccccattgggtacagtaatatataatctccctcttttgcttctaaaaaaaatactagtaatactccaataagctttttttttccaaagcctaccaacacaccaaccaagccagcatcattgataggctcagcatttcccttctttttaatcaccacataaaatgctggacagatatgatcatctgctctcctttttttcccctttttctttttatctaactcaaaaaaatgattggctttaactactaccctagtacaactccagttagtagttgttgttagagcaaatttaatagtatagccaactactggctccaaattatctatagctaatctaatagcctattcatataatagttaactataaaaatatacatcattaatacccggtcatacctttcatacacacataacgtcttagagtttgtgttacagctggctataaatctgtatcccgttttcttctctctcttctcttttcttctcgatatatggttataactggcttatagcttgctattgtatctgctcttacagtggcttactactatactctatggtggtaattacagagagaaggcagtgcagaagagatgatggcattcattcagtcacaagggtggcaattgtagcttgtttgaccagcctttggctttggtccgaaagggagctctaaaaactttgaacagtgagagcgagctcagctcttaacccaatggggccataggtatgtgtgcactgtgcagttggttgtgcctcactcccacatgctgtgcaaaaacccatttctttacctgccccatttatctccttgagtttaatactacctctcaaaatatagcaacctataataggtcccaaaatatagcaacctaggatacccatcctacaatataccttatgtccaggttcatagtcctaggatgggtctcatcacatcttagatcgctatattttgggacggagagagtaagaatctaagagcttgaacgagagtttctggtacctacagcttctgccaggatcagaacttcacccaaacaatataacttttcgtccagattttaagaatttgtattgtagaattcaaaaaatggactagaagcctcaacttctttaaattctcagaagctaaataccaaccagttgcttcttagaatcttctcagcttcttcttcttcagattctcagaagctagctaccaaccagttgcttctcggaattttaagctcccaaataaaccctgagtttaataagagtagttaggatgggtgcccttctcaatttggttatggtttgattctcgtttaagcattgtttgtttcaaaaaagattctggtttaggttcctttgggattgttggattgaaaaagaaacaagaatatggaaatgcaggaaatagagtgtcatggttagctcaatcctacaggaaatagaaacatgtgaatttagggcccctttgaatcacatgaatgaaaaaatagaggaataggaaaaacataggattctgacagaaatgtaagtgtaaaacagaggattgcaaaacacaggaaaaacataggaatgatcgtttgattggaccacaggaaaaacacaggaatttgaagagagataaaagactcaaaggattttttccattaggttttacctcttgttaaaattcctccaaaacttgtatggaaagagaca

SEQ ID NO: 8901 - DNA, 140 bp, Oryza sativa
agccaggatcgggcggagtccgctagggccactggtagatagtttgccatggccttgctgtctcctcctgctgcgcggattgcgagtccgtagacggtgagccaacactctggattagtggtgtcgtcatacttctcgtt

SEQ ID NO: 8902 - DNA, 625 bp, Oryza sativa
gtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgcatggcggcgctcagccggttcgtctcacgactcggcgagcgggggatgctcttcttcaagctgctgaagaaaactgacaatttccagtggggacccgaagcacaaaaagcctttgaagacttcaagagacttctcactactccaccagttttggcctcgccgcatccacaagagccgctactgttatatgtgtcagcgacctctcaggttgtgagcacggtcctggttgttgagcgtgaagaggaaggccatattcaaaaagtccaatgaccaatttattttgttagcgaggttttagccgactccaagaccagatatcctcaggttcaaaagttattatatggtgtcttaaataccgtcaggaaattatctcactactttcaaagtcactcggtcacggtggtcacatcatttccactcggagatatacttcataatcgcgaagcaaatggacggattgcgaagtgggccttatagttg

SEQ ID NO: 8903 - DNA, 472 bp, Oryza sativa
tggctggaaccgaggcagcgatcatggtcttcgtctggttcaagatgttgacaacatgatcagcttggttgagtgcgtcttccttgaggagggtgtcgaggagagtgattgctgcaaccacgttctgctggggggtgcgaaagaccgctgttccatcgacgtcttgttgcccaatgagttctctcgctcggcgcccagattccaaggcgcgttgccgtcgatcttcagcctcctttgcaatccgttcgtgatcttgctgctcacgttgtagtcgttctcgctcctgtcgctgtcgctcttcctccagtcggcgacgttcagcttcttggcgtgcacgatcttggtctacttctcgggcttggcgttgttcctccgtttcattgtcagccatgaatacgccgaagaagaggggcatgtagttatcctcatagctgtcgtcgaagttgtcgaggtcgccgtggtcgtagtggta

SEQ ID NO: 8904 - DNA, 9307 bp, Oryza sativa
  unsure (1)..(9307): unsure at all n locations
ttctcagtgcttttctggatttcatcagagatatggtacgtacatcggtgtattgcagaccgcatgcgagcaatcctagtcattagaaggaattagttaaatattgcaagtaaaagaatttaaatatattaattgtgtggagcattaccggtcagtatatatgcactagcagcttctcccttatttgcagttgttctttaccatttatcttgtacgagttgtacgcgctgtaaggatattagcaattcatattaagtcgagatttaattataattcatcaaaagtacacatgcatggatcaaaatcacttactattgttagaaattatatgtacatcccgtgattataatcaagggtagataagaaacaaatctaatgatcaatacatagtaacgatgatgcagttagtcacggatgaagtaacacagatatgtaatctatgggacttacttaaaattgtatgcggccattatgacttttttgttgaaatttcaagaaagctcgtcccatgtactgcaccccagtaagcaacttagttttgtgcaagcccttgatgtattctgctatcttttcgggcctcttaaccatttcaattaatttaaatacttcatcccggtatgacggcaaaagcctcggcgtatgatacatccattggcgcatgtccttatctctagaaanaattatttataactatatntaaaaaaattcttaaacaacaaatatttgtaaacaaacttaagttcgccttaaaggatagagaaatattaataactaagggatgggaatctatgaatttctcgtaaatacaatacactttttttttacatagacctagggatgaaaaaaaatttcctctctcctatctagatctaggaaatgaggaaatggatgagaacaaaatacatcattttgggtaattaaattgtcgcattcaaccactagaggatgactgcgaccacatgccatcatatagtatacatagatccaacataattttttttacatagacctaggggatggaaagtaaacataatacacttatttttttacatagacctaggggatggaaaattttctctctcctatctgatataggaaatggatgggagcaaaatacatcattttgggaaaattcaaccactagaggatgagaggatcatagcatcaaggagtatacatgaacccaacacaatcatatcaaaggaaagtataggaaaaaaagaaaagaaaaaacatggtgcttttttttcactattttgcatgcacggatccatcacaaagggatgtttaaagggatgtttaaagttataaaaaaatgagtagtaagagtggaaaggcatatatctaaccaccgtagaaaaatcattcgaaaatttggagttcaaaaccttcccccctatattttgtttgttttcggagagaaaaacttcggaagaatgaacaagtgctcaaggagaaaaaaaggctatatagcctcatttttgcaggcggaccacataaggtggtgcctacaaagataaattttcgcaggtggaccacataaggcgtccgcctaaaattatcgcaggcggcgccttatgttgtccgcctaaaaaatctatcttcgcatgcgaacgacgatgtcgcccctggttactattttcgtagacagccatttcgctccgagagacctacccgcctagaaaaaaaatgccatcgtctgaaaaaaaatggtttttctagtagtgcttgttctcccttgctctcccccatcatcgatctcctatagtctctacttcgccgccaccgcgctggccacccactgcagggcgccactttcgccttcgcactgatgaacttcgagcagatgctgatccatatctattatatactaaaagtccattaaactctctacaaacgctctaaaaccgtcacgtggcactcctacaaacgttctcaagccgccacatggcacagtaatctcaccgtcgattttcacttaaattggtggacccgttattttacacaattagattagatttattattaaatataatagcttcctcctctatggaggatacaaacggtgtaggatcgtaaagggtaaagggtctttcccaccccaaaagctagccattgaggtgaggggctcctccacttatatcttaggtcctttgcccttcctaggggtggacaggaagctcatggctcgttagctcgctcggctcgtgacaggctcggctcggctcggctcggctcggctcgtttgaatttcctaacgagccgagctggcatttcagctcttagagataacgagccagctcgagctggctcgcgagccgctcgcgagccttaacgagccagagcagatgaggcccaggcgcctagcccagcccaacagcccatcacccagcccatcaccttgtgaaaaccctagagtcaatccccttctggcttgtccccatcctcaatccccacccaagccgccgccggcctcatggctgccgctcgcccgcgcctatcctccccggcgccgacgccgccgcccccgcctctcctccccgacgccgacgccgtcggccgtggacgccttcgcccgcgccgctccttcccgccaccgccgccaccgcccgcgcctctcctccccggcgccgacgcggccggccgtggacgccgccgcccgcgccgctcctccccagcaccgacgctgccgtggacgccgccgctcgcgccgctcctccccggcgctgacgcaaccaaccgtggacgccgccgcccgcggcagtcctccccggcgccgacaccgtcatggacgctgctggccgcgccgctcctccccggcgccccttctcggctcctccccttgttcgctttctctcttgtccccaaagctcacgagcctaacgagctggctcgagctttcaaacaagccgagccgagctgggtttctagctcgttaggataacgagccgagccgagctagctcgttatcctaacgagctagaccgagccgagccgagccgagccgagccagctcgacatccacccctagcccttccacaaccaatgtgggactattcaacaatctcccccttcacacattcaacaatctccactattcaacaatctcccccttcacatattggtgtcccttagcccttcaccgtgtatagaccccacagagcaggccaacggtccatcaggtatacgggccacgcaggcacccacggtccattagaccttcacacactgtgtccatcgggctagagatgttaacctagccaggctctgataccaattataggattgtaaagggcccactggtggagaaaccatctttggtcggtcggccaaaatccacaatagtcccggttgcaataaaaaccgggactaaaaatgatctttagtcccggttaaaaacatcacagctagtttatgaaccaaccgggactaaaaatcatctttactcccggttcatcccatgtcagtagtctgtcagggggccgaggatctttagtcccggttggtgacaccaaccaggagtaaagatcatctttatagtctcggttgataatacaaaccgagactaaaaattatattgatctttagtcccggttagtattaccaatcgagactaaaatttaatacgtagtatataatgcctatcccttatcctctcctacacttcatagatccgttccacttcctcttcacagatctaactcctcctcccctcctcacttcccatccgccccttctcctcctctcctcccttcccattcgatccggtggccggcggccggcggggccacggcggcgacggccgtgacgggcggcggctggaggggccgcgcccggcggcgaccatggcgggcggcggcggtgccacgcggggcggcggccatggcgggcagcggcggtgccgtgcgtggcggcggccggcggggccacgcccggcagcagaggcgggcggccggcgggggcgaaaaggatgttgagtgcactgccaccatcgatgagggatctgtgaagcttgacgttgtgaaccactaggtctagtaccagggggtaccgccccgggtggaccactcggtcaggatgatccgagcggtcaaacttaattgttgtctctaaccaccgaaagatattggggcatatcgggctggaacagcgttgatctcccgtttggtcagcttttgctttctcttagattcataagccaagggtcccccaaagatgtggttgagttccttgcggtggtcttgaaaaccagtcggggcatcaccttcatcatccttcttctttgacgtgctttgatctccgtcggaggccttacgtgcgttcttggtgtattgttttgcaaactgtttgtagacgaaacaatctttggccgcgtgattggaattgggatgatgcggatattgggagttcatgatcttgtcaaaagtgttgatgcgcgaatgttgtcgggaggatggtgtagtagttgccacaagttcctcgggcttacgcttgcgatccttgtgattggtacttccagtctcccctgtagtcggcgtatctttcttcggcttccaagtggtgcctgactgcttggacgcggtaatggcatcttcggctttggcatattcgttggctttttcggacatctgcttgactgtcttgggaggcttgcgcccgaacttgccgactaggtcttcgtggcgaatgcccttggtgaaggcggtgatgatgacgtcgtcggtaatgtcagagatcttgttacgttgctcggaaaagcgtcggatgtaatctcgaagggattctccagacttctgaatgacgttgtagagatcaaaatgtgtaccagggcgttcaaaggtaccctggaagttggcgatgaagtgttcgccaagtttcgcccatgatccgattgtaccacggggtaacccgtgaagacaggactgggcagaatccgctagggccataggcaaatagtttgccatggctttgctgtctcctcccgctacgcgaattgcgagaccgtagacggtgagccaggactccgggttagtggtgccgtcatacttctcgattccagtcggcttgaagccggctggtcaatccactcaacgcaggtcgcttgtgaaggcagtgactccatccacgtcgtcgtcgtagcgatctggtgaatggtggggagcgtagcctattgtcgcgcggcgctggttgatagtatcgcgaaaatcgacggggcgcttgcgaggtggggagcgtggtcgttcaactcgacgctccctgtgtagttcgggaagcgagtggacagatcgctcgtcatgacccctgctcctgcgactggatctcgcgccggcgacgctgaggcttggttggtgatagtcttgagatcgaagaggagaaactcggctgctagtcagcgtgctgacgcttgcagagttaaccgggaccgaggcggcgatcatggtcttggtctggttcaagatgttgacgacgtgattgggttgattgagtgcgtcttccttgaggagggtgtcgaggagggtgatcgctgcaaccgcgttctgttgaggggtgcgaaaaaccgcagtttcctcgacgtcttgctgcccgataagttctcgtgcttgtcacccggcttccaaggcctgttttcaccgatcctcagcctcctttgcagcccgttcgcattcctgttgctcacgctgcagccgttctcgctcttgtgcttggcgctcctcttccagtcggcgtcgttcgacttcctgttgtacgcgtagttcttctgcttctcgggctttacgttgttcttccgtctcgttgtcaaccatgaagatgccgaagtagggaggtgtgtagttgtcttcaaagccttcgtcgaagtcgtcgaggttgcggtagtcgtagcggtagcagaagtcatcgtactccacgatcttcgttggtcgcgagtcgacgccaggggagctgaggtagctgtccagttgttccgtcgaaaccgtgccgagaggctggagtatgacgccgacttccctggagctaggccgggccgaggctgaagccggatcccgcctaggcctatggggagaagacgcccttgtggtgaagacaacagccaaatcatcggggagtttcatcaggattggcggataggccccattgtcttgatcgggttgtgttgaagtagattgaatctcgtccgagtggtttgaagccaactcggtggagatgatcttggggtagacctcggtcgagttcgggataccgaacggggcggagatatggcctcttcccgactagtttgaatccgagtcgaggagagaaatcttgccgaagtcgttgttgatgaagtcgaggctgccgaatcggaacgcctgcctgggagggaagacgaagtcgtcgatgccggaaacgaaacccatcgcactagtcggcgaagaacttgacgctacccctacctggcgcgccaactgtcgaaacaagatttcggcaatactaaaagggggtggctatcaagctggaaaagtggatgggtttagagacaaggaattttatacaggttcaggccttcttaatcaagaagtaatactctactcctgtccggggattgatccgccgagtgtattattgatcgtatgatctaggaagaaatcgtgcccctaaagacacccggacccctccttatataggggaaggggtctgcattacaaaaaacaatccatatccctaacggaatatgtagctacagataaaaaacaatcataaccgactaggatcttgggtatttccttgacatacaagtttagaatttaacccgagtcctcttaaagatatcttatatacgatttcagggttacaatcctaccttttcattgggccacgtggcaccacaagcggaactcagcctggattctgggctctagagcagccacgtatttgcagcccacctgtagccgtttgattggaaatcaacgatggtggtgcagcgagcataattggaaatgcgttgcagactccgttaggggatcgaggataagatttttttatttttatattttgacaattccacatcggtgatttctagaagtgctctttgagctttgctggcatgggaaaaaacaacgtgggccaaaagcccaaagtgaggtagggatagatgtggcctttatttacttgatttgaattttttttcaatattttcaacaaataattgtaatcatgacgctatatgggcttttaaaaaattatacatacatggctaaaacgtaatttgatttatgggtctactgaacgttttacgtgcatgtatggtttaacgcaggcttgtcaaaccagttgtttataagctcgtattatcgaacatgcaatgaaaaatatttaacctacaatactgtaaatcttcacataaatatcacaccctctatattttaaacagacgacgccattgaattttgatttaatatttaaccacacatcatattgtaaaaataatgtgttatttattgtgactattttattatcgaacaccaaaatcaggaattaaaatatcgtcaaatgcgacgcatattcagagaagctaactagcaggctcgctcctcttttcaggagcatattatatttctcagtcaaaagtaaaagaacattaacttaaaaaaagaataagggaattaaatataccacaactactattggtaataccaaaaaaatggaaaaaaaaaggaactaaaacagtgttaaaatgcaccatatctacatacacatacacatccaaaatagtaggtgcacggtgcgcctattggcgcactgattttctagttctatctatacatggcaccccatacccagttggatatggggtatccataatctccacactagttgggataaatagcataaggggagaggtagagagaaggatacttactgacatgtgggttgtacaattattttttctgattttaaatgccacatcaatatcacatcagccaaaaccaccatccaaactatcttggtatcttatatgcactggtttgagagttgagggacacatcatatctggtattacggtttaggtatggatttcagactcgacgacaacgtgaggaacctgaaagtaataagttcactttggtccctctatttgtcgcccagtccgattttcgtcccttgaccacaaaaccgggtacgactcgtcccccaacttacaaaaaccggacaaacgaggtccctcggtggtttggaaggcggttttggctgatgtggtgcctacgtggcttatttgacgagttctccgttccacgtggcattgacgtgacaagtatatatcggaaaaataatataaagcgtggccccacatgtcagctgcacacaaaacataattttaaaatggtgggggccacgtgagccccacatgtcagcctcactcctctcttctttcctctcccttctctctcttcttccctttcccctctctctctccttcccgggcagcggacggcgcggatgggcggcggagcaggcgagcaaatagagggacccactttgcccgtcggcgggggcgaacggctcccgcgggggataacggcgacgcggtgcgcgtctccctgcgcctccatggcgcccactgtctccgcagctgccatcggcgctgggtggcaccccctgcacaagcgatgcggcgtctgttgagtcctcaatgcccgccagctcgtgcggctcaccgctgccgcgcgagtgccctgctactcccagatcggcgaggccgagacggagcacgcggctgcaataggcgtggcggtcgaggttgcggcaggtgttgttgtcggccgtcgcgctcgagagaggagaaggggggagtgagattgacatgtggccccaccttttattaattattgtttttaatgtaactgacatgtgggtcccacggggcttatttttttccaactcgaattgccacgtgagcaccacgtcagtgccacgtgggacggagacctagtcaaaccagctacgtaggcgccacgtcagccaaaaccgctatccaaaccaccttaggaccttatgtgcccggttttcataagttgggggacgggttgtacccggttttggggttaagggacgaaaattggactgggcgacaaatagagggacctaaagtgaacttattccaacctaaaatgaacctattccgagaaagaatagcctttccggcctgcaaatggcccatcgaacagcttcagccactaggacaacccgccttcctccggcgaaaatcctccatgggtttagggttccggccgccgtagaagcaagggggagagggggagggggggggggg

SEQ ID NO: 8905 - DNA, 13921 bp, Oryza sativa
  unsure (1)..(13921): unsure at all n locations
ccaccgccacacgcttgaggccatgagcctccgccgctgccaccgcaccgtcgagcaccgcaccacgccctccctgctcggcatgctcacccaggtcaagtgcctcgtcgtcgtcgagacccaggagatgtacgccgcgcggaggcaggccgaggaggaccgacgcgcccccaggcccccgctcatcgtctcccacacccgccgccgccgcggggagcgcccgccgcagaggcgcactagactcaagaagtaacttcctggagcctctagtttttctttcccccacatagtgattcgatctgcgtgattgattggttctccttgcacgttagctgtttgacgtaatgccccataagaaagagtgttccttttgcttctgtgcctggaaatgttcatctgattgtggatgtaacgtacatattcctcacattgttatttgttgtgcttgctttcgttctttacacgttagttgtgtgaacaaaataaattgtgcacttttccgttgcatctgtttgagctggaaatgttgacctgcttgtggatgtaatccacatgttcctctcttctaatgtggcaagaaatgtaacctgcatgtgattgttctagttcatggaatgccaatcgccaaaaccttcttttacattgtggaaactttttaataaaatctcttgatctttaaaatgaaacggaatgagtaaagtagatgcattggcttaacaaagctaaatttcatctgctctgtaaaacagtagctataattagattctttttttttgttcataacacattgtaaagaagatatcttgaaatgtctagctcactgaacaattcataattaactaacatttgtttttaacttgtgtcagtgctagcgacaaggattgctcaactcggtaagggttcatttagaaacaagcttgcgctgaccctagttcgttccttatatgatgtggtattatggtgggtaagatacgcattgctgccaacttaacacaggcattgccaacttaaaaaaaaaaaagctgtcataaagagtgttccctttgaaaatcaggaatgataggatgcacctcagtccgaatatgctacttacatagatgtacttgtgagattgttagaattatcctactcaaaacttccatattttttttaaaaaatgcgatcatgtagagtttccacaaaatcttcccacgtcttattcatccctgtcttttccccatgaatcccacccaagctcagtgacccattcgtttgattcctctccatttgtcacctcgattttgagagggagggacggacggacacggacgagaggcaattccaggctcaaacatttctgacaccagatacattgtaccgctgaactgtggcttgatgccttcggtccagcagttttatcatttgggcacgacatcctctctaacatcacgcagtcacagagtgctgcttcttgtatgcgaccactttctctctgacttcttgtctctttttctttgtttagttgaagaactgtatttgcctttttagacagatatattacttccttccagactttacagtgctaattcatgttatgctaaattagagcataaaaatctttgtgctgtatgacagccatgttttacaagtgtaaagaagatccttgaaatgttgttgatgaaaaacataccaaaattaaagtgattagtaatcaccagtgtatgctgttcctttgtctacgcatgagtaaggtcattattaagccaaaatagaaggccagggttacctgttgtggtgtttatttttcattcaactgccgttgaacttcggggattttcttgatagcattgatgtttgatctgcctattttcaccaaagtttattaagggttttatttatttatccagcatctaatttaaggcttttatttatttgtccagtatctaatttagtattggtttattatattttggatgaagggatgatagtttagtctttgtatatacataaagcgaacggtagaggcgttggcgtgtactactgctggcccaatgcgtagcccatgggcccagcggctcatgttgtaaattaactaaagcgatggatatgtatacgtgcctggcactatttaatttgtaacaagattgattcagcattgaaacaaccaaattaacataaatataggagtaaataataattaagtataatacactagttacaggataagaaaaacaatccatcgatctggctagctatctagaaaatcgatgacgatgacgatcacggatacgtataattaattagttgcctaatcgaagtgacagaggatgccatcgttgccgatgcggcgcttgatctcctcgtcatcctccggcctgaggacggagacgtcgtcgtcgcgcctgcggcgaacggcggcctcaagctccgcctcctccagtgtcaacggcggcagattgaacctcgcgtagctctcggcgcttgtcgccgccacccacgtggcgaactccctctcctcacgcggctcctcctcctccctcttctcccgctcgttcatctcctggagcagacggaaagctcaggctaccgccggaagccattccgccggctcagcccccgccaccgcctcctcccgcttcgcgttccggctatccatcatggattttgagcttacggttggctcgatcttgttcgttcttgctttgtcgatattaattagacgatttacgagagttacagtgtgccctgcctaataggatctgcttgtctcaatcccccaactattaataaaaaaaccccatactttttctccaaaaccgcggtcggacttctattcggactcctgcgaatttttttcgtttttagattttttttaatatttacagaaataatctatcgactaaaaaaattgcagaaatagctcctgccgccctaatggtgggcggcaagctgacgtggcagacggtgggtcgaccgcgccgtctgccgtcgtcggccaaaattgcgattaggcccttgccgtccatacagagggcggcaaggggctaattgcaattttggccgcccataaagagcttgcggccgtacttttttggggcggcaagggacccagatgaaaaaagtacggccaaaagattttttttatgttatgttaataataaataaagaagtatttattggtaaaacctgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggacttaaacaaggaaaattatgtaacatgaagaaatagtagtacaatttgaacatgatacaactatttgcattgcgattacatagatgatattagattcgaactaggagggaggtagtgcaatagttgaacacaacgacaatgtagtaatgggacaaggaagcatgacagtagaaatttcaatatgctaagttctccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatattgtaggatttatggaacaaagaacttgacaacgatcaccacacctgtatcttggacgggcttcccatggagggagtgccatagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacgtgtgaacgtggtggggtatggtgggtacgcctgactggcgccgaaagatatatgcatgatcggcgccgaaagttacattggtcgtatgcgccaaatggcgggcaaatactcgtatcagacgcgaataaaggaggctgcatcggtgtggcagaaagtagttgtgcatgcgccgaaaggtatcgtgcacatataaaaacaacgttgtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgtggaggagtggcctgcgcctggtcctgcgtctgcaccggcggtgcgcctcccagctgtgaggggccgatgacgtcctctgtcgagcctaaagtgaagtcgaagtcagtgatgtcgaagagcaaggtggaaggcagcaagcggtccgacgaggtcccagcatggtccagtgatcgaccctgactcgacgtgccggctgcctgtgacgaagtcccggtgtactgccagaactgcgctgagtgcgaggtcgacacagctgcctgagacgctgaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggatggcggggtgctgaacggtgcacgaaaccctgaagcaatcggcaagtgaaacggctcacttatatgtgcgaggcatgtacagaaataataataaaaatagaggtctcacagcacgtaaaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaagtcgccaacttggcgggccagtcgccagctgactgctgacccttgcgcgagtacctgcgaattaatgtgtaatattagtgtgaaacgacagatgttacaaattattgtgaacaggaagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacgacgcacgagcctaggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcaatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcacgctgggatccgtcttcgtgcaagactcacaaagtgcacggtacagagacgccccaccgcggaaccccagctccactgaggcacctcgcctaccgcggagtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtaccgtcagatcgtcctgccagtccacagccgtggtcactggcccaacagcgtctcccgcgagcggtagccccaacaagtacgatacgtcatgtagggtaggggctacctcaccgcacggcatgtgaaaagtgtgcgtctctggcctccatcgatcgaccaaagctgctaggagggacctgtccacagtccatcgtctggccgggtccgcgtcgccggccgtagcctccaccagccgacacatcggtaggaggccgacctcacgtagcctgcaataacaaattaatatgtcattataacaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagattacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacatcacgtagccagacgtggcacgacgacgcctaggacgtggtcgagtggaggtagtgccttcacccgtagggcgagctccatctgctgctgatcctgatagtcctgcctccgcagcacttggtttctccttgtctttaggacaatgcttgtaggtgtgcccatgttcatcgcatttgctgcaacgcttcaccctaccagcctccgactcgtccatatcgttgcggatgcgacgagtcctcctccttccagccttgcctcggagcttcgatgggtcaggaatattgagtacttcatcgttagtctctgtgaactccccagctatgcagaacccataaatctcgccgctccatgtatgatatattgcttgcttactgaagtactgtgacacatatactgcatctagtatgccacactccgctgcggcagcaatgacatgggtgcatggcctgtggagcagcttcggctttgcacaagagtaatgacatgtgccatcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgttgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatccagttcttctaaccaatgttggactatccgttgggagaggtccaagagcttgaggagggttagcaacggcggtcgatggagccgctgcacgctgatcactgcatttggctgtcaactcatctaatatcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcatacgaacaacttttgttttaaccaatttcaggaaccagtaccagctgtcggtattctcactctcaacaaaagcaaatgccaagggcaatacctgattgttcccatctacccctattgctgttagtatctggccccgatactttcctgccaagaatgtcccatcaatgcagagaacacgacgacagttcacgaatgccatcttgcatgcatgtagagctaagaacgccctttgcagcacactcttgctaggatgttcaattgaggggaatttcttcacttcgtaagagctcccagggtttctttcctctataacaccaagcaagcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgaaattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttactgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctgcatttcatccacaatggcaccgacagtctccccctcatcggccactccacctggttgaatgcccactggagctactacgcccccgtgctatcgtgcgttgaccccccccacagaagtctcgtttacctcagcacttggtccctcgccctcaccatgttcatncgcacacccggatccctcgggtgaacaaacggaaccaaagccagaggtcccccgcgttgcaatgcattttcccaataccatctnccaccccgagagttctaaactggaattagtttcccataaaaaccctcagttggcccgactaccataaccttgattgttatgtcacctgtctgtggatcaaccctcaagccccctcttaaccctccctttatagaaggtacccctcctctcagcccatccatcaattcctcttctcgataccataaaatctgaccgatcctacccagttggcccctaacggacctttcccggtccctggtaaacttggaatatttgtttgttcgacatatctgtcaacgaaataactagatcatattactctttcatgcaataaacatctacaacgtaatatcttcttgtgtaagccaatgcaactgtaatgtattgattccaaactagcagatctatgtagttaccgatatctacaatacgcacttctagattagtacaattaaaaccctaaaaatataatgcatttattcaaacaaatttttaaagaatacacactatttaactcatagtcacatataggatctatgaatattacctgaaatcggcgtctgaatccggcagggcttcgccccttcttctcttctcctcccctctcttcttttttttttcactggaattgaggagagaagaatgagggctgggggctgggcagcaggccttctataggcagcgaggcctgccgcccggccagaggacggcaaggggccgcctgcaaaatagccggccccgactggcttttttgcattcgggccccttgccgtcccaccagagggcggcaagggttttcctgcaaaaaaccctccctccatcaccgcccgttcctcccccgtttgccacgttagcttgccgccccagaggtgggcggcagggtctatttttataatttttttggccgatagattatttctgtaaatattttttaaaaaaaatctaaaaccgaaaaaaagtcggactcctgcgactcctcgcgtgggccggctcggaccaggccgactgctgctgctccttagccgactcagcttactagccaaccgagtcaatcgagccaaccaatcagcaagacatgcacagcacccgtacatgcaagctgacgtcaacacacacacctgcatgcatcaacatatgcatgcatcgatcacacatacatgtacagcaccgtacatgcatgcatacctgtacgctacagtacctcgtatactgtagcatcatatactccaacttttcaattcccttcgcgaacaccagtggttgcacgcacatctcgtgaagcccgttgcaaagatctcccccacacggtgtccatccaccgtgtgccgtctcgtatccaacttcgtcacccggtatccttgaccgtctggacctcaactcctccctgagtctagtcccgatccccactgttgaccgaagttgacctccaagaatccatactctaatcatcttctcacataatatcccgactgcactagacctctgctcctccctgaacatagtcccggttctcaccattgactaaggttgatctcaagtcacctgcacacaatcagacaaaacaaccgttcctgggcacagatatcacaacctgacccacattagtcatacgcactcaaacaaacatccacacatcttttcaaaccaattctttgattaaatcatttgtataaccaattgttcatcatagatattaatcatgaaaatgatttcacaatctcctctttgatgaacacattggcaacatcttcaaaatgcgaatttgtgtttttgaaaaaaaacaaaaatcacaaagtgaaaaggaaaactctccctttttaaaagagagttacagtgtgccctgcctaataggatctgcttgctatttaaagcgaaaaaggtgtccctgccagaaccgactcgttacggtgtgcaaaatccgactcgacgcagtgtgcgaaagtcgatttacaacgtgcgttcataaaatccgtctcgatgcggtgtgcgaaagtcaatttacaatgtgcgttcatgttcctgtgcagacacatattcctaccgttcgatgtgctttgggattcgagcacggccagccttctttcgatctctcgaatttatccccattcttgactttttcttttttaacaaagacgcccgcatacatgctatatctataacttgaatatgatggacaagatcccaggggatcacttctgaaattatttgtttttcccccacctttcccaaatgtgttccatgcgcacgcttttcaaactgttaaatgatgcattttttacaaaagatttctataagaaagttgcttaaaaaattatattaatccatttttttaaaaatcatattgtggaaacttttgaataaaatctcttgatctttaaaatcaaacgaaaattaagtaaagtagaagatacattggtctaacaagctgtagccatgtttacattcaatgtttttttttttggcataacacaggctgaggctccagatggtacaggtaacgaacgaaagcaaaatacccctctcacagataaatgaatatgacaatttgcaagatggtgttgggattaagatgatggaggttgataccatagaggtgtagcagacctcggaagaaatcgccggttggtagcccgagcctgaactgaaagaaggggaggaagaccaccatctcgtgggtgtcgggcgttgggaagtcttccctgacagcctccctctatttgatgagctcctgcgggggaagatactgttgagttgtgatccaaattcatttgcatttaacaaaggttagcttctgccatagtggagcggaggcccgtcgctggtaggcttgggccagagcgtcttagtcagcaaagttacattaagaaggttcttcatcgttttaacatgcataatacaaagcctgttagtactcttattgcacctcgttttaaattttcagctttacaatgtgctagtactgataaggatgtagaatagatgtcaagagttccatattatagtgctgttggttcttttatgtatgccatggtttgctcccgtacggatttatctcatgctatgagtttggttagtagatacatggctaatcctgataaagaacactggaaaggtattcagtggattttcaggtacctcagaggcacagctgatgcttgattgaagtttggcaagagtgataagggacttgttggctatgtggatttagattttgctgctgatttggataagagaaggtcactgacaggttatctgtttactattggtagttgtgctgtgagttcgaaggcaacattgcagcctgttgttgcctagtctaccactgaagcagaatacatggctgttgctgaagcatgtaaggaatcagtttgactaaaaggattgtttgctgagatttgtggagttgattattgcattaacttgttttgtgacagtcaaagtggcatatacatcactaaatataagatgtttcatgggaggacaaagacattgatatcaagtaccattatgttcgcgatgtagtcgcgcaaggtaagctaaaggcatgcaagataagcactcatgataatcctgttgatattatgacaaagcatgttcctattgctaagtttgagctttgctcaagtctagttggtatagtggtttagcccaagaggctatttggcgccgaaagtgtttttgtctttgttgtgttcagggtaaaggattgattcacgctacaaggaggaatttgtctcaaggtggag

SEQ ID NO: 8906 - DNA, 5646 bp, Oryza sativa
gtgtttgcttatgcaattactctatgtcataacgatgatattagagtagtatctggtagtttaggcgtggtgtctagactacgggatatcattatttggggttatatgctgtggatgagaggtgggccgctgatggtgacagctcagtacgggtattcctccgcacgtgtatatagtcctaagttaatttcctgtggagggtactactccgtatttagccccggttgtatggtcatgatgggctgtcgtaaggaactcggcagtcaggggtggcttctcgaagtactaggagggcatcggaaagagggtattagctagtaaatcatataactagaatgtatgtataatttgtatactagaagtataggaatagattctttttctattttctttccacttagcttagataatttagtttgagaatgagaagttctatgcttgtgtgtcatcctaccctttgaattatattaacccctgcttagactatgattattacaagtaacataaattattagtgcggttctctctattgtaatcttcccacgggattaaacaaatacgatacccatggaatactctcgggtgaaatgctaccactggtggagaaaccctttgtagtcccggttcgtaacccccctttagtcccggttttcaaaccgggactaccaatccaggactaaagatcgctatctttagtcccgggtgaaataaccgggactaaagatcgatctttagtcccggttcgtacaccaaccgggactaaagatggctccgccacgtggccgactgagccatctttagtcccggttggtgttccaaccgggactaaagatcgagctgacctttggttttttgcctggcctcgcgtgagtgcgagtgtatatatatatatatatataatatctagtatatatgtgatatatatatatatgaccaaattaaaatatatttacattatagaaaatgtgtacacatgcatatagaaatatatgtagtcatgtattaattataatccattatatgtcctagctagctacgatttcgacgtagtagtagtcgctagctcagaagctaaggacctatgaattgtgtttccgtcgtaatataattcacccttgggatcaaggatttgttcgttgatgaatcccatgagttgttcttgaaccgctgcgataaattccttgtgtgtgttcaggttatccctcatgcgaataaactatatgaatgtatgaaattgattagtaattaaacaagaaatcgatatgtaatgaaattttgaatttatttgtacgtacaacgagctctcttgtggtgatgatttggtctgcaaggcagtggtaatactcgcacacgtagtagccgcacaagttagttccctgcttttgctttgcgcactacaaataaatgacaaacgacgaaagatctaattaatatacacttgtatgtatttgaatcggagaaatataaatgtagagcatgtgtactcacaggaaatttgaacttccgcctaagtctttctctccagttgccgcggaccaaatgacggaaccgataccaagccttacatggagtttaaagctatgattcgtagtagcaattaacataacaagattttcttaattaacagaggaacttatgacagtacctgtctataagttcgaaaaccttgtcaaacgtagactcttttttatccattgagtcatatacgttgacggtgcaggccgacaggtcgaagagtaaaagcacccagtggaatctacaatgtgcgtgggatgcattacatatgaaacacttagcaagtgcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatctagtatcgaaaaccccccgccgttgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgattcagagaatgtcatctccttgcaagaagtccatgtccctgatcctcgctccgatcatctctctaccggtggcgctcatctccatgtacagctgatggaacttgtacatttgtgtgggtagggactgcaccagctcaggcttgacaagcggtttaccgagttcgtacatgtatttcacttccgccttttcgattggtgcgactcctacaattgatccgtagttagaccggtgtcagtaataaattcttctatcgtcatttcttcaccggtcaccaacggctcaatctcctggtttggttgctctccaagctgagggactggtttggactttccagaagatgctttatcagcgttcgctcatagtccgatagcttaatggcatccttggcaggtgcagacatacccctgaagaagttcctgacacttgggtctataggaatcttcttttctggacttcgaggcttgaattgtctcttgacttctgatgccacgtaagcgtcaagctcctcttgcgtgcaatcataccccgggtccttgctcttggcggcgtcaactttcgccttcttcgttgcccttgtgtgggcaggcggtggagcttggggggcccttgactttgaaggtgccggaagaggagcttgcggaggagtcggtgcaggagcctgaggtggagacggtgctggagcatgaggaagagactgtgcaggatcctgaggaggagatggctgaaccggaggagatggtgcacgagacgccgtttgtcgcccagggaggatgatgtaccgcctgcgccatagaatgatgtcatggcttgtgttccagatgcgtctcaccgtctcctccagggtaatccagctcgaggtcctcgtacgcaccttcgaccaactcaacttcgaccttggagtatcctgctggaatcggtctgcagtggtaagtacctgaagggtccgttgggatggccatgcccgacgccaccatcatgtggtgagaggttatttattagtaatcaacatatataatcagcaactagcggaatggccaaatctaaaatatataaactacgagcttacctttattgataagttcttgaaaggaatatgcagctcacatggtgtccgctgagtgatgtcatcaacgggccaggtggattcgtcctgggtttgcatggcgtccatgctctgtgatcctacctgccccgttgaggcgcagctgctacagtttcctgacgggctcaccattgcaggaggaatggtcggctggggatcatgggaccgatatgcggccatgcgttcatcaaccttccttgccacctcctcttgcatgctgcgctcgtagctcgataccctgaaatctagatctgcaatcttcgcctcggtatctctcttgcttctcatccgactcctgtacgtgtggatgtcctccttgaacccaatcttccaaggaatcacccctttccctcgtgttcgtcctggatgctctggagtctgcagggcgagtgacagctcgtccctctctctatctggtcagaacgtgccctgagaagagtcttccactgcgtctgttagtcgacacgcagcctctcgtatctgatcgccgaagacaagtgagccatcagctgggttgagcgttccaccgtgagcatagtaccagaacttcgatcgttccggccaattagcagtggccggtttgatacccctctcaagcaagctagcctccatctcctcccacttcgacatcgcgacgctatagccgcctgaccccaagtggtgtggtacttcttcttggtggcattttctttgtttctttccatcatcgcctgcccttgttcacctgtcttatatgcaacgaactcgtcccagtgatcccttagctttgggaatgtgtcaaagttcggtgtctgccccttcaggatatatttctggtacagatctcccttgaagctctgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttcttcgccagtacaccgtactgacaggcacgttatcccgcataacccaaccgctgtgacgtacatagttcttggcggcttctgccggggcactaggtcgtccatcttcttccacttccgttatgatgtgccgaccctcaagcttcttcgtggcacctcgttgcccgtgtgccctcttctgtccaacggagggttgacttccactagcctcctcctcctagttcccctccacatccctttccatgtgcccctcctggttcccctccgcatccctctccacgttcccttcctcgttcaaatactggtttggatccttgttcccctcttcttcattccagtactggctgcttccctccacgattgtatcgtacaatatctattcctcatcgcgatcagccatctgttcatacaggaaacatctgctaagtcatgagacatttatgttttaacaatcttatattaaaactcaaataatcttatatgctaagactaaaatagtcatgtatgctaagtgtaactgtcgtatattagaaccccacacaatcttagaagctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatatgctaagactaaaatagtcatgtatgctaagtgtaactgtcgtatattagaaccctacacaatcttagaagctaagtctaattacaaatctaataatcttatactaaaactcaaatagtgatatatgctaagtctaggtgacgtatattataggaccctagctagtcaataattatatactaagtctaattaccaatataataatcttatattaaaactccaataatcttatactaaaactcaaatagtcatgtattctaagtgtaactgtcgtatattagaacactacacaatcttatatgctaagtctaattacaaatctaataatcttaattgcattacaaatataacaatcatatatataattacgtcacttgcctgcacgaattccttcgagggctagctctaccactctggcttgagggacaactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacatttattcacctgcctataattgcatttcacgttcacgttcgttcgctcgttct

SEQ ID NO: 8907 - DNA, 616 bp, Oryza sativa
gcggcgtgcaggcgcaccgccggtggcgtgtggtgcggcggcggcgtggcggcgcggcgccggtgccgtgccacggtggcgtcgtggcgtctcgtggcgcggcgtcgtcgtggcgcggcgtcgtgtcctgatgaggtcggcgtcggcgtctgaaactcggcgtccggcggcaaccgagggggagagagagatatcgagatcgaagagagagatcgagggaggcggcggcggctctcaccccagagatgcggcggcggcggaggagatggaggcggcggtgacgacgacgagcgcgagacgacggcaagatacggcggcggcggcggcgcggggatgccctaggcagtggcggcgaaggagaagccgagagagatcgatcgggcaaaaacttctaagtgttggtggagaagacgagggcgcgcatcgggaatatatatacccctagatctttactcccggttgtggactaaagatcttttcctgctatttctaaattgtttttaaacccggttagggttaagaaccgggactactgataagcgcactgaatattattttccattacatatgtgtttctacaatagaagataatgcattacaattatttaaagtacaa

SEQ ID NO: 8908 - DNA, 2213 bp, Oryza sativa
ctaaatgatctacatatttgtgttcatttattgagtctattcgttatttgtgcattggagtaaatggacattgatgcatgtatccatacacacaagtatttataacctacatgcaatatcttgatttgctattggttaggaaatattggggatggtgtatgcatctagtttattgctagagtaaatatagtatgagagagttattagcttttcttggtcttggtgtacctatgaaatatgtagataaatatggaatggagggagtatacagtagtgatcaaacttcttgatttatgaacagagaataagtaatgaagtagaaataaacttattttggcacaagttttaaccaaaaaaatcagttttattttggggtagaggaactacatactatggtgtgaataatttttgtttctattactatcgatctactcccaccatcctaaaatttaagcatttttagtatagtgacaagtcaaacatttttaacttatactattaataacaagaaaataaaaaaagatcaatcatgtaaaattgattagtagatttatcattaaacaaaactatcataatatgcatctctttctattaaaacatcttatttttatagatattgttggtcaaagtaacatctcagagaccgtgtcagagtccaaaaatacttatattttgggacggatggagtacatgatccaacacgatctgagagcttagattttaatttctttttcctccaaacgtagtaatttctataccttcagagtgaaggtgatttatcttttcaagctagctttactgtacagttaactatgtaaacaaacaaattaattaattaattacctataacattgtaaggtgtttaatttttttgtaagtaaaaagtttttttttaactttgatcaagtgtgaaaaaaataatcaacacaataacaagtaaatatactatcatgacatacctcattgtggattttagagaagattgactcagcacaaagctatctgaacggattgagtattgaaaatttgaaaaccggatgtgaacaagtattttaagaaacatagaaatttgtttgaaaaaatcacgacgttttatgagctttagaagcgtgcatgtaacaatctgttagctagtatagcactttcaaaggaagcctttttcaacaggttgagctgtcgctgagactaaatagctctgtgatttcgtcgtgaacataaatggaccacgtcacaatttaaatgtcaagcgacttgcaggtaacagatcatcaaattcgatctttcgatggttcagtcttggtgaaatttcatatgggtgtatccaggtatttttctcctattaaatcctttcacttgcagtataatctttttttctcctattaacacattctgactttgcatgcatgaccatcattatgtagaaagcgttgcgttgttgacctgtaaatatatgccacttcttgttgacttgttgggccttagaagaaaattgctggatcaaagctggctgctggtggtggtgaatataatgaaatggaaatcgtcagttgatccaattgttttggtcaggcgattgtataatatgctcttttgatattaatcttccacatggctagttaagggcttcttatatatatttactaccagttgatactccgtgttttggtgtgacatgtagataaatgcatgttatacattatagaaatagaaatggtacatgtgtatgttaaaataatatgaaaatgatatggagataatgatttgacattgctttcataaagttctacaaatacaacaaaattgtaaatgatatgatatatttgtatgatatttaaaatactctagataataattgctagtgggtaatgatgtgacacacttgcatgttgagttttagaaattagtggacatcaactttgtactaagataagatacgatataatgttgactatacaatattattggagtatgtagttttctcggaatatgttatgacatatgaccatatactatgttaatggtgtatgatattaatggtgtaggaatgtcaaaagcacaaaaaaaaaagtacttgcataaacatggatgacaacaacaagcatatattctgatttggagtcacaagaaaatactcctccatccaatcaaaaatattttttgggaattgctaaacaactacctactgaaattttttgttttgtcagctgagttcg

SEQ ID NO: 8909 - DNA, 4343 bp, Oryza sativa
ctggacaaaccagcttattagacgcgacgagtagtataggagccaacacaaatttgtgtgagggaagaggttgagacggatagggagcaagtggccgaatcgtgacagtgctacaaacagaatgatttcatagtagtagtgcaacttcctttttccgatgtatcttttttttttttttgcggggtttttccaatgtatcgatcattgttgactttagcgagcgccagcagttcagtacacgcaaaacgcacagctatatatgtgtacgctaatcatccatgaattgtcccaacctcatttccttaaacgcctacgcatagctctcaccatgtatccgcctctggttctggtccttgcaatcttcttcgccgtggccactgccatagcggccttgtcgagtcccctcccgcacccactcgacccactttctcccacggagctcacggcggtaaggtccgccgtcctcgccttctctctcgtcgcttcccgcccgatatcctttcactatgtcggcctcgatgagccggagaagcccgatgtcctctctcacaccaacgccgccgccgccgccatcctcccacgccgcgcgtttgtgatcgcccgagccggcggcctctcccatgagttttacgtcgatgtcaccaacacctccgctccccgtgtggtttcgcatggtattcacgatggccctggcttcccaatgttcacgaccgaggagcaggtggcggcgggacagctttcacgcgagtaccctcccttcagggaatccttgcagcgacgtgggctggccttgaccaatgtggggtgcggggtgttctccatgggatggtttggaaagaatgaggcgaggcggttggcgaaggtgcagtgcttcattgttgcaggcggcaccgccaattactatgcgcggccactggaaggcgtgacgctgctggtggatgtcgagaaactggttatcgttgcgtatagagatagggcagcgtactcggtgcccaaagctgaggggaccgactaccgcgccggcaaggctaggccaccgttcaacggagcggtgccggcgcctggcgtcgtggtgcagccggagggcaagggcttccacatagacgatcatattgtcaggtaagcccctccaatttgcatggggttgttacttgttacttgccacctctaaaactggtttacttcgcgtggttctatcgacaattccttgggagtaccaatgacagctgcccttggtcaaacggttgacaatattcagagagcaacttcccaacttaaataaattgcatgtattagcactgaaatatttgaccaaccggtttcagtaaacttttgggctcatgtctttcgacttttcgctatatagaatcttccatcaagattcgtcttcctgtaggcccaacttatagttgtacttagttatatagcacttatacttagcaatagaaaatttatgctcaattacaatggatttatacacagctacagtgaaaaaagattttacaactgttttttctctagatttatgatttttgacatatttatcccccttttttatcattttatttaaaacgggttgtatctattagtggaaaattttgcaagatttaaagctccaaatctatccataaatcaataggtagtacctttgacaaattgaactaattcatgagctacactgcttgagcgtgactgcaggtgggccaactgggagttccacgtgggttttgacatgcgagccggcacagtcatctctatggcttctgtccacgacgctgatgccgacctatggcggcgggttctctaccgcggtttcgcctcggagatcttcgtgccatatatggacccggaggaggagtggtacttccacacattcatggacgccggtgagtacggccttggcgtctcggctgtcccgctgcagcctgaggctgattacccagccaacgccgcctacatggatggttattacgtcgacgcggacggcaagccggtgaagtcggagaacatcatctgtgtgttcgagcggtacgccggcgatattgcatggcgccacaccggggtcgcgggaccaatcgcaccggtgatctaccatcgacccctcaagtgcgtgtgtgtgtgtgtgtgtgtgtgtgtgtgtgtataatactagatgatgtggctttcggtgcagatcacggaggtccggccagacgtgaccttggtggtgaggatggtggtgacggttggaaattatgactacacattggactgggagttcaaaaccgttggctccatcaagaccgtggtatataacaatcttctgtttgcttgccgtgtttaaagcaaattaaaggtaagaactaactcttgactcaattaacacacgtattgcaggtgtcccttagtggtatcttggagatgaaggcgacgaattacacacatgtcgaccagattagagatgacatacatggcacgctgattgccgagaacaccgtcggtgtctaccatgaccacttcattacctaccaccttgaccttgacattgatggtaccaagaactctttcatcaaaaataccatcattccaaaacgcaacacgggcgttcgtgcaaccggcggtgctcccacaccaaggagctactggacggtactctatgaggtggccgaaactgaggctgaaggccaggtgaacattaatggcgcacctgctgatctcctcttcgttaacccaagcaagaagacaaaagttggcaatgaggtcggttaccggctcattccagccggtgcgacggcaacatcattgttggccaacaacgactacccacagcgccgagcaagctacactaagaaacaggtgtgggttacgccatataacaagtcggagaagtaggtgtccgggctgtacgccgagcaaagcacgggagatgacaacttggctgcgtggagcaagaggtatgtcaccttgagcccatggctccacatttgtgtaccttagaataccatatcgctcattatacatcccatggcatgcgtatgttggagcagaaacagaaggataaaggacgaggacatcgtcctctggtacacggttggcctgcaccatgttccgtgccaggaggactttcctgtgatgccgatgattagtggtgcattcgagctccggccattcaacttctttgagagaaacccgctgatcaggaccaggccacccgggaactccccaaactgctcgtgcagctttggaagatccggataaggtgatcgatgctgccgtgcaacttaattatatttgagatgtccttcgtacttactcggataatgtcgaaaatctaactttgtgacgtttttgtatcatttaatttcattttcagtaccagttgaataaattgtgtttaagttgtgagaagtcaggctccatcgtgtggttcactgtcaccttcctaatgcctaagctttgaagctgactgcagtatctctcatatccacatatattctgtcacttgcatacgctttgtcaatcaaatgtcaatgccttcaattattgctgctgccaaggttactgttccaccatcatagatcatgtagggtatacatatgcatataagcatattgcttggtcacctggttaacgtcatggctttgagctagctatatgacccaagcatgttttcatcgataccacgaatggtagcttcattccaactttggcagtttttcaatgtgcccacgcaacgcgcggtggttcctattgaatgaaatatgtaatttgattctattgtgaactgcatatatatcattggtggagaagtgctttttactcccggttcgtaatccccagtagtcccggttggaaccgggactacgaatctgggactaaagatcgctatctttagtcccggttaaagccggttggtaataccaaccgggagtaaagagagaatagcggtggtcccaaatgatcttttttttttattttctcccaaatcaagtgggatgcatatccccaaatcaaagtaacatcccaaatccacatcacaaataaagtaacatcctaaatccacatcacaaatcttaaagttacatatacatcacaaatcctaaaaaattacacacaaatcaaatacatcacaggtcatctcagatccatccaataaatcacaaaattatacatgtgaatcacaaattaaaaaaaaaagaaaacagcgccgttgccgccgcccgccggcacaccgccgggcgcggccccgccggccgccgccgcgcacggccccgccggctgtcggctgccggatgggaaggggaggatgggtaggaaagggaagaggaggaggtggaggagaggggaggggatgaggaagggga

SEQ ID NO: 8910 - DNA, 3128 bp, Oryza sativa
tggaggggaaggggaggatgggcaggagagaggaggaggtggaggagaggggacgaggaaggggggaggtggacgggatggatcgggatgaggaaggatcgatctgatttaaactgtaggaaggggaggaagttcgacctgtggaggagaggataagggatagggattatatactacgcttgaattttagttccggttggtgtttccaaccaggactaaagatcatttaatttttagtcccggttgagaacaaccaaccggaactaaagtggtgacaccaaccgagagtaaatatcctcggccccctgacatcaatctgacaggggatgaaccgagattaaagatgatttttagtcccggttgataacaccaaccgggactaaagatcatagatggctctggggttttcaactgggactaaagatcatttttacttccggtttttttagaaccgggattattgtggttttgggtcgacccagcagagatcatttctccactagtgtatgttagttagactatgaacgaaagctgcagtttagtggtattaatcggtactacaccatgtcaggtgctatcgggctgcaccttgggagttgggatgtgtcaccagggcaagcccatgaagaggggacagatagaaaaggcagtatataaacaacacttagctcggttcccaaaaatacgtaatacgcacgaaaaacggagcggtctatttgcacgtgattaattaagtatttgctaatttttttaaaaaaaatagatcaatatgattttttaaacaactttcgtatagaaactttttaaaaaaacacaccgtttagcagtttgaaaaacgtgcaagtagataacgagagcagagtttgaaaccggctgttaccaatatagccttaggccgagtttagttccaaactttttcttcaaactttcaactttttcatcacatcaaaactttcctacacacacaaactttcaacttttctgtcacatcgttctaatttcaaccaaacttccaattttagcgtgaactaaacacacccttaaaggaaggatgaaagagaaagagcaatgctctggtgctatcagcatctgctgatagtattataaccattaaaaataatccgaattctttgttaataagggtaaattagtaatttactaatacattaatttggggtatgtcatttttatttttgttcccatctcatagttcgttgcatcgctgatatcccataaaaaaaagagagaaagcaaaacgaagcttctgcatgtggatagctagtcctcctgtcgacggtgcttgtggatcgcaattcgcaagtctctcccgccggcggcgtatacactccggcacccctgtcagatgacaagtcccttttagaaaaaaaggattgatagataatactcctttcttattttaatatatgatgtcgttgacttttttactaacgtttgatcattcgtcttatttaattttttttacaaatataaaaatattatgtcatgcttgaagacatttgatgataaatgaagtcaatgtaaaataaatgataagtacataatttttttataagatgaatataaaataaatgataagtacataatttttttataagatgaatagttaaacattgttaaaaattcaacgatgttatacattaaaacacggagggagtaaaaattcaacgatgttatacattaaaacacggagggagtatgagtttgagagctgctttcatttcactgaaccgtcaaatagactgcaagctatttcaatgctgaacaaatccagcatataattaatccagtgtaggggttgggtgtgaaacgtaatccagttccctttcttcattgcaggaggtttacctggtgactccagaagaaaaacggaaatggtaaacccttgccaagtctcccaaattaagcccctgatcttacgtaatggctgtcgctggagctcgtcgacgatagcgtttttgcacattaactaaacatctcagcgatagagtttttgcccctgatcttctatgtatctcagtcgagttggcgagcggcgctttcatgtttgagctgcgagatgagaacccttccgcacctgctagtttagtcactgcaaaataacaattatacccctcctcatatatttttaagaaaatcccctatgtacaattgataattcgtccaatcatttatgtatccctgaattttgcctcatcccttatatacacctgagttttcatttagatctcctctatacccattacgttagttgaccatgagttgaccgttaaatgtttttaagattgactatattacccctctcttatccttatgtgctagtttaatgataaaaacacaattattatatgacaaaaatatctatttgtaaataaacaaagggaatataattatttgacaacaaattttaaaaataaattaaaaaaatttaaattaacttttatggtatacgtatattgttttcatcaaaatttgaacccaacaaataaataattttggttcacaatttatagctaaaactcttatatggattttgtaaaaaaaataaatttgttcaacagtttaagttttcttttcaataaataattatgtcacatttgattttattatgagttacaatttttcacattgtgaattatgaaaaatgggcgatatggtcattttagaaaaatttaacagtcaactcacggtcaactaacagaatagggatagaggagatcaaaatgaaaactcaagaacatgtaggggatgaggcaaattcaggggtatagaagagattgcgaaactttttagggttatgtaggaaattttctctatattttttgaagaaccacaatgccttatcacgtttctactactactaactaaggtggtaatagaaatatatttgaaccatttgatcaaatgagatcaatggttcagatttctttctactattagtagagagcgcaccatactggggccctaacagaaaacaacgacttgccatggtggctcggcgcggcgcggcgcggtgacagcatcctatttcctggcttggaacctgggcgatttcctttcctactctcatggatctttcttccggccccctaccttagcttttagaacct

SEQ ID NO: 8911 - DNA, 1908 bp, Oryza sativa
aacagcagcgctcataggttaaactcctcctgtttgtcctcgtcccacacggggacacctttcttcttccacaacagtttaagatcttcgaccagtggtcttaggtacacatcgatgtcgttaccaggttgcttggggccttgaataataattggcatcattatgtacttcctcttcatgcatagccaggggggaggttgtagatacacatcgtaacgagccaagtgctatggccgctgctcatctctccaaaaggattcatgccatccgtactcaaaccaaaccgtatgtttcgtgcgtcctttccaaattatttaaattttctgtcgatgtttctacactgcgaaccatcgacggggtgtctcagcatcccgtcctgttgacgctcttcggcgtgccatcgcatcattctagcattccccttgttcctgaacaaacgccttagccgtggtattatagggaaataccacatcaccttagcaggaattctcttctttgttagctgcccgtcaacttctcctggatcgtctcgtctaatcttgtatcgtagcgctttgcaaacagcgcatgcttctaggttctcatactcctcaccgcgatataggatacaatcattcggacatgcgtaaatcttctgaacttccagtcctagcgggcagactatcttcttagcctcgtacgttgtctcgggcaatttgtttccctccggaagaatgttcttgacgagtttcaataaatcgccaaatgccttgtcactaaccccattttttgccttccgttgcaagaactccagagtggtatccaactttttgtgcccctgctcgcaacctgggtacaacgaagttttgtggtcctctaacatcttgtccaatttatgggcccccttttcactttcgcagtcctccttggcgtcctgcaacatctgacaaagatcatccgcaacgtcgttaccatcagcatccctttcctcctcgcccgtttgatttccttcaaatccaacgtactgagtaaagtccggaatattgtcgtcttccacttcatcttcttccatttcaaaaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcgaaaaaaaatcatacacaaataattattcttacaataataacactcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcatttagtttgttttctagtattcaagattaactttcattatagttttccttctcaactattttataaaaccttctttagcaaatcaactaaatttctatatattctttcttccccacacaaattttctctctcatcaacttacaactaaattttggagacaaaaaagtgtgtaaaacatagctacaaatgtaatatgacaaaaaaaacattggaggatgaagttgcaaaccttttaggcacctccgatttgtatgtaatcaccaaaataaattcactagaaattttggcatgaccttccctcttttttgagaaattttgaagcttgctcgggcagctggaggaggaagaagacatatatataggggtgggactttaggcccggttggtgttaccaaccgggg

SEQ ID NO: 8912 - DNA, 6539 bp, Oryza sativa
  unsure (1)..(6539): unsure at all n locations
ttcctgcagccctgacaggccctgacagcatttgaaccaggactaaagattggttggtgttaccaaccgggactaaagatcaaatatgcccgttacccttttgaaccgggactatgctgtcagggcctgtcaggccccccgggatcttaccaaccgggactaaagatcaaatatgccggttacccttttgaaccgggactaaagatcatctttagccccggtttttattgcatccgggactattgtggaattcggccgaccgacgaaagatgttttctccaccagtgtacaatggtatatccgtgcgcttgtggataaactctgcaaccataatatactagaagtatttctgcgccattgttgaaaattatattttagtaatgtcgttaagaaataccaacagcggcatgccaatcagctgcatctgcaaacaaagcagggcatttcatttattactaaaagctatctattttattgaattgactttttgtttgactgagctagctgcttgttcgatgaaaaattgtgcaagcatcgaaaactgctattggatacaatgtatattgacaattcctctgtgcaaggattcaaatcattttttcaacagtcccttgttacaatgtgcaggttcattttggccagagtctaaacattggataataaaaagcaacattagaaatggagctaaagttttacacagccatatataaatgcataataaagaaagggatgcagaactcatcgagagactgagaaaaagaagattattttacctagaaagcactagacagggctagatttcaaatgatggaaactacagagaaagcagcaggttcagacagggcgtgttcttaccgcgggatcagagtggcttcctgagcaatgcgcaaaagacgctccgactgatgaactgcaaagtccacagccacatcagagaaatgacaaacattgcctctgcgaaaggggggaaatctgcataaaaggggaggggaaggaagtgcggaggaaccaagcaggaagcggaacgagaaggtggagaagcgcggctcctcccgccgcctcctcttcctacagcccggctccaacggcgccccagccgactgtgacaaagcggggcaaaaaaaaccctaaaggaaggggatggacagtgacagctggtgctcacctagcgagtatggacggcttcgcgttgctcacaatatttacagataaaaaaaagcaatccgatctggctacatatctagaaaattgatcacgatcacgggtacttataattagtcgcctaatcgaagtgacggaggatgccatcgttgccaatgcggcgcttgatctcctcgtgaccctccggcctgaggacggagaagtcgtcgtcgcacctatggtggcggatggcagcctcaacctccgcctcctcctccagcgtcatcggcgggagattgaacctcgcgtagctctcggcgcttgtcgccgccacccacgcggcgaactccatctcctcacgcagctcctcctcatccctcttctcccgctcgttgatctcctggagcaaacagaaagctctggctaccgccggaagccagtccgccggctcagccttctccgcctccgcctccaactccttccacttcacattccggctacccgccatggattttaagcttacggttggctcgatctctttcgttcttgctttgtcattttaaatagattggacccggtgtgcaaaagtcgatttacaacgtgcattcatgttcctgtgcagacacatttctttccgttggatgtgctttgggattcgagcacagcaagccttctgtgtgctgcattaatgttcgaaaatgctaatgtaacatactcaaattttagaccttaaaaatttcatgtcaaaatagttggaagctaacttttctatttttgagaggcaaatatttccatttttaacctaggtgtggtcaatctaacttgaacctaactaaaatttgagaacaaattaaaacctttgcatctctaacctaggacaaaaatataaacctatgtgtaagcatgcatactctcataggacatgtttagacttgagtccttcatatgcatttggattttttatttgcatttcataataggtcttatgaatataattacaatctagacaaacaactaaaccattagggcttagtgctaactaatggaaagtaatacataggaaccataatacaacttaaaatatatcaacaaggccaatgtcaaaccccacaaaactaatttggtcatccatctgaagacaagtcatgaacatggaagtgaacaaataaattaactcatataaggtatattctatcttaatcatctctataagcatcctcttaatctaatactaaagtaaacttatacataaataggtaagaagctaatgacctgtgtaaggtaaactgtaactcaaacatatcaatatcacctcaggttaagaagagtccaaatataacttttataaccatttacatgcatttattttatgaggaggaaaacacatatataaagataagtcttgtcaattatctaaaataatttgtgcaagataaaatcatgggaaaattcaggtaggctctacttaacttatataactgactataattttggtataatttaataactaaatttgatacctaaagtaaatcagtcaaaccagtcaaatagtaggttaattataattcttaattagctaaaacctaccctcaccaaatgtgcattaaactgcatggaagtgtatagaagtgtataggggaaataatttattcaaatactaggtttccagaatttatcttctctgtttaggtctcctaaaaatccaaactagtttccaatgagcccatcttcttctaatttctgtgagcaatctatccataattttcaagtgtaatcaaagaaagtggaaattaggcataatcatctgcctccagtaaaatcaacactagttaatctcgtccacacattaagttatgaagctacaaagttaggaaaaaataattccggaaattcatccaaaaaccaatctcacccacgtttgtacccacacctctctcttccacctagtttgccacgacctgggcccacctggcagcctccctggcttgcccacgccctgtccatctcctcctccaccgctctacccgaccaacagaccagagagacaggagagagagaccgagagctgggcgcgtcgacgcgtgggagcgacgtgtccacgccctcaaaacgccaaaccttgctctctatctttcccagtcacatcgccacacctcactcaccattcctatgccaagagaaccgagggagagagctctagctgctctcctcgccttcgatctcaccgccggccgtgatgaagacgaatcttcgccaatcctatctcttccacgttccatactctcctcaccatgccgaatatttctccttttgatttcatcctctctcgtgcagccaatcgacgggaacgctgccgtgcccaccggagctctggagcgcgctctgcgcaccgccgcagcgacattgtcgccgttccggccattgtagaccgtcgtaggctgagccacagcaccaccaacaccttctccacatcctctccaaaaaccccccaagaattcccaagaatcgtgcactgaggagggagattgactccctcttccccaattccagccgtcaagctccaccttcgatttctccctctccggtgagtcacagttcaatttctcgggcatgaagctttcctgagacctattcaacaccgtgtgtgtagctaaacatctagatcaatgctctagctccacatgcaccgtcaccggagaaccaccgcgccgctcgcgccgccgtcgccattaattccggtgaccaatgcttgcaagaataccacctatagcctcgccttgaacccctttacattttctccttaggttgcacgccgagatctgccgccgtttgccgccggcgagctcgagaacgagctcggccatggctagctctgtgtcagctcaaaccaaggacctcacttgagaagaatcaaaactctaggtactagtttgtaaaacctatctcacacacaaaaaacctacctgatcagatccactacaaaagaaattgatggtaagactacactataaaatatcatctcaaagattatatatcatgtgtatatgaatttggtggtaatatataatactaacagataaaagaattgcatagaggtatagaaaagaggaaattgagggccatagacatccttattattcctatattgtgatagtaagttttcagacttccctatctaataatgtcgcatcccaatgtttgcctatatgaaaatatatactccctccgtttcacaatgtaagtcattttagcattttccacatttatattgatgttaatgaatctagacatatatttctatcttagattcattaacatcaatatgaatgtggaaaatcaatatgaatatggaaaatcaatatgaatgtggaaaatgctagaatgacttacattgtgaaacggaggaagtacatgtatattaagaaaaaaaagttcggctgcagcagaatatgcatgacagactgacagcactaaagaccatatgagaacatatactactaaggttgtgtttagttcagcgcaaagtttggattttggttgaaattgaagatgatgtgactgaaaagttatgtgtgtatgacaggttgatgtgatggaaaaggactgaagtttggatctaaactttggatctaaacacaacctaagtaaccctcaattaaataaccatgaacaactgaaatgtgtgggaatcggcggctacagtaagttgacctgggaagaagatcagcggcggcggctgatggagaagcacccagcagccagcagctaatcaccgttctattcaaaccttcgatccaacattcatcgaatcattagacacagataaaaccctgcaaacaagttgaaaattttagacattgtgcatcaatctagccgtggaaaaacactaatctgttgatttgccacttgtgcgtaaatagcctgctactctccctcagatgcgttcattacatgcggggcaaaagaagatgatgtgaatcgtatacctcgtcgatgggttgtcggcatatcagctggcgcggacgtggacggaggcagaatgagacagtgatgaagtttgggcgacgcggaggagacactcgaggccggcgacgtcgcgtcgatctggaggcggggattgacgtcggcacggtggtggagcgtcggcgctcgatcagtgcgaagccacgcggcgacgcgatggcgtcggcggcgtcacgagtcgtggtcagagtgaggggttgttggcggcgtgatttgcgggcctgagttggtgaattatagagtagatttgtcaattaatttttttaaagaaaaactactgtgtgctgtaacagtggagagagagagaaacagtggagagggagggagagaggtgtgtgaggacatggcagccagcaaccagccggccggtcatagcgacacgcgacatgggagtggcgaggctcaccggaggggctggaacggcaaggaacagcaacggcgacgaggaagaagatgatgccggctcgggttgacgtcggggatggagctccgaggcttgccgagctcgatgaaggcgtggctgagggagaggaggagacgacgaagccggcggtggcttcgccgggacttggcgacgccaagcggcggctggagcgcacgccgaaacgacacgacggcgatggagcgagcgtggtgctcgagcggcactgggaatgggagaaggaggtctcgggggtttcctttatataggctagaggggaggaggtcgaccatgaggatgggaaacggcgctggcgacagtgaaggtccctattggacacaccggtttaagaaaccgattaagtgcgatttaatgtggtattgagtgcgatttgttgacggaattgatgcctactacacaagaaatcaatttttgcaattactttcaaggaaaatcaaccgaggagggagatcaaaggtagcggcggcacttgagttcacgggagagatgaacaggtgacgggcagaggtggaggacgctcgtgacgagtggggcccacctgccagcgcacgggcgcgcgcctggcagcggtggctcggagtgggccgggcagggtggcgacaaggctgagggaggggaaagaatgaataagttcaccggccgtcccttaagattttttgaggccccttaaccacaaaaccagaaatgtgcacccctaaactatgtaaaaccgtgcataaaaggtcccaagacagtatagatgcctggtttcgctgacgtggcatcctagtcagcaaaaataattaaaattaatatgcggggccccacatgtaagtgagagaaaatggtgtgggtcccacattcctctntttttttttctttttctcctctcttctctctgggttctctcaagccggcaccgcggcaatgggggagagaggtggcccgcggtgga

SEQ ID NO: 8913 - DNA, 1581 bp, Oryza sativa
cgcgcggcatggcggtaggggcggcagcgagcgcagcgggcacagcggcgggcgcgtatgagcgccagatgcagccggcggcagatgtcccacccctctttcttgcccacacacgactgtcgtggtggccggcggtggctgcgaggaggtccgcgccggcagagaggaaggagattgggatgccggcgaggaggttggcgagcgctcggagagagaggtgtcgaggaggttggcgagtgctcggagagggaggaggtggaagtcgcaccgctcctctaccccatcgccgcgccgcacgccactgctcctctctcctgcccgacccgacctaggtcgtacatggagtcacaatgcttgttatagcaacgtggaatagaatatatccttcgtaacaaagcctcagcgatttccattgatgttgtggagctcattcggagtttccttgaatttcacctcacatagagtgcaaatgtgcaatgttgttgctcatctatgtgcaaagcagaggctactagcctactaataataataaatggcgtatctagcttaatttgtggtcttggattttcgtgtattatgcttagaaaggactgtactccaactactcattaataaaacataactcctgatttcgcaaagacaaaaacaaacaattctaatattaacaaaactggccaggcatatatttagacaaacaagctacctattttacttcttccggtcacgtacacatttgacgttgggagtattatatatatatactcccaatgtcaaatacacttgactggagggggtactatatggtaacaagtaatatacacgcatgctactatgtgtattaaattgtatgttaccatatatgtacaaaccaaaccaaagggaggtgggggtgactgggctctgccaagctggactagggtggaggtagagcgttctcgaggtccgcctgtgtgggagcacggcgagcttcctcttcttcctgtgctgctgacatggatgcccgcctggccctccatctgatgatctggaggaggatggcgttggcgcagatggccacgccaaagcccgcgaaggtggacaggatgatggcaatcaccgcttgcaatcgcacctgcaatgtatatatgcggcgcaaaaagattaagaaaaagataatattagattatatgtaacctatatatcatttcgctgaaaagcacaatagtaaatcggactttaaatagggtagttatagttgcatcgcggttgaattggtaattgattttagtatggtacatctataaatttaccttacatgctatgtttacagagataagtaagaacaatactcaatgtaatctatttgttcaaaaagctataattattcaattggacttcatgctagaaatgcgttatttttcctaattctaatggttccaaattttcaaaatgtcggtaatatcgtcccccccccccccccttccctgcagcagcaagcacctatcttgatgaaattttcagttttttttgtgaatttggacacaaattattcaaattcaatcaaaattcattaaagttttaaataatttcgtgcaaaaagta

SEQ ID NO: 8914 - DNA, 27117 bp, Oryza sativa
  unsure (1)..(27117): unsure at all n locations
cctcatagaccagctgctggcggtcgtggacgccgcgcaccgtgacggggaggttgagcacttcgtggttgcagacctcgcacggcgcgttgcccttgatgctgaaccacttgacggcgcagtcgccgtgcgccagcgcgagctcccccttgcaccggcactccagcttcagcgtgccgccgccgccgccgctggcgccgtcctccgacagcgccaccatgcatatccggaaaccagcgcctcctcctccgcctccacgctgccggcgtcgtcctcctcttctccggcggcggcggcggcgtccgcattgccgtcgggaggagaggcgcctatcaccgacaccctgaaccgcacgctgccaccgtcgtgaatacgaagggagctcgagtccgcactctcttggagcctcctccccccttggagctgaatctcgacagggtgctcattggcacggactgtgagcggctgatgttcatgtggtcactcgcgtgcttcgccttgtcttcgtcttcgtcttcgtcgccgtcgtctcatcgttcttggcaaatcgagcgaacaataagcaggctgcaggctggatagatagctagatacaattagttaggcgaaattactgtacttactgcagaaatgtgatcactgcttgctgcatctgaaggtagcggatgatcaaaatccagcgacgacgaacaacgcgcagcatttgcaattctgaagctgaagagcttggagaaggacagcgaccgagcgccagccaccggcgccgccgccacctcgccatcgtccccagcgccggtagcctcatgctccgtgctggcaacagcctgctactcattcccgacgacagtttcctcggatcacctgccgactctctgaaagcagcagcagcagaagcaagctcttggtgatcatttccatatcttgccgaggaggaggatatcgaaagcatcgccaaggcaccatttctatctccttccattcgcatgctgatgctacttccacacctacttctgtttgtgtttacctgagcatgccattcatgtgcatatacgaaattagttcagttaagaatttcatctccatgatcaaactaaaagaacattgtcaatagcaaagcaatgattgaattgcaattgcaaaacagatagaaactcactcacctcctttgcttgttgagccatagcaagcactcgatcaacgatcagtcagaggccatatgcaggcaggagtgtatgggcagagcgtatttttatcttttgggcacaaactcacaatcaatgtgtcatgcattcgcaattaatcaggaaagcgacgtagcaagcgactgattgatggtcgaataaatggaccgaagggtaattaagggccgggggtgacgtgaggtgtgaacgagagaaagaagatcgagaagaagaagaagtactcccatccagcagcagcgactgcaggtagctgcctgcctagctagcttagttaggttgggtggtgtgaaagggaaattagctaccttgatggagactggtataattttgcaagcaccacacgggccagagctactggtagctagtttagatgtctttggcttgagctaattacatccttaatggttccatgcacgacacctcacccgacaaacaacgatctctgggtgacagttcttgaatttatatggtttgctgctctgtacagacatttacatataagcttgctcgccttagcaacgtttagataattaatttcattacttaatgtaaagcatttccattaccttaaagtgcattgcttaatgaaatatctcaagagaacatatccgtaggctagcttatttcagaacttaaaaaattaagcagtattccgttatcactcttcaaggaaaaaattgaatgtaggatcgaatagctagaactaagccaactagaggagattgaatagttgtagtatccaaaaaccgaaattcgatgacgatcgtccgatcggattagatgcaccggtctgatcgctggatgatctcaggtctgaccagtatagtagctccggtttaaccgcccaatgccccaaagtcgtctatcaccgccgtatccccgccggtctaaccatgacgatgccgtcggaaggccctttaccatcctacagtaaacgggagcataaaggcaagcaataaacaggaattgtacggatgcaacgattatggaaccaaaattacgaagatatatataatagtaccaaaacccaactaaacaatacaaatctggagtactaccaaaacctgcatctacacatatatgcgctctctctgattagttaagtcgaagctaggaatgactagttattaactgttttctgttttaatcatgctaaagtagctaattaatcattaagcggttcaaaaaatccaacaatattaattaatatatgttgctgttttcccaagtctgtgtgcgctggaattaagcttgcttgcttcatttcctggccggcaagtacaaacgaggctagtactgctcatgtgttgctgttgcttcccgtgtacccatttgacttgctaatcccactcatcagtcattgcggatacttgggatagcttcgatttgatgtatgctttaaggaaattaaacaaaaaacaatcaatggaaaggaaaaggaccccttgatggaacaaaggttgactaagtctcaacatggaaactacgttatttctacgcaccatgttttggtacgaccttagtaaaagacgaactgcattcacgtgactataagccaactttaaataggcttcgacactcttttctgtgtctgttctgtacaattctttttttcgttgagggcatgtttggaagactcgttttaggtccaaaacaataacaaaatatcaggtccaatattagtgtaaaatatcacccccataatttcttttacaaaatttgctataggatataaaaaagacgtgtaattcgctggagaacaccataagacactgtaaaaaaattggtaattagctgctagaaattcacggtattattttattatttccggaggaatatgagagagaaacagatgcgagagtacgattatgctcctgcctttgtttggcctacaactaattgggtctggttcgaaccaagacccggtcctctctcacgcctccgaatctccaactcctttcctcaaaccctagaaattaagccagcgaagtagtagtggcgacatggtccacgaccgacggcaagcttcaacaagggtggtgacggattgaagttgtgcagtgattgcatctttggagctgtgagcccggtgtggcatcgctgatggctagaatgttggccactggggtgatgtctgtgggcacccgaaaattataccgtccaatgcaatttgtgattaccacataattttggatgagtgagatccatacatacataaatagccagccatacctcaatgtgcccataatcacaaactgacaccattcgatataaaatccacaaagccgaataataagcaaatgagatattgtttagacttagcatgccagtcaactttagcctgacatgcctatcaaaccataggaaggtggcgaccaaatgtgttacacatctcaggaaactttggctcaaattgctaaaactctacaacatctcaatttctcaaaagtcatactcatgctcagctagtccctaggaaaagtgactagcctcgcactttcatcgcaagcaattgatgaacatcacgaatgcatagatttggataaaaggacaacaaggtacatattttataatggggttcacaaccccattatacaacacaaaatatagtagcggaagttttgcaaattcacaagcaaaagtaaaatccgtggtgtaccaacaaccccacaaggacaaaacaaagctgcaactacacactactgtcattaccctcggcgggatagtagtagtgcacgtcatcaacaccggcatcatcacctgaaaatagcaacatgagtacgaaaggtactccgcaagacatacaccatatatggtagttgtcgatggagcgatcctccaatagcagggaagtgcatactcctcccctattgaagatttggccagggagtttactacagatgatgtgtatgtgggctgtgaagtgttttctagtctcggacgaaggacactcaacgattatacaggttcaggccaccccgggggtgtaacaccttagtcctgtgttttttttcattcgggattgaattggaatacaagcatcttcgtatctctcttttctctcctttctaagtggcatgtcctcttccttttatcaaccaaggagagtgacacagtgtctttctcatcctttacctcatgcttgcatggttgcctcctttttcaacaagtcaaggaccgaataacaactgtcttgtgctcccttctccacccgtcatatagccaactcggtgtgctcacgctaacctggattggtgacacgccccctccattaggtgaagcggcgtatccgagtgtcgttgcgcatgcacaccatgtggcgaggcctgtggccaggggatgaatcatcactgtaggcctcctcgaaccttaccacctagacacgccttcataaatccagcccaaattaaaaatcacttcctaaatggaataatagaaattattaaaagcttaaaacaaatctcatcaaatgctaaaatacatcaaataaaaattcaattttggcttggagtattttttttgaattctccatactttaatttggtccctcaatttttacttgaattttcatagaaacctaaataattttaaatcaacaacaaccaatttaagagtttcttaaaatgagaaaactaaagataatcctctccctctcgttgggccaaatccggcccaaagcgctctccacctctttaggcccgctgccggagtccctttctcctccctcccactctcctcatccctctctagcctctctctctccctcttgggctgcagccatctcggcccaattcatcatcctatccctcggactgaagtccgtttacctcctcccgctggccacctcctttctcttgggccgtatagccccgaggcccatctcagatccccgcgggtcgtgtcccttagccaagccgtcgcccgttcttctgccggtcaaaccctaccgccaccgacacgccgatctacctacccggacgtttaccatccgaataaaatgccaaaattggttcctctcctcctcttcatgaattcccccatgtttttccctcttgattcagcctttaatcgtcaaatttaatctccggtgaaccaccgccattgatggccgacgccccaccggcgtcgttctcctatcccggcaccgttccactccccaatctgctataaaaggaaccctggaccctcctcatcctccgtgcttcctcgggacaaggtctctcgcccccacgctgcccctccccccccccatgcctcctcctctctcctctgggccggcgaactccggccaaccctccccgtcgacgggagcagcaccgaaccacacgccaccaccttcctcggcatcgaagagacctccttatccccggcctcatctgcgtttcacccaaagggcgccggaagtgcatcctcattggcaaccaatggcgccgccgccgtcgtcctcctccagccggccctgaccgtcaaatcaagtgtctctggagctcgccgctacctccaccggcttcgcagccgcctcctcttccccagcctcaccttcgtttctcctggagaccgctggaaactcgtcctcgccggtgaacagtgaatacgtcatcgtcttcttcctccagtggcccctccctcctcagtggagcaccgcctcactgcgccgtcacggctatcggctgcacctcatcatcctcaactacgcctagggttggcaacgagacggatggcgggggagggggcggcgttggacaagaacggtcccgcccccactctcttgcgtgttcacccggccccggcccggattggagaatgggacgaaattagtcaccatccccggcccctccggggccccgccatccgaccaggttcccgcacacccggtgctagcgacagtcgaaaggagagtagaacaaagtgggaacctgtagccagaaggagagcaagtgaaagacgcgaggagccaacggccggcaggatgggggaaacagcatggagcatcgcatcagagaacctatagctgagagtggtggcaaggggcagagtagtcggtgctagctgcgggcggccgcctcctgggtgagcgtcgcaacatgcgtccgtagcagcaacgccaaatgatttttcttctctctgcttttttctttacgcgagcctcacacgattgcgttgtgcccccgccgccagaaatgtttcgtcgtattgtggggatggcaccgcaccatatgggttagggtttgcttcttttgtatttatatctcctctaaactgggctacacaagctcattggtggtcttccaatagcaaactatatctgggctatccttgatgggctattaatatgtaatagcatatattttgtacaatacttcggggcccctacgggtgacccgtgggtgatgcagccaacccggctcagccccggaaaaagtcgggggcccgccctctctcacccgtcggtgagaattctctaccatccccggccccgtaggagcgggtccccgcaggggagccagccccgtgggggaaattaccacccctagctgcgcctcctcgttatccgaagattctcggaacacctccccatcgtagttgactacttccaatcgtcattctcgccaagacgaagtgtcgcccatcgtttcgtctccgttaccctcctccattcgtcgccgctgcaccaaggtcgtcgtcgcgtcatgcccatggtgagaacccctccttcactgtcctatcctcattttatcggcgtcgctgccgtgccgcggtgcgccgatgacctctggtcccgtccgccgatgcaagttgttgttttcctcccgcgtacagccacatatttgcgcgtgtggttgcttacgtggcttcacacacaaattaatggtataataataattaaacaacttggaaatatccatttaatacacttaaaattcggatgatcgtttctcggccaaacgagctcctaattgatatgttgaaattgtttaatttttgttataacttaaagaaactgtggttgttgtttttatgtattgttaccgtatctttgatagagttgtatcccagttttgttgctcgtgcagttgtttcggaagttcctgaagtgcatatcaaattgtcggaagacctttgtttgagcaaggcaagtcataccatattgcttggacattaaatcccattattgcaaaaactatgttgattcaattctatatgcatcacttttataaattatatgactcttaatgttctttatttaatagttaatattcatatgatcattgttatatagccatgttgttgaatttctaaccatgctcttgtcaacctaagtaaaatgataaaataacaagtatggctccgtatatgatggacttactagttgctttaggttgagcttatctatacttagatccatcgaagaatcccttttacaaattagaatgagagtaacaactaaaatatgtaggaatgacgattaggtggctgcttgagctaggacatgatggaatctgagtcaaaactctctaaacctgtttttgtgaggcacgaggtgtatggttttgttataagcacctcgggcctgtgatgcgaagcataacagtgcaatcacaagtctaatgggtaaggcttgcctagaagtctagatcatctcaaaacaaaggacatcgatatgataggtctggggctaggggatgctgactttgacctggcgcacaagggggcatgtctcgtcccgggggattcggcaacctttacgttgtcgaggaccagcggacggcgagacctttgcgggtccttctgttttgggttgagctaggtgggtagtcttgtcacgatcttgacttttcgggtatctttcgggtattgcgatgcatagctaacatgaagttaagtgttgtgccttgtgggtaaagatgtacacctctgatcagagtaaaactattcgaatagcaacgccctcggttatgggcaagcctagcaatgtacccaagttagtttttatcttcgaagtaatggatggaattcatgtcactttggacaggtggttaacctgggtttatggccggtatgcataggttcacaaccatgataatattgcttagaaatagaaccgagtttaaactatgctttaaaaacattaaaatattgcaactttgcctttacacaaaaagaacctattatgccacctctttgttcacctttcattataattcattttccggcatggcttgctgagtacgatggttgtactcattcttgctcaatctttccctctccgatcagagaagcttttcgaagaacaggtgttaggtgtagtcctggctttacttctagttgagtgccttaaagatggactagtaggctcactagtccgctgatgtttttcatttgttgtcaagcctaatatgtctttgtaataacgtaaatattatcttgataattaataaagatgtgtcttttgtaccaagtttattctggtgtaccctggcttttcctaggacgaggaattataccctagcgttcgggaaagttattttccaggcgtgataagctggtataagagccatcacaactgtgggataagtcaaacagacaaaccgtaaggacttattttgtaagaaaagactatttgcaaaaatccctttttgtttcttcccctatgctttttgcaaagtgtttatctctcccacccttgctacacataatagctgaacaaggtggtagaaaaacttagtaacatttacaataccaaattagtttcattaaatttaacactagatatattttgtattgaaaatgttagtaaattttactacaaacttggtcaaacttaaaaaaatttaactaaagaaaagtcaaactacttataatatgagtaccattttgacatttcatcttccttaaggtacgttaggcgatgaacagtcataattaattctgaacacagagaagctttcgaaggaagaagatggaactgaatggtgacccacatgcagattgggaatttcggtccatacaaaaaatacaacaaaaaaatattcaaaatatgtatgatgggtacaaaatggcatttctagttttagaaatattgcaaaagcatgtgtacaaataggtaaatatgtgaatagtaatgtattttttttcaacataacaaatgcgcaatggcatgatcaaatttacccaagaacaaagaggtaaaagaaatatatattttatcgactggttcgtagttatccttcatatttattgggtgtgaagaaattactccttacacaagttgaattcatgaaaaaatccataaataataaaaaaactctccttttaaactaccaaaaacaggattattcggataagaaaaatggaacattcgttttctcgagatgtgtcattttcttagtcaacacgtccaaacacctgatttgctgaaaatatatggattgtcatgcattgctagtagtgctttgagttatgcttatattatgacataaattttgaacgctagatatgtttctattttggaccggagagggtataaaattctttttagtgacttgttaaatagaatactagcgtctactggctgggttcctatacctgctatcagcccgtgtttttaacccaacaaaatttaacaagtcataggaaatatagttgatttagaacgctagtacaaaaccgacccatccgaaggtaacatggactaaaaaccactatctctatgactggatcaccgttaaaatcggcctgacaaaatccctatcttatcttaaaaaaattaccgcaagttttcaagtgaaaaactttcagacataactataatataattggaatataattacattataactacactgtaactgcattgtaattacattgtaactataatataatttatataaaacttgtatttgacttatgatttgtttgactaacactgggatcttacgcgtgatatgtgtaaaaatttctttttcgtaattttttccctctcatgtataaatcttgagatgattcgatggtaacaattctgaaagttttgaagagagaacttgaagtagttttctaaaaatttcgttggagaaaagctcaagcgcactgcactagtccatttaattgaaccaagtgattttgcgcttgctggtttgatacgttgctagcaccgagatctgatctttgcttttcctttttttttttttggaagaggtagatctgatggtggcaattttactctagtttattaaaatcaaatatccatgaaatagtcgcaatgattgaattgtaaacaatattactacctacgttttataataattaatggttaaagtttaaatggtaaattcaaaattgcccactattaagaagcggagagagcatatgaagttcaatagttggagactcgaaaaatggcaattcatcactaaacagcgatggcagtttgtaggcaccggttggcagtggccaagagctcttgatggtgaacgcagaagcggagaaatttcagcgaaactgcatcgctatcactatcacaagttacattcagcttgggcatcgcgtcatcgtctggacctcggcgaaagatggaacgagtcacggatccttcgatacagaagttgatgccaagtcagagtaaattgttgtacgtgcctttcacgatttcatacctcagctagcttgtcctaagtcgaaagagtaaacggtgaacctaccaagagaatctcacctacaaattacaattacaacttgcgcaaattaaaattgccgcagcttgcgacctgaccagaggcagcccttaaaaaatttgttgtttgaccactcaaatgtacaaagaatggacttgaaatctagaatgccgagtgcagataatctactagtattaatttcagcaaaggcgattttttttcttactgaaggcttaaatggaaaccgctccaaattgagttggaacagtatttaagaacagcaaacatccttgcagtttcaaactttggagtacagttaaagaacagcaccagcaaaaacagcactaaatcaacattttatttcgtctctcagacagtaccatgctgatgatgcgcacgaccaacacacaacacatgcttacatattcacaaaatgtatgtaggtaatgcacttgaaggtttgagatgctacaaacaaatgaaatcatttagtccattgaagagtggcttgtcaacatacttacaccaaactgactggatacagctgaacaactagatcagttattctgggtttctaagcgaacttcttgtcgaggtgacggtctatgatttcagatacggtttctaagaagattacttcacttgaccctgggagaacatggccctcggcttcctggacgatgtcctcaatctcagagtctctattcacagtttccctgcacagtatacgcccgatgtcatacggtgtgaggcctcgtgctgcacctttctttaaaagcatggtgctgatgcacaggacacgagcacatcttgcagacagctcccacccatggaacttgagaagcttgatgtcctcttcagcgtctagtgatttgatgtatgcaatggtttcatcactgaatggttcacgagcctggggccagtacagccactcaaaggtacaatcttcaaactgcgtcacaatggaaaaaaaattatcgttagtctaccagaataagtactatctcatgcaagaagaaaagtgagtgctagagagtaacgtgtaccttctctggcaagcagtaaccatgatcaattggaaccaacttgtaattgccaccttcttcatccttgcacactaaaatgttccctgcatgacgatcagcgtttgctaacctaagatctaacactgctattttgtggacctccttcactggaaatgctcggggacccatatcctcacaacttccattgttctgaatgaacatctgcagtgatccaatcttgaagctcttccccctgtgtaagctccggaccaatgctgtgggaggcacaccagagaacccgatacgttcttcagattcatgatcaccaattggatggtcaagaatataagcagcaacttccctaaatgcaccttcccctacaagtgtccccctcttcatgccttctccatcagtcgacactggaagccctcttgggttgtttttagccataggttcctcatctctgggcttaaacactgcaatattcttctctcctgatgcatcttgcatgaagtaaacaccccctgaaccttcagctgacatcactggcaagtatccattctcaagaccagctatggctgagctaatcattctcatcacttcaagtgatagcttcaccttgtggttaacgataattggttcaacaagagcaggcctagcaccagctggtttagcagggttcacagcatgagcttcattttgaaggttctctttctcctgcggagtgacaactgtaaccaccgtgtctttatcaacttgctgtgtccgtaactttgctggcttgcggatgaacaaatggatcacagcatcatccttcttgctaatatcagcaatcagctggtggtcctcaagctccttgccatcacattcaagcttgtgatcctcaccaaggtcctcatctccctccactgccagcttactcttgagatacttgacattgcggctctggtccacctggaactgaaacttctttccactggtagtctcgatgttaatcaagcgaagatcagccaagcggataacaaggtgcagaacatttccatcggcaagcccataatccttcacatggcagttgttccttgccagctcgtgcccatcaagcacaagcctctgcttgttaaccacgaaccccttgaaccgctgaatgcgcagcttgaccgaggcgatggactccgagccgagcacactcatcggcatcggtggggcaccaggcacagcaagaaagatgataatcgaatcctgcagctgtgacccggacaaacagtggggcgaccggctgccgtcgaagcagatgggcaggagagcaaactcttccaccatcgggctaatggcaatggcagcagacgacatcttcacaggaggtccttaggatgccgaagcttcctcaactactgctactatttacactaacctaaaaatcagatccttcacactacgaattagaagccatggagaagaaagggcaagggttcctttccttccttagaggatggaggaaaccctctgcgatcgcgagataaccagcgtggttacaatcccatcttgatctccaggcacatcaaacctgcacaaaattcagagagccattcgttattaaccaccgaaacattcaaccgaaggggagaaattccagagcatgaagagaaacgtaccagacatggttagatgagggggagaagtgacgaaatatctcgcctttgcccaccagtgattgaatcccccacacggaatctacaaaggagaaatcattccggatcgatcagcctcagaccatcaaatccacccgatccccagggtaaattcagctcaaattaacacaaaaaaccagagaaattgctcaccagaagagggattaatcaggaagggcccgaaccccctccgatccggacgccaaccgagccacaacctcaccgattcacctcactccaatcaaaccctgcaagcacaccaccacaccaccacacagatcagaaaaactccccaccaatccaaatcccaagccaaccgccccaaaaaaaaaaagaaaaataatctcacaagaattcacaggacaaatcagcgggggattcaccgcaagaaccgaccagaggagaggaggggggataccccggagaggggggcggggctaaatccggcgcggcgccttgttcttccttgctccgaagttcacgcgagatggggaagcttcggtttggttttggtttggggagaaagaaattcagagagagagggaggggaaatggtgatggttgtgggggcagctgatttattcggcggaggcgggcggccgtcaccgtcagtttccagggctgacggcgtgagcgtgacgtgacgtgctgtggggagagagagagagagaggacgcgccttcgcggaagtggggccgatggaatcggaaggggaaaaaaaatctccattgtcggggctcgagggtatacagcggttttaggatttttttttttttgtcggtatgcttagcacacggagcaagaggaaagaaggatggttctagagacaccatagataagaaatccaggttgggatattttgatctttaataatgatgagtacgagattattattacacgtcgaacattgtattaatccatatacacttagaaaaaacaaacctaaacaaataagatgagtgaaaacaaacttgcacacaccagatgccaaaagtcccccagaaaaaggaaaaatgtatgctgatgattatcgaaaaaaaatacttgatttagtcatatagtttggcctacagttaattagaaacgaataaaatattatatatgtattcttagtgtcttaaaattacatatacaaatgaactataacaaaaatatcaaaatattttgttttcttatcaagggcaagatgcccccatttctttttattagaaatgagatgactaaaaaaatataaaaatatgtataagtgaattttaaattttagctgtcgctgaaaatctaagactgtgtttagttcacgtgccaaaattttttcagtatacggatacatatttaaagtattaagcgtagactaataaaggcatccacaatgtggaaatatagagggtcttaagcccttgagtagtccatatacattgtgagagtgagcattataaaggtttcttggatgagctaccattagctataatatgcatggccataaggaataaaaaaacattcttctctctataggtgggggagagaaattggaaaggtgtagtagttggttatagatgataaaaggtgggacccaccttaatacctcctcttgctatatacactgtgtgagagatgctatatagcaatagagcccacattggacctatcttaaagacccacttgagcattatacattactgatgtcttaacaaaacaaactacagattccgcctgtaaactgcgacacaaatttattaagcctaattaatttgttattagcaaatgtttactgtagcatcatattgtcaaattatggtataattaggcttaaaaaattcgtctcgcaatttacatgcaaactgtgtaattggttttttttcatatttaatgctttatgtatgtgtttaaatattttatttaatatgatggaacttttagaagtttgaagggtacggtaaacactgcctaaaatacaaaggaaatgtataaagccggcctgggccctcctccacccaacgtgcctgcctgccatcaatctcctccatcgacaaaacaaaacaaaagaaaagaaacacgatcacctcactgccttgtgggggcacacacactatgttcagaacggtcggcgagaggagcgggcggaagaagagtcagagcaaggatggtcggtcaggtcagtttctctgactcagccagccccatccgtgccgtggccgtggccgtggccgtggggaagacgaaagaaaaaaaaaaagagtaaagtccatcaccgatccctaaacttttaccgctgtatcatcccggtccctaaactcgtaaatcgaccgttcaggttctcaaacttatttgattgtgtcatcccggtccttaaacttgcagataactcgtttaggttctccaacttgttcagttgtgtcgccccggtccctaaacttggatttgaatatcatttgggccaaataggacagtctaaagactttatatttaaaaataatttataactttttcatgtgaactctaatgaagacaaactttatatcaaacttgtagccctcgacgcgatctacaactatgtagttgattttttttattttaattcattttttgtcccaaaatgtaattttaaaattaaaatttcaaaatctataaacatgcaaccatattttgggaccctaaacagttttaattcaaaaacttttcaactacaaagttgtaggtcgcgtcgagtgctacaattttgatataaagtttgtcttcattagattttgcatgaaaaagttataaattattttttgatataaagttttttgaccgtcctgtttagggaccggggtgacacaactgaacaagttggaggatctaaacgagtgatttacaagtttagagaccggaatgacacagtgaaacaagtttgagaacctgaacggtcgacttacgagtttagggaccgggatgacacaaaggtacaagtttagggaccagtgatgactttactcaaaaaaaaaaaaaagcaagccacaggaggggagctggaaaaggccgggggagcggactaggggctgtttggttgaagccctgagccaaaagagcctggcgtgatgtgtccctgagggatatcctgtgttgtttggttggtggcctggtttcattccctgcctgatctgaaaaacctgataggttcattagcctggctcaggccaccaaaaacgagcgcctggctcaggctagttacacaaaacgcgctaatcaaccttgtcctgtcacgggcccacggctgtgcatgcaaaaagtgttggaatattttattgttgaatcttggttggtgtaaacgaactgaaaatacaacatttgcttatatgcgatagattaggatatgagatagtaccgttttatttactttctccgtttcacaatataagtcattctagcatttttcatattcatattgatattaatgaatctagataaatatatatgtctagattcattaacaacaatatggatgtggaaaatgctagaatgacttatattgtgaaatagagggagtaaataatatctaccttaaccatgtaattatgagccatctaatctcaatttagtttcctcaggctcaggctaccaaccaaacaatatttgctcaggctagcatcatcaggcaagttttgataggatagccaatgcctctcaggcatgcagttttctcaggcacatcacctccaaccaaacaggttaaagggattaggccggggtgcgtaggccgtgacgcgtcgtcttaacaggagacggtgtgcgccgtccgtgtccgtcgccaaggacgcgtgtgcctacgtgtgggtgtggctgcttgtgcttgcgggtgcgactgcgactgcgactgcggccggtgcaaggaaggaatgggaaaccacgggcgtcgacccagctgtttgcgttttttgtcgttgtgtgtcgccttctctacgtgggcacgtctgccccttttcttttttttgccccacaacttccacttgccttttccccgcgatgcatggagtggacattttctcctcgtcccggttcaccctctccgcccgtccctctcgtaccccttccaatcctgcgttataatcatttactaatgatctgtctattttgcttcaagaaatttagctcagctaaacgtccatcccagacgcatcctcatattagctactcccttatatattgcaggcaagtttcttaaaatgctaaacaaactatttttttcaaatacttttatataaaatttattttaaaaattaaataaaccaaaattccaagttgtaatacttgatacttataattaataatatactaatgtctcgtttcgcaacaagttcaaaatcaaagccgataaactcattcaaactatacattagaaaattgcgggccagttgaattagatttgattataactctcatatttttatacatacaattatatttatatacaacagatactaaatttatgatgggatttaatatacaactattttattttcttctgtttttattgtactttatttacaactattgttatcaactatacttgttataatttggtcctacaaaaagtcttggaaaaatatcaatctttatatgtagcatccttagacaatatcgaaatttgtatattatgtatatctcaaaagaaatttccatgtttttaaagaacttttttatgtagctgaaagacaaattacttaattaaaagatagacgcgacaaaaaaaattcttttatcacatgaaagatgattttcataaaagaaaatcaatcacagaaatattctattatcaaataaaacaaattatattttaaaaaaattaatacatgaaaaaatcttgaatctacacaaaaagttctgcattatataaggatgctgcgcacatttttttaaaaaaatttaacttaagcgaatcaatcaattatcaatcagtatatgtcttgaaagacagttttagaaaaatatctgctccaacggcatattttgaaaataattgataaagtcattttttcactgctagtagcacattggttacacttttttagttgtaacatagaaatataagttttgaatcatagatattctatactcagttgtcttaaaatataacaacttactatgataaatctaaacaagcttcttatctatattctatattagattgctaactatgtagatagtatttcccatgccattacaaatttacctatttagaaaaatatcattacaattcgtctatacgtagccgtgacactgaaattttacaaaattgaatctatgccatcgctgtcacgttcttcgtcactgtcgtttctttcttccttcctctctcctcttttcttctcttggctgccgtgggcgtcaagatccagcgtcggtcgtcggcaccggcagagaagttgatgctgccgccaggcacgattccttcccgcggctccaccctctgtgtcacctcctcccttccttcccttttcttctcccagctactgcgggcgtcaagatccaacgccaatcatcggtgcctctgtgtcacctcgtccctcccttcccttttcttctcccgactgtcgcgggcgtcaagataccgcgtcgatcgtcggcgctattggagaagctgatgccgccatcgagcacaactccctccagcagctccaccctccgtgtcacctcagcctgcggcagcggggaagcccatcaccatggccacaccatccttcctcaccatggggttgaagtcagagccgcagctggtggtggtggtggcggaggagcgtgagtgtgcggcttggactcgagcaatgcggatgccacgacgaggtagggttggtacggctgctgccggcgacggcggccggggtgtcatcgtccttgctattggctaccaccgctaccgctgccgctgccattgggaaacgagagacaagggtttagggttagtttggttcgtgtcggccgcatgctcgcccacaccgccgttgtgccctctttctctgctcctccacagtgctgcccttgtcgcgatggctgcgcgcccattggactcgaccccgccggctgaggtagatttcttgggcgtggagctatggaccgtcgtgccgtgttccttgtggagaactcgctttgcggcagcacccaccacgttctcctgtaggagaagccacactggcgccgcagcggcgatggagacatgatgatggtcgtcggtgtcagtgagcaaagatgtgacgagagggaagaagacgggagaaagaaggaagaagacggaaaggaatgagatggatggaaaacgtaatggcagtggtatcgttctaattttgtaaaaattaagtgacacggttacgaatatacgaattgtaatagtatttttatgagtagtgaataggtaaaattacggtggcatggatccaattaaccctattttgaatgggatgtccaagagttttttaatgggacccacgcgtgcgaagaatccggccccacctgcacgaagtataaaaagatgatccccacatacacaccgggggtagctccaacgacttctcatccgaacgttaagcgcgcgcttcctctgcttccgatgtggcaagctcccattggctgatacacgcgtcccgcgctccctcattcgagctcccttaattttctcccctcgagggtctcactcgtttaaaccgtccgaacggtcgactcaggcgtacgcgcaatcgcctttgcctttttctctccactctcttctctttttttttctaaaaaaaatcatttttcttctttaattcaccgactactccgaattctctaacggggagtaggcccagccgtgggccgtggtgctgtggctgtcgcatatttcggctggatttttttttttatatttggagtgatgttgcagtggagtgcagctttcggctggaaattttgtttatttggagacgatgaactcccgttgagattattggagttggccactggcttaccattttgtttagttttctccgcgaaatctgctgcttttcttctctagtagttgattaaattaaatcttgtttggttattgaaggatgatgtggttgcatagtcctgttccttaggagtagcaaatccatgtgcgttccagttggcggaattgatgtttgtccgaatgtccgatagcatcaatgatgattcgggaaaaaggctttgggcgcttgtgttagaagtataatatgttagttaaaaataagagtcaaatactgttagaagtataatatgttacttagatataagagtcaaatacaaatatagagataagatatatcctagagataaaatcctagaaataagatagagttctagagatagaatcctagagataaatctactcttacttgtattgtactctaaatctctatcccctatatacttctatatataccctataagagggttgatgtaatacacgagaaaacatcagaatacaatatattagaatttttcacatggtatcagagccatagcccggggagatgagatgaatccgtaagctctccccggggcacagcattagttagctagcctctcctatcatctagattagattatccacatatcattagatattttttccaatattgatattagatcaattcatattagccacatcgaaccctacgatttccaggagccaacacgacgacgatttcgtcgtctctcactagcatcatcaatcagaaggcgaggccgtggcgtacggcaccaccgtccaagtcgccgtattgaagcccgatcgagcgacggcaacaccaggacgcatctactcagaaaggagcagcgcgcatgcacatgcacgtacagatcggttaaaccaatcaaggtgctggccaagcgccatcacgtaccgatggtcttcaccgagctctcctgctgacgtcaacaagcatcatgccatccggcctcatccatggatcgatctgcatcggctacttcacaagaagcaggggccagatgctgttcgtcgccaacaacatgtgcacacgcctgtgctgcacacctgcgtcacaccggctgatcacctgcgacacacctgcatcaagacaccggccgatcatctgcgacgtcttcgcggagtccaagtcaagccgccgagctctccaggacgatcgtcttcgccgattctacatcatcagtggtcttcatcaactttgcgctgccgactcgtccatagatggacactcgcgtcctctgacagattaatctgcaagaaacttcatcgacgacatttaccgcgtcctctacgacggcaacgaccgcatcaccgacgacggcatcgatcacgtcatctacgacgacaacgactgcatcaactcggcatcacttttgtgatgactgctacacggcgcagaaggaccaaccaaggtggtggcctcatcgccaacgacgtcctctaacatatgcaagacgtccccaatggcatcctctgacatatacaaggtgcaagatgctaacaattgcagtttttgtcttcacaccatggcgtaaatatttttttttcgtcttcggctatttgcggctacatcaactaccatgattaccatgaccatggctactacatgattggctacatcgacgaacgtctacaacaagaatcatttacgacaactccagtcaaagcgtccgtgtcatcgctatcgtccatgacactcccgctatgactgcgggagggaatagagaagagtcaagggacgacatagaaggggacgcaggcactaggtggaggaccgttcaccagagatgcaatcgatgatggtgacttgaagaagatgaagaaatagaagatttcaaatccagtcgcaatcgttcgcttcgctcccgttacgactgagggggaatgttagaagtataatatgttagttagagataagagtcaaatacaaatatagagataagatatatcctagagatagaatcctagagataagatagagttctagagatagaatcctagagataaatctactcttacttgtattgtactcaaagtctctatcccctatgtactcctatatataccctataagagggtcgatgtaatacatgagaaaacatcagaatacaacatattagaatttttcacagcttggaaatggttggttcggcaactaattgagatgatatttttgttaggatactccaacgcatgcctgcctggttaagatttgaattacaattcaaaattggttctaaattctaaaatttgatttatgattaaatttttagagattcttcgtcagtttgaatgcccaacccttttgtaagtattactaagaagaagtgttaaacttgtgcaaaccacgtatattgaaaacctgaaaactatcgtttgaattcaaaatggatgcatgagatttgtccatatcacaatgagtaaaagttttagtagtaaacattttactcgtgatgacatagataaatctcatatattcatttgtgaacaaatggtagtttttgtgtttccgtcacatttgtggttttcattggcatgtatcacaactacccaaagttattattttttagataatagaaatggattacatctccgacttctgtcataagacacacagccataagtttaatagtaataaaaaggtaagataaaagtaaatcaaaatgagaaataaggtgatgggacaaatccccaactcccctttattattgactagcgttaaaccacataaaatattttagctagcaattcttatggaactacgccacctatagtggaataagagacccttggctaccgattccaagagtgtagcactattgcgcatagtatcctactcctcctgtggtagcattgtagaccaaaagtggagctagtaggaagacatgaagataacctgcatagggttagataattgtttaccattaaaaactttatcactgtgacaacgccaaattgaccaacatacagcactagctccaattagaatcatcttcttaatggacctagatatacccctctaagtcaattactgaaaatatttttggcgttacagggtgggggatactaaaagcaaaaaacacatatctccaaacaaactgagcgacatgacactgaaagaaaagatgttggattgtctcttgtgcatagcagaaagaacaatgtttgccccccccaaatttcttttagccaggttatctttcgttagaattactttcttgtgaagaaaccacataaagaccttgatctttagtgtaattttcaagtcccacagaattctctttttatcggaacattacaattcatgatcgcggcatacatagatttgacggaaaattgaccattcttatggagcgaccatacaaagcagtccttttcatttgacagagttatattagctagcctgaggatcaaatcgttccacttgattagcttttggccaacaatagctcttctaaaagagatatttagcggcgttgtgctcataacctctgccacagtagactgcttctttcgaacccaaagttattactagaaatcaaaattagcctttgatcactatgggaacctctgtcatcacgcagctacatccttagcgtatctaattttcctttattgcacaatcaataagtaaatctcttttacttagtggaaactgagttaatggtggccactatgagtctatgctttaattaaaggattaaagggcataacatcaaattttaagttcaagcacatatatttctcttttttttacaaacacatatatttcttatattaaaatacaatcatataatatattattataataaaaaatatttaattacaacgaatattacaatatagttggattgttgggtggtaaatagtttaagagaaaaagatcgattaaatcttgctaatgaagctctcatttgtatgcatggatggacacgtataaaagtggagaagggaaagaaaaatggagagagcgggtgctgtgcagaaaggcacgcaccagtcgtatacggtagggacacctatggcctgtattttatttatatcttcaaataattcagatactcatattttaagaatatatagttataaaagttggagaaagaactataaatgagaagttgaaaattttaatatttttagattctcactagcaatccaaatctcaagttcatccaaaccaaacaacttttgaatgtcattctaattatttgatattaggtcattttataatatccgcgtcttttttttaactctattcttttgaatgtcaagttcacctgcatagggcgtccaatccaaagcacttcatgaatgtcattatctcacccagttttggttaacacaagaggtcccctcgagataatgtaaaaagactaaaaacccagcctctcttgtacatcctcgcatcccggcccatatttgcccatgaatggaccaggatttgtgctttggtaaataaagcataaatgaaaagtctatattgcctccctcaatcttgttcctagttgacttgcatccctcgaccgcaaaatcgggtacaatgcatccctatttttaaatcggtgcaaatcgtctccttcgatagtttcgtcagacatgacaattttgacccctttgactggctaagtcagattgtggtgtgggcaccatctgtagggatctcctccatcctatcttctttctcccctcccccatctcactctctttcctctcttcctcctctctcacattacagcagcacgcggaaggagtcgtgtttggccaccacgggggtaggggtccccggccccggccgcacgcgaggggaggggtcgtcggccggccgcagcgtgcgctaggggaggggtcgccgcccgccgggacgagcttatccgtagcgacgtgcgtgggggcggggagggggggggggggggcggtcatcggcgccgcgggaggcgatgcagccacactgagagccatcgcagccgtgaagatggctgggaatgtgtggagcaaagtgccgctgcattggtctggggctacgagacgggatgaaggaatggatattgcgaccaatggaggtgaaagcattctacagtccaccgtgagcgtgagttgaaattatctcgccgcaggtacgagagcgtcgggtagtattccaccgccggcaacggccgcttcgctaggggaacatagccggaggttttagcacaaccgccggacaagtggcgacattcgtgttcttcctcgcccatatgctgcactgattaaagaagaacaccgacgagctgttcttcatttcttcatcccgtcgatgtccgggatgcggaacagctcgccgctgatagtgttgcagatgaagcgcttgatttcaggtttcaattccttgtcgtcgattggtacgggaggggaggggggcgtgtgctggtggcgtgggcagtggtgaggccgtttgtgaagcggaggaagaggagaggaggatcatcacccaccgagggcgcgcgacgtaggcggcggtcgtggagagggggcgcgccataggcacgacagagtcggtgttgcatttcggcgagagagaagggagaggaagataggagatattgggctgacaaatggggcccacctttttttatttttatccttttcactcacatatgggacccgctttattttcaattcctttcatgactgtgctgccacgtcagcacatttggactaagtcaccctacctcttcagaagaaaccgttttataaaccacttaaggagtcaatttacacccgtttttgaatttggaggggtgttaatgaatagtaaatttgacatgacaacatgcatagtgaattttctataaataaaatttgcttcgacataagtaatgagctttactatacattttacgaaatcaacataatcatggttaataatgtaacgttatggtaaaatcaataaatgcacatttatatatttaacgaagatggacgtgttggtctcgggaaagcatggtatactattagttgtcatgaaaatattgttaaggacctgtttagttaccaaataaattttttatgctgtcacataaaatgtttagacacatgtatgtagtattaaatatagaaaaaaaaaaactaattgcacagttcaccaggaaattacgagacgaatcttttaagcctaattacgccatgatttacaatgtagtgctacagtaaacatttgctaatgacagattaattaggctttataaattcgtctcacagttttctggcgaaatctatattttattttgttattagactacgtttaatattttaaatgtgtatccgaatatccgatgtgacgtgtaggggtaattttttttgccaactaaacagtccctaaatacaaatcaacataaatttgttaatgttattactggatttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8915 - DNA, 1730 bp, Oryza sativa
atatatagagtttagggtcgtgcaaccaacccttgacgcaatcctaataggtttcaacacgatacatggcccaagggcccaaatacggtgacgtaacaccgggacagattctgaacgtcaaattgtttagtccattcttgttgacttggaaagaatttggatatgggaccagaaccattggaaatgttatcttcttagcttttcatccatataaagaacgccccaatccgagcacgtatgcgacctgcgcgcccattttagtatagactggtcctggactccgaagtgcactcgaaattggcttagtttgggcctccaccttgacttggacgtccttgatgatcctcaactctaagtccttctccaagtgtctccttgttctctctattgttcctaatcacaatataatcattaggtagcaatctattcttaaattcatataaagaagaacataaaaacgagctcacctctaaattcaattgccgcgcgcaagctcttgttatcggtcctcaaatgaccgatggaagattgttgtgtgtatccgaaagagtgatgtccgcatcaggtagttttgttacattccatcttaaatgtgtagttttgtgataaatttaattttaaatctatagttttgtgatagattaagttaaatctatattttttagatagtttggtcatagtataggtagttttgttaaatttactctaattatactactcgtacatgctaaataaaatataaaatagtaccctttaaatatcatataatatttttttatagaaaactttataaaatctataggcgcgccaaccgtgcgtgccgattttctagtccatactagtcgagacgtgttacacgccacttggctgggtcctgctaatgcgcacccgcactcccctccccctacgccgattcctccctcttccccctttctcctccccatcctctcttcctactacagtacaccacaaaaattttttaaaaaaacaaaagttagaaaaaattacggatagaaatactatatataaaaaatttgaatttaaattcaaatttgaattaaattttaattcaaattcaaattcgaattcaaattcaaatttgaatcgggtatgtaaaacttttaacttataaactttgaatctataaactttagatgtataaactttagatgtatagaaatacttgatatagaaaatatttgaattcaaattcaatttgaatcagatataattcaaattcaaatttgaaacgggtatataaactttaggtctataaacttttaggtctataaactttagttgtataaactttagatgtatagaaatactatatatataaaaaatatttgaattcaaattcaaatttgaatcggatatataaacttttggtctctaaactttagatatgtaaacttgaggtgtataaattttaggtgcataaatttactaaaaataggaaagtaatacggtgaaaaaaaaaacaggtagagggagggaggggggaatggggtgatcgctagccaatagccagggtgattgttcgcccattagagtttccgcgcttgactggaccatgtggcgtacgtgatgtcactgataaatccgaaccgacgcgagataaaaaaaaactgaaaaggaaaatctcgaaacgtcgatccaggattgaaagcagatggatcagaggcgacctgaccgttgctagcgacttcaccaaccaccagtccattctc

SEQ ID NO: 8916 - DNA, 4659 bp, Oryza sativa
tagtcgcataacgtaaaggaccttggagattggagttcttgattggttcctattggaaatttgatcataattcggtatattttaatctaaaataacaagataataagcatgatattcgcaatgggaattgatccagtgatagtggtaaatgtaatcaacatgagcatacttaatatagaataagcatcaatatagacaatacaacgcaataatattgtgactgacagttgtaggaaacaaagaacgaatagtaacagtgaaacgttatacccccgagaatagttctccgctggagtttgaggcagtattgcctccgttgatgttgacgggaggctccttctctttgtatctagtgttgctgttgtcaccagttgtcgacatgttggtgaagatgatgcagagctacccaaaaacttgatcgtccgcctacccgtgtaggttctcaagcggacagagtttcggaggcacttgcttgttccgatcacccgtgcacacgagatgaacagaaccggagaaacagagagacaacgcaaaaacagaaggagagtatcgccaaggaacaacaacaggaggaagactcgatctttgagagcctctgccttgcgttatatatatagagagagatctccattaccacacaaaaaaaatctcatttgttgtgaaggttaccactgtcagggttatgaatgaggtataccctctacccttggacgtatgttgtatactgatacggtatacctgcgcgtatatggatgtttcctatacatgttaaggaaatccatcacgtaacagaaacggagtccacagatggaaggagtcatgctcggacagaactgggtcgttactatatcgtgtggggtccgatatctccgagttctacttggagattgactgacccgcggtataaaagggaccccctgggaggacctaaggcatcgaatctcaccaccaacacatctgccacagcctacgaagccggaacctacaggagccaagtcgccgggtgatctagtcgaaccaactcgactacgatctcgtcgataccatcgagttcctttattccctttgtaatctgtgacttccatcatataatcccataccaactggattagggctattacctacgaaggggcttgaaccagtataatctttgtcttctgtttgcttgatgttctattacgtagatcctcgtaccagcgtaccccaataccctccatatccggtccaagggtatccctcgtcgacaaccacaaaataaatattatttgttgtgaaggttacaacacagtgaatctctcatttgttgtggaggttacaacacaatgaatctctcatttgttgtggaggttacaacacaatgaatttcctttattaatggcaactttattctcatctgttacaaaacggaagagcagcaggcaggctcggctcgattggccactttgcatcggcacacccacggccgaggccgactcagcgcgcgcacgtgcgtgtggctgtccaaccatcacctcaaccggtcaacggaaaatctccaatatcaccatgtttaagttgaggttcttccacctaaattttcaaggcagtattattatctctaacattacttgtgggctcttgaaattttaattgaattaaattgggcctagcccatttattccaacaggttccaccacaactaatcattgtgccaaactacacctccatattttcttggcacagaaaccagtctcaaattttttttagtgacaaacatatcttccaagttgaaatgttctaaattttattttaattaaaactgcacactactgtgcctagaagagatttttctgaatttcatgtaaactggcagattccataaatcccgctaattcgaaagccttgtcatcagtgctagatacatatttccagatttatttgactatttgctatatttaagctgccttatttttttttatactttaccacctcaaagaataagtacattgataaacctaatattttacgcataaaataggaaggttgttaacatatattttaccatgaattctaaatgcttacacacaaactttccttttactaaagttatatgctgtctttttggaaatcacattttataattttttttataataatcatattgctggaaggatgttttctgaggctatataaatgtcaattattaaaattagattgtccaccaatcaacatatactactacaaaatctcttattggtgacggttcatagttaccagtttaattgaaatcggcacctatttattttaaaagtgctggtttaaaaaaatgccacatatactatagtactatcctatttgatttgtgccaaaccattcaaaaacagaattaaaaatcaatttaagggttttgttgaatgtaggatatttttttaagaaaaatgttaaaaaaacaaaacataatacatttatatattttagagcaattaaacaatattcacgggctataaattttttggtgcaccacaaggagcgctcattttctagtatctatgtaatactggctagctcaatcccttgtaaacacatgaatatgtgaggcaacaggataaattttgagaggaaaaaacatagagtaaaaggtaggtagaacaccactcattgaaggaaacatagaaaaaaattgctgaaaatgatttgaccttcaatgtgtggaattgatttaaatcaagaagcattgatatgtaatatgccgtcctaacgctatacccaccaaaatatttagtaaagcattacccttctctaatttgacagcatctttagatcactttaataccttgagtaactagagtgaagtaggcaacagcaaaacatgagtcgttccgaaaatattatctctcttcagccagaaaaatggagactatgtggatcaggaatttttttgttgattcctgcgaaattgtaaacatggaatattaatattgttttggtccctattggttcaaaatagcttccataaagtaaaatagtcttgtcactataaacagatgtctatagtgaaactaaagcaatttcaagggtatgaatctaaacaaggtgccaaggtttacaatcagaaattcaaggaagtagctagaaactattttcataagataagaagcatagactattttcacactttttgacctgaactcatgcggttaagttgcatctacctaattcaaacatttgagtatttgacgtgtggcaatgaaaccatgactcaggttactcacatatcatagccccctgtgaaagggtgtgtaacctattagttgcagtgacctaagtagcaccctaagattctgaaagtcttcatgggaacgaatttcagattggtttgcttgtaggctaagttcccaatttaaatgactgtactgcatatatcccaatggatcttaaaacgtcattgatatactacaaattcatttttcttctaaatatgtatatgtcaaatgtttaaaatcagatgtttatttcttttggagcatatgcatatgttacccgcttgaaaccggtttacgtaacctgacgaacgaactaagagtgacatgacgttgaagacggggaagatttatgaagaaatcagggaaaagcagagtagacagtattttcatttcatttttcatatcccattcgattacaggttgtgtcttaatatactagcaacacacggaaccaccctttgggccccactccagcgagaacacaatcagcttgtctctctttcccgaatacatcttcccaactcgagtacgccttatagatgtgcccttcccctgtttgagccacctcttagtgttttcatgtcatcccgttgtcacttgccgcatccatcttggctgcaggcgctacacagggtatgccttgtcgaggcttcgcttgatccggtagtggcgctccagtgaaatggaaggttggccacaaagcggtggcacccctgaaccctaaaccaacaatgataccctttcacttgatccggcataggggaatcagcgcatatggtggcatcttctccgcggtgggtgacggctaacagagcggagcataatgaaggagaatcggcgtaggcaacgatatctattcctccctggctagcttgggctttcacgatgagagggcaagcgattgtttcggcggtggtgctaatctgcctaggtacaccataggacgcaccggtccattagcaggcctgtgcgcctagaagcaggctctatcgctacagtagcagttactccctctgtcctaccggataagacatttcataatacaataaatctaaacaaatagaatatctcatccgttactaggttgtaatattgtggaatggagggagtaagccgcccaaagctaacataatgtattacaaaatagcgacaagaaccaccttggtgtaccaaatgaattactgtaccacccaaattgacaagaaaattacaaatcaataacaggaacagggccaacaaacggatacacatagtttactcataatatcatggatcaatctcgctagaagcgcttcaactgtcaagtccaagctcaatctgttagaatagacaagagcacactattttttggggtatcacggtgaaatcattttttcgaaatacatgttaccccctcccttcttaactccttgtacgg

SEQ ID NO: 8917 - DNA, 624 bp, Oryza sativa
aaccttatcttgatcaatttgtactggtattcatagatgatattttgatatattccaagataaggaagatcgtgcaaatcatttgagaatagtactatagacattgcgagatcataaactatttgccaaattaaagaaatgtgatttttggatggataaagtatctttccttggtcatgttatttcgggtgaaggtatatcagtggatcctgaaaaggtcaaaaccgtctcagagtggaaaaagccctcatcgataactgagatatgaagttttcttgggttggaaaaggccctcatcaaaaccgtcgatttattagtaacttcgctagaattgcagctcctctaacccggttgacacaaaagggagtaaaatatgagtggactcagacttgcaaagaaagtttcaaagaattgaagaaccggttaacgacatcacctattcttgccttgcctataatgggagaagaatttaccatttaatgtgatgcttcaaaaattggattaggttgtgttattatgcaaaaaggtaaggtattgcctatgcttcgtgtcaattaaaatcatatgagcaaaattatccaacccatgatatggaattagctgctgttatttttgccttaaaaa

SEQ ID NO: 8918 - DNA, 1950 bp, Oryza sativa
tacaaaattggctagcaaatacttaagttgggactctctacatatttataacaacaaaactgatttcttttaattatacagtttcattcaaaaataataatttgccctgccagtaagggcacatgcataacacttatatctttgcatatataactggtgagaactttagatcaagaagcattccttcacttcaacacatgcatactcctgcttgatccattgtcactgccatgtacttcagatgtccaagtgcgacacattagaaatacacatatgtttcattaataatagctacatgacaaaaaataaataagtttaattaatctggtgtctgatccgacctcatttttcagggaaaatatctaaacatacaaatacaaaaaggtactttagaaatgggcagcttgtaacctcttcggttatcatattaaaagctatgattcttcaagaaagcctccttgattcgtttcaatctacagagagcatcgcgcatggtgcttcgttcatcaggagactccagagcacaagacaacgcaacctccatgacaggaagtattatgttgttaagcatcagctgctgccggttctgctcagcactagcctgctgctgcccttcatggcagatatcaacgattgttcccctaaggcgctcgtcaactacttcatgagctcgatgcgggaatccatctcgcacccatttttcaagattcatgtcccctccaaactgcggatcaacaggcctctttccagtgatcatctcgaggagcaacattccgtactgagacatcgccttttgctgatggtttactcccatacccatattctgcacaatatagttttagtgtaaacatatcgcaattcattctttttttttcttagaataaacacaatgatatgaatgaacacaaattatggcaagctagaaggagcacctggtggaatatatccaatggagcccttaaggccatgagtactggatacatcttgtccagctgatgttggagacaacaaccgagccaacccaaagtctccaaccttagctgtcatgtcttcatcgagaagcacattgctcggtttgatatcacagtgcaccacttgttctccacaatcattgtgtaggtaatctagtgcactcgcaacatcaatggcgatgctaagtatcatatcggcgttcacccctgcaacattctcaccctgcctgcctttgtggatcaaatcctcaacacttccgcagctcattagctcataaaccaatgccctgaactcattgcctgaaaaatcgatactcgcacacatggtgactagctttactaagtagcggtgccgaacatttctaagggcctcacactctgcggtccagctcttcagtgctcccatcttatgcagatccaacaccttgatggccacagctgttctgctgcgcaacactgccttgtacactgaaccaaagccacctgtgccgatgaggtttctattgtcaaaggagctggtcacctggtttagctcttcatatgaaacaagtgggtgacttttcttgatgaagctgcctagttttttaggcttcctatttcttaaccatttccttggcaacagcagcatgcttatgatgacaacgatggtaatagcagccattgctgctgtgccaactgcaatagcaacggccatctttcgacgatgtgaggaatggatgtagtagcatagcatgtttgagtagcataattttgggttgccgtcaaggtaaacaacagagtggtccttaaagatgccgttgtttggcaccaatccatcaaggtcattcattgagaggttcagtagcctaagggcttgcatcttcaccaacgttgcaggtataatacccgataactggttgctagacaggtccaaggtttgcaaacctttcagattcccaatagtaccagggatcacacctacaaagaattggctgcagga

SEQ ID NO: 8919 - DNA, 3985 bp, Oryza sativa
atactaccgttgaggaaattataggacaagtcaatggcggttatttgccctagttgaccaatattctctcttattgaaccagttagtaaattatgtgatagattaaggagagtgctaaggctgttgagtgaaaagatggaagcagggatgccccccttcagactgttgcttgatatgtccagtgaaagcacatgttggaggttaccaatctctactgggatttcaccaactaactcattatggttcatctcgagcctcgttagttgtgcaagatccccaatttctgctggaattatgcctgacagtttgttcctagcaaggcttagcatggtcagctctttcaatagtccgatttctggtgggatacttccaaaaagtaggttgtagctcatattgagcaaagtcagggaagataaacgcccaatggaagctggtatgtacccagttattctgttgccaccaacatatagccttgtgagagaacttgacaagttgccaatggaatcagggagtataccctcaatgagattctcatcaaaggcaatcagctgtagcttagtgcagttcataaggtcaacaaggacacttgtgttaccaacaatttgattgaatccaatattatacaagacaagattgtgaagaccgctaagtcccggcggcacagagccgctaaagtgattgtgggacatccttatactttggatgtttgtcacgttatggagagatggtgggattggaccagtgaacctattgatgcaaatatggaaaacaaggagccgtgggagtcgaaacccaacatcacttggtatcttcccatgtaggtcattatttgcaattgcaaagaaagaaagggaagagagattgtaaagtggctcaggaactgtgcctttcaggttatttatcgagagctggaggtacttgagctgtcttagatgaccaaactcgtaaggaattgtgccggtcaggttgttggtgctaagatcaagtgtgctcaacaacgagaggttaccaatatatcgcggaacactaccacttagttggttccctccaatcttcaggactcggagtttctgaaacgagctaatgcttgcaggtatagtaccaaagaaggtattctgtgacaaatcaatgatctcaagatttgtgcagtttattagagctgcagggatattgcccgtgagaatgttagcactagcatttagtgtttgaagctgtcctagccaaccaatttggtcaggtatttcaccagaaaactggttcttttgtaaatataaaccatgaagggctgatagattgccaatgctagggctaatcttgccaaccaaattgaggccctggagatctaacaccaagactctaccatgacgattgcatcggaccccactccatgtgcaagcggagccattaccccaagataatagcatgcctgatggatcactggtgaccagagatttgagaccaaggagggcctcttgatccatattatcggctggaactgactgagcagaaactaccaggaacagagaggatgacatgagtaagagtactaactgatggacgatgccaatccttatcttgatttggagatgcttacacagcaaggttgcccacatcttgattcgggtctgcacacataagaagatcgcaggttgcagacatgtggatatccagaacaagaattgacaaaaggaaagctggatcatcacaaatgtttgagtatatagaaaatacatacctggtccagtcgtgatgaaagaaacctataagaatcgcatacttaactatatactaccacagctcagggattttatacaatggcaacttgagctagcgatccatgccgtcttgttaagtagcatgacaagtgacaactcttagagccggataatctggacttcgtcactgtactctctcattcttgcaggggaggctgttcctaatgtcaacagaagaaaataaagataagacttttgatcccatacatagcagccttagaaattctggtcaccagagaggacgtcactgttttcctgtataagaaagttggtaatgagatgatcttggccattggaattaacttttccaccaaattgtacgcgaaaacaaagataagacttttgatccatatatagcagccttagaaattctggtcaccgtagaggacggcactgttttcctgtataagaaaattggtaatgagatggtcttggccattggaattcactgttccaccaaattgtacgcagcatattgaattgtatatgatatgcaagtctgagatgcaaaagaacagtacaggaataaaataaaagaaggtactttatgataggcaaaatacacagcactgtactttagttgacaattatatcacagtttgcagaattaggcaatcatatatctaaatattattaaggatgggaaagtaaatttaccaaagaaactatgcttccattaaagggggcaaagaagaaaatatcaatacatcctcaatttgcaatacatatttgggcttattatgatagggtggggttagattcattatcttcagctgacagaaaagaaattgaagtcaatttcttttgaaatcctgcctatccaagccaatcatggttgaggaaaatgggaacttattcaattggacgctttcttctttagcttcacagtttctttgaactatttgctgtactatggagtatatataggataaggaaaaaaaaaactcaattttcatcttcaaacttccacaaaagtacggacaccatttattcttcaatttttcaatcctctctcactctttcctctctttgtgttcttcctggcttcttcctccactctcactctcccccattctcaccccgtttccaaccccgcaagaagaagaagaaataaacctttgctgtcaactggcaagaccatcgtcattggcttgcccccaccaatcatggcctcctcaatctgcacaatgacgggcatttaactcacctacgcggcgaagggcgagggctacagcagatagatcagcgacagcagtcccctcgctgggccacactggaactggaagaggaatttcccgccagctgcaggcggcacgcgaggggggcgtcgacctcggcgaaggggacggactacaggagtcatatggcaacggcggagtccaggcctagccagcatgagtccacggccgcgtcggtcatcgctctagtccccaaccacctcggctgcagtacgagtgtgagaatggtgaaccgagagaggggaggtgggggcggaggcggcgctgcgagaagatgaggtggcgggggaaaaaaatgaaaggtcaaaatgggaagaacggtcaatttcagttggtcatgtgttcgatcaggcctcctccgtattttaatttacggcaccgtctgaattacccctaaaccacaaaactgaaaattcttcacccttaactatgcaaaccggacgaattactccccttgacctaatccacggtggtttttgtctacgtgacgtacgcgttgcggtccagtcagcattttatttattaaaaatatgtagggcccacctgtcatactcctattcctctctctcttctctcactctctgtctcacacgcgcacggcagcagaggaggcggcgaacgggggatgaggcggtgagcggcggcgggctgcggcggcggcggaggaggcgagtggcggcgggagctcccgctgctcgaggcgaggcaaggcggcggcggcggaggaggaggcgagtggcgccggggtgcggcggcagcggaggaggcgagcgacggcgggagctcgcgctgctcgaggtgaggcaaggcggcggcggcggaggaggcaaggcggttggggggagggggcgacggatgacggcgcgcggcgcggcggggttgagatgccgcggaccgaatgccggcggtggtactcgccatcgcagccgacgatgcagcgggacctccaggtgtggaacccgtcatcctcct

SEQ ID NO: 8920 - DNA, 3799 bp, Oryza sativa
agctccgtccgagatggaagggggaagccgtgccgagctccgtccgcccacacgcctccgagagggagggggaagccgcgccgagctcctcatccccacccctccccccccccggtcgccgccaccacgtcacgcgccgccgctccgtgtcctccaccgccgctgacccgtgagacggtgagagagagaggaagattgacagagagaagtgagagagagaacagagagtagtgtatgacatgtgggtcccacaattttttataaatagaatgctgactagactgccacgtgtacgccacgtaaaccaaaaccaccgcagattgggttgaggggggtaattcgtccggtattcatagttcggggtgaagaatgcccggttttgtggttcccgggggggtgggtaattcggacgaccgcgatagttcgggggggtaactcgtactttttcctaaaataaatgataattacataagttttttgaataagacgaatggtcaaacgttgtataaaaagttaacggcgtcatacattaaaatacggaggtagtatgatttaattggagtaaattacactagcttacctcaaacttataataagctttcacttaggtccacgaacttgtaaaacacacatcgagatctctaaacttagtttaatgtatcatccaggtccatagcctcgatggcatggaattttttttatttcttctcccttcttccttctttttttctccacttcacctcctttctctcccttctaccgctgacaggtggggcccacctgtcactctgtcagcccgcgcgaggctggcaagggggcagagaggccggcggcagcaacgacgtcgtcgataggaaggaggaggaggggaaggggaaggcccctgctccggccggccgcgggcacgcgcggcaagcagatgcggcagctgctcaagttcgacgagctcgcctactctctcacgaagctcatcgtcgggttctgccactgtcgccgtcgagctcgcgccgctgaccttgagctcgccctgccaccctgctgctgctgtcgagctcgcacccaccccgctgacgctgagctcgcagacgcctaccccgcacgcgcggcggcggtcggctacccactgccaccgtcaagctagcgcccagcccgctcgcgccgagctcactgacacctcccccctgccccggacgcgcggccgcagtcggccacccctcccctcaggcgcggctggcgacacctccccctacgcgtgcctcgacccaacgaactgtgccgccgccctcttcacccctgaaccactccggtggtggccctcacatggccgccggcagccgcttctccctctcctccccctcggccttcacccacggatcctctcctcccgccagccggcgccgacgcgctgctcctttctcgctggtcgttgcccgcgcacgcgctccgttcctctcctcccgccggcaggtgcccgagcacgcacactgaccgttgcaggaaacctcgtccaccacgcgagatgaggaagatgagaaaatatggggagaaaaaaaaagggaaaaagaaagttttgccatgtcatcatccatgtggcatgccacataggcaagaacacggtcaaaagaggctttggaccaggataatacattaaagcatgtttagggagctcggtgtgcgttttgcaagttcgtggacctaagtgaaacttcgttacaagtttaaggaccgctagtgtaattttatcatttaattggtatagagatatgactgaaaacgaatcagacacgaatctaatatattatatattaaggtgcaatccttttgcgcttaagattcggacacaaatgaagaatttctcgatcacatgttttagcacaaatgtttgtgtgttgcaataggtaaagatgttttttcagagatataatagttagaaggcaagcaaccattaggaccgctatataaattataattgaaaaagttaataaatatctttccttgatttttggctgaaaagtctttcgttccttccttttcagtgttagtccagttcgatacctcgatggcctagctagctctcctagccgactaccgtcttcaacctcacgaagagtctcgtacacgtatgatgccggagccgaccctcccaatcaaatctagctgaacctttttcgatctctcaaaatgtagacacttatcactactacaccctacgtcacgccaccggatccgcgcggggggtggccgccgccaccggatccacgcagggggcggccgccaccaccggcgcgccgccggatccgcgcgtggggtggctgccgatggatctgctgcagccgtcgcgtgccacctcatcgtcgtcgccgctatcgccgtagaggaggaaggccggggcgggcggcggccgccagatcagagcgggggagggcggcggtggccagatcgacccggcgcctcctcgtcatcggcccaccgcccccgctcgcggtgaaagaaaaagagggggagaggaagagagaaatgagagagagagagagaggggaacgggagcaatcgaggagggggatgggagagggagtagtgggcgcgcggattaaatggtggatgggtattttcatgtacggaccaattaacacgtctgcatgcaaaaataaggctatttttgcttgtggacgtgttaagtggcccgtgttggcggctgttaaatgtcgattctataccgccaacatctgcataaagttcggataataaaatatccaacatagtgataggtgcttaaatctaacatattccacagtgttggtgtatatttatatgcaggtgataaaccccgatgttgggaggaaatctagactaaagtgaggagaattctgtatccatacaaggatgggttgtgaacttcatcaaaacgtcagtaaatcagcccaaaataccaagaaatggataaaggaggatcaggggaggagatgggccgaagaccaggccagatgggcccagcccaggttcggccgaaccaaaatctcagccgttcaggctggggtttggcgtggacgctccaaaccatggcggttggagggcacttcggacatttccccttcaccaaccgtcatacctactcctatataaagacatcactccctcacttcacacacacttccaagcttaagctgaattataaaaggctctattgtactatattgtatactagaataggaagagagtagagtagaaggagtcgggagaattccggagttgtcggtaatcttctcctatttcttttattatgtttattactctgaatttaatataatattcttcttgagtaatttagatttatcttgtgagaattatctcttggttagttcctaaatagcatacatgattattgttcactataatcaactaaaatatagtgattgctttggtgagttataaacactaaaatagatattaattgcttagacgtagtgtttaggtaattgttaccagtaattgctgcgtatcccacagtacgtttgaggtaggtgtagaggtggtgacagccctcgagatcacttaagtcctccctgtccgggtatgtagtagagcgacatctagaaatagcaggttgccagtgcctgaagtattgcattaggattaaagttaagctttccctagacactgtttctcactattaaatcctctctatcctggcctatcttttgcttggtgtccttggatgaactggtggaagatttgaccacacatgttcccttggattcgatatccctggaatactccgtagggaaagtgctacatcggg

SEQ ID NO: 8921 - DNA, 2012 bp, Oryza sativa
  unsure (1)..(2012): unsure at all n locations
caaagcaagatacaatgtctaaccatcacaactaaagcttggatacctacaacagtggttccatttattattattactttttttttcaccagctacattgcatattacattggttggttcacttaccaacttattgttactaggacgataccttatacttagcatgcaagtatgtcctctggatgcctctaaagactaagtagaccacactctccactaggtctacatgtcaccatttccctctaacatctcatcttgactagtttctacgcacatcaaatagtaataataatatatgagtatgttataaatactcagcaagattagtacatatagctatatgtatttttttaaagacaaaagaaaatactacaacccatagatattaacggccaataaataataaaggacattaaacatagtaaatgagttaaatccacactgcagaggtattaacataatcgtcgtaatctccgttcttcaaccattttctctnccactagtgatacccctcgtntgagaatcaccgcccgccgatttcctacctgtgtgagggcattcacatntcacactaatatcagcccgacccatattgttatttcaggtattgggcctctcaggctaagtatnacaatcacgttattattctccacgataaaatcatcaatncattattcggtgttcataatactttntgttagattgttagtatcaccatttcaataatacctggaaacaaatttagtcaaagtaaaatagttggtgggtgccgtccttgcctgtcttttgttgttcttctctgcatcccatctaatcaaatataccggtccttcgtattaatttatatctatatttgtcgcgccggacattagctactgacatcagctactagcaccatagatagctggctgatgtgactatactagagaaagaaaaccaacatggagtagtgtgtaggtgcttgcacgcctctagtccagtgagcagtactgcatgcatgcatatagcatgtagtatagctgctagctagtaactcctagtctctatactagctaccacaagcagtggcggagctaggtttggaggagagggggggctcagccttcttcttcttcccccattttcttcttcctctccctcttttcccccctctcctccctcacatttccatggagtccagcggggtaacaggggctcgagccccctccgcccccacgctggctccgccgctgaccacaagtactaacctttcacactaatatatctacctcctgctgcatttagtacacaggattatgaaaagcaccctaaaaaaatggtaagtgtagcagcctactagtaccacaagaaatttttgctaatctagctagcttattactagctgctacttgctaggtctgaacactattaaaatgtaacaatacacttacctccttgctctgtgcagccctgtgcttctatggtgcgagtagtattcctaggtttttgggaggctttatagcagcagcttccttcgggtctaaggagacacctgcccagtttatgagaggaatggatagctttcacctcctggacatttatttatccatttttttaactggtccctacgatcctatccactggtgcatgtctatcctatcccctttggttagtaaaatatactgccctccccattctctttctatttctatctttctcacacactttaagttcactactactactactactacttcagaaattccgtcctcgaaattattataccttggtgatggaaaaactgaggatagtttttctggagatcatcttccttctcccatgtggcctcatccttggtgcgatgactccattgtacctttaaaaatctaattgtttggttccttgtttttcgatctttaatgtccaagatacaaacaggatattccagatatgtcaagtcgttctgcaactcagccatatgaatttcaacctgatcacttggcctccgaaggcatttacgaagcatggagatg

SEQ ID NO: 8922 - DNA, 11206 bp, Oryza sativa
aataccagtacaaattgatcaagataaggtttgaatatacgattcattaaatccataaaagctgccggtgcattaatcaaaccaaatggcattactagatattcatagtgtccatagcgtgcatggaaagcagtcttgggtatatcactaggtttaatctttagttgatggtagcctgattgaagatcaatttttgagaaaacccgctctccttgtagttgatcaaatagatcatctatccttggtaagggatatttgtttttgatagtcaccttattcagttctcggtaatccgtgcataatctcagacttccatcctttttcttgacaaatagaacaggagcaccccacggggagacactgggacgaatgaatcctttatcttctaattcttttagttgtacctttagttcctttagctcaacaggggccattctgtagggtgccttgtaaatcggagtagttcctggtactatttcaataccaaattcaatctctcgatctggtgataatcctggtaattcagctggaaaaacatatggaaactcattcacaattggcattccttcccaacttgcttcctttctcatgatttctgccactaaagatcttgataaattgttttgatctccatggtaagtaatttagttttgatcccatggtttaagtgaaatttgtttttcatggcaatcaatatttgctttgttcttgcataaccaatccataccaagtataatatcaaaatcatgcatacccaagggtatgaggtcagcagctaattcccatccatcaatagtaattggacacgatttacaaattaaattagttgtttggctatccaaaggagtttctatgcagatcctttcttttaactgactagtagggatggtgtattttctcacaaagttggtggagataaacgaatgtattgcgccataatcaaataaaactttaccagggataagagcagattaagacattacctgtaaccacggtgttggattcttcagctgtgctcttagttaagttgtatacctgagcacgattcccaccttgtgaattattcgaccgtattcctcatgtagtattagtatttgcaagtggctttccttgatttggcccatgattatttgctgaagatggtccaggtaaataaagcgagggtactggagtcaatactttagtatttggctgagtagttgaactaactcgatttttacccttctgtaacagaggacaaaggtacctaatatgtcctgcttctccacattcaaagcacctccagcgataggacaaattgatggaacatggctacttggcatatgggacattttctgccttgattttctaaagattccctctgcatttgtccagaatagttttcacggaatcttccctgattttgttgattattagtcttaaacttcttttgaggttgtccgtgttctattctttgttcatgatacccctcctcaagaagttgtgctttacttactacctccctgaatatggttaattcaaaggcttcgacacgccttttgagcggttgacgtaatccactttcaaatcgtcgagctttagagccatccgtctgtacaaattcaggagccaatcttgcaagtcttgaaaattctatttcatattctgctacagatttattacattgcttaagctctagaaattccttctccttcattctcttcacactttctggaaaatatttcttgcaaaaagcttatttgaataattcccatgtaatagagatacgttcggaatatgactttttgtgagcatcccaccattcaaaagcactagattgaagcatataggtagcatatataatcttttctttatctgtacaacccatagcttcaaatgccttttccatggctacaatccaatcttccgctttgggtggattggcagttcctgaaaatgttggtggcttcaatttctgaaattccccaagtccattccggttagcatcacttttagtaatacattctaaaagctccatagcccaagggtcttgattgcttgcactaggtataattattccagtggcaccattactagtattatttccatactgactagtaccattgctgttgttgttttgctccatctatcatattcaactcattagccagaatacataaatgatcattggatggatctcaaaatggtaagaaaaatcagatttactatatgaatgtgagaaatactaaaatgacttacattgtcaaacggagggagtaatcaatataggtaatattaaaataaaaccatttagttatattatcaccattatgcttttctcttcttattttagtcttatcatcattcttaacatgcaccaatttaaaaataataaaaattagtacaaaccacaagcaccacagcactactgcattacttcaacgcattacttcaacgaaaagaaagtgcaggagcctatcctgctacacaaacactaaggcaaacacttactggtatactattgccacatacagagctctggtttttacataagagatgtctagaaagacatcaccatgagttctgatgttaactcctcagttctaaaagctcctttggttgtctcgtagcccatccacacatgctactgatgctacaagacttattatagtggagtacatcccatcccaagggaaaacaaaacccatacttacaccactcctacatctcacacactgccactagagctgtcactacccccacccctacgctgcagaaaagtagtggtttcactcaggtagcagacgcggtggtacaggcgatgggtgaggcactccagaaacataacttcattctcactggagcgaacaatagtcaacagttctgcatagagcttctcagcctccacccctaccacgcaagcacgccacctgatgacgcagatgctgcacctgagggtaattgacatcctggcgctctgccgctaaggcgtgtatagccatgagtgaagtagtttgctcagcttcagctactgtggtcttagctgcctcataataaaggtagggaacacgatcagctggaccaaggttaacctgcacccccacaatatgcagtccagtggaactatgcctcccagtaatagtcggtgggcaaaatttgctacaggacactcaaagaacgtgtattagctgctggacactgcaaaaatgtggtaattagctacaggacacccgccttattattatattatttccggtggaaacagagagagaaacattggttaaagacaagtttgcccatgagcccacttgtcaatcttacatatcatttctttctattttcgtcttcttcctcatgtcttgctctcttgccgccgctcatgcccctcggtgaagacaacgaccgccgtcggcgccgatgagccatgatcgccctctcctttctgcattcctcaatcttcacttgatgccatcttcgttccatctaatttcgtgccattccatgcaacggtgaacgcggaccacgccctcgctgccctggagcgcactttgagcatcgcgccgcgacatcattgccgttcccgtcgatcgggtgaagctaaggccaagccaccgcaccatcttcatcacgacgacctcctcttcggaagccccaaagaaacctagccaatggcgtggcgagcttatcgatcggcatcgtcttctccaactccggccagcgagctcatctttgattccacccgctccggtgagccaccattcaatccatcgcgcatagaagctccctaggatgtccataacaccatccgtgtgcatacttggcagctcttcgagtagatcaagccgttgtcgtgaacctagagttcttcttcgcagtcgagccgttccaaccgaagctgctgttgtccaagcctcgacgatcccttccaataacttggtgagcctcctggacaagcgcggcagcgggcggtagagggggtaggcggcgggtgggacggcagtcggcagagcagcaacggcgtcccgtcggcgttgtccttcatcgccgcttccgaggaccgccacgattgacagcgagggagcacgacgaggaggcctaggagcacgggccggagcaagcatggcagggtggagcagcgctcgcggcaggcagcgcgagagtgacaccgctgaagaagagaagagaagaaaagagagaagtaagaaaagagaagagaagagaagcaggaagaagaacaatgtctaggggcatgtgtttcggaagaagagaagagaagcatgaagaagagaagagaagaacgtggagctttagatttgaactttattaacgatgcatgtgtttcggatgacctccttgggtcattatggaagaaaataaataagcatacatataggggttgtcacgacccaaatattttttttccgtgacagtctgtcgtatccttatacgcatatatacaaagcaagatgcagtgtctaaccatcaaaactggagcttggacacctacaacagtggttccatttattattattactttttttttcaccagatacattgcatattacatcggttgattcactgacgaacttattattaccaggacgataccctatacttagcatgcaagtatgacctctggatgcctctaaagactaagtagaccacactctccactaggtttgcatgtcaccatttccctctggcatctcatcttaaatagtttctatgcacatcaaataataataataatatatgaatatgttatacatactcagcaagattagtacatatagctatatatatattttttaaagacaaaagaaaatactactacccatagatattaacggccaataaataataaaggacattaaccatagtaaatgagttaaatccacactgcagaggtattaacataatcgtcgtaatcttgttccttcaacccatttttctctccaactagtgataccctcatctgataatcacgccgccggattccctacttgtgtgaggcattcctcatctcacactgatatcagccacccgatatcgttatctcaggctaagtatcataatcacattattattctcactgattgttcgacgaaattttgtgcgctttttttataaattaattataaaaatgaattgtgcggagtactgtagttgagaactaatgggcaagtcacgcgcaaggaaatacttggttgtttgcctgtgatttactttcatgtgtgcattccatgattatttaaagaaggggaattagtacctagtcatagctaattgccgataagcacacacatgcagcaaatcatcagtacttagctattcaccggacctgccagaagtgccatttatctagccgggcccacaaatctgctagatgtggacatgatcgctcctgatcaatataacaacatggaaatacatatgatcatatctcctcttgatggtataatttcaggatatatcattttaatggaaatacatcattcacagtatcacggttagatgaaaaatagcacatccatttcctactttaatcaacaggaagcttcctgaagaacacaagtatagaagtgagacaactaaatggcaagttataatctccgcattcagcatttttttggtaaagccatgcacgggcatgcatatgcaccgacctgcagctgctataaaaggccaagcaaattcacaaggagaaaaacagacagaggcagcagagagaggacacagagaggcaggcagccgagagagcctgcaagctcacaccgtcgccactgccgtcgcggccttcaggcgctgcgctgcgctgagtgcctcggcgggaacgtgcgtgttctgcggccggcgacatcggctgccgtacctcggcgtccggcgaggaggcacgtgtgctgaggaagcgcgctaaggaggagacgatcaccagggagacgatgccgctccagttcactgccatgggtaactagcctattatcttttcatccctttgctccatttcagtgcatgcatgccgggacgatgctcctcagcagagaagatgtcggatgcaccgccatcgccagagttgccaggccaaccgatccgttgacgtcatccgcaagtctccatcaaggttgagacgatgtttctgcatggtgcggcgatgtcgccgggatgcttggacgtcgtcgccttgccggtcgtggcctcttctccgcaacgccgtcgacgtccgctcgccctcatcaacgcagctatcttcttcacactcattgccttgctgcttgaagagaacgccggccggagcaccactactcggtgcacgcaaggcgtcattacctccggctgcgtcatgaactatcttgttggagtggccgtggtcccgtggacgccgctgagccgcccaaatccatagacgacgaggcattgccaactaacgttcgtctccgtcaccgtccgttgcccaccggagaaggccattatattctcaggtcgccaaggtgctggttgccgatatccggagaccggaggtcactaacatgtcatccacaagccgcgatggtatcgtcagaccctgttgccggcacctgtcatgatgcagccttgctgggcagggatgtcccactgagactactaatcggcgacgccctcagtcccccacgctcgtcgtagcctctgcgggtcgccgccgacgtctactaagtcatcctcgccagtgctatgatcttcctcacgttacaattgtcgagccgcccgaggagaacgctggagcaccattgcttggtgcccgcacgtcgtaaccgagtccagccatgatcccttcgcttcagccggccgaggtcgtcgtgccatccatccacgacgctttcgcttcggcacgtcgggatcatcctcataccaagagctacagtgtcatgctcgccggccttgaccgcttgatgacaaaatccttatatgtacaccgtcatcgatgatgattgtcgactcgccactgtcgccagtcatactctcagacccgcaccgccagggcgtcttcatgactgccatcgacgccggtgatgtgatctcgtccacaaaccagaagtatcctcgtctttcatcgatcattggcatacattaatcctcgtggctgtcaccaatggcaaacctgttcggctgttcctggtgatcatcgcccgtgcagattgtttctctgccaatgacaagcacggccttgtcgtcgttgccgacgccaatcatgcattcatcgtcaacgtgcaaatttggagccgctagctgttaataaacgagctcggcatccccactggtgtctctgtcactctgcagcgcccatacacatgacggcttcttcatggccgccatatgctcactcccgactcaagccattacgatcggaggtggctcaacatcatttgagtttggccccgattgtcggctcatataaaatagggccaccgacacctggagtgttatccatcgctcccaggtttcgctacgcccctaacatcccctacagccacttgatactaagtgtgtgctgcagcgatcagaaggctaactcctgtgccatgatgatggtcaaccggtgtcgtggagactagatgggtgatgctaccccaaccgccagtgaccacaagcttggaatctccaccggtgtctctattgctcctagcgatatcaatacatatacggatgacttcttcgtgaccaccatcggcatatatactctcaagctcgacgccaccaccgatgtcattcatgctttcgctgatgacctcttcatggctaccatgaacatactcgagctcggcaccactaccagcaccgtgatcttattctcaccccagccaatgccatgctagttcccactacaagcaccatcttcacctccaccgacgaggctaaatggcagggcgggcagagtcgacatcaagacgacatcaccaacaccggcgtgcggactgacgaggccgcgaacactgccggcacccactcacacacatctataccatcatcaccatcatgcatgggaggacgtgaagcgaagacggacgacgatgaccagcgtaccttaatcggaggtatctcacgggtttcacccacgagagtaattaaccgggtgtcttccgagaccccgggaaccaggagatcacaatcgccaagtcagatccaccttgcctatgggccgtggagcgtatttgtccaaggattttgtattttttaattcttcgagaattataataaaatgcatttttcttcgtccattttatttttgtgtacttagtacactggcatgcccgcacatcttatttccctgggtggggagattctagttaaaattctctccaaacactgataaaatcatcaatccattattcggtgttcataatactttctgttagattattagtatcaccatttcaataataatggtaaacaaatttagtcaaagttaaatagttgatgggcgcaatcttgccttgtcttctgttgttcttcctctacatctacatctctcgggattttagttatcccgtgaatgctaggagcaacggaatcccgtggggtagcagccctctaaacccacaattactttttttccccttctttcgttttatttagtttactaattctatttgcgggccaaacaagccgcctctggaccatgggccgattcgtgctcgggccggcctgtgtacgtgaggctggcacggcacagcccgccaccgggccgtgtcgggtcgggccgggcggcccattttgccagctctccccaaaccccaccatggtgagcagcaaacgatctctcctccttccctagtccagactcccgacgcgaccaagcgccgccgtcgccgacgcttccccgccgtcggagatggacttccaggtcgtcgtcctcgccgggggcacctccgagaagctctcgcccctcgtctccaaggtcctctcctccccaccgccgtcttttaactccggcgccctaactgtgaccctcttcctcttctcccgcaggatgtccccaaggcgctcctccccgtcgccaaccgccccgtgctctcctacgtgctcgacctcctcgaggccagcgacctcaaggacatcatcgtggtgagcgcgcgagctcgcgtgtttctgcttggacgcggcttgaaaaatggtggggggattgtggctgatgcgggtgtttcgcacggtgcaggtggtggaggggcaggaggccgcgcgactcgtcggagcttgggcctcgagcgcctacctagaccgccttctcgtggaggtgagctcgaagcctaatttggctttcgattgattgaagtatgatagaccctaggtgtttccctttgctgtcagaatcagctgaatttatattcatgtttctttctttgttagatgtcatgggtatctatgggctaacttttgcatagtttgcaaaagaatttctcttgtggagatatcattgaatcattttgttcaggttgctgtattgtatggatgaactccttttaattttcgtgtatgatggagtttttttcacggagatagtctcgtggtgccgtgcatattatacagttgtgtgcttgcttatctgggttctcaaggtaatgatattaagaaggtttgaatgctaaaggagttatggtatatgaagcagcatgatatggtcagcttcagaaagcatgatataatcaagtttcctagttctaaggctgttatgattattttttagtgaaaattggttggctaggtgtatttattgtgaaatcagtcaaagggcctgtttgggggagctttagattctgagaagcagctgtttggtagccagcttctaaaaatatggaaaagctttgaaacccagcttctccagcttctggcttcttagttcatttttcagaatctgtaactacagattctcagaagctgtggactgtttggggcagcttctaccagaagcagcttttgggaaaagctgcagctgggacaagctcccccaaacagggccaaaaaggctgtgtacctattcgtctaaattaattgaaatgctgcccctctatgttcagtgtctgtccaatctattacgagctggccttttgttttggaaccaaaggaaaaccccagtggcagatttgtattgcgaaagaatgaagccagtgtctactgactacagttggcgttttacatcccagataaagcttatttattagggcatgcgcaatgtatcttacccaactagtaaataagatgggccccatgaccaggaggtagtaagctgcaactcttctcacaatgcttatatgagtgtagtggtaaacaaggtggggtccacctgaaaaaatccatccatcccaaccctccattacctggatcctgtcagaatcttcatattttatttggttgttgccggcaatagcacaaataccaggtagtaactactacctcttcccacaatgcttactattgggtagtaggcttgaaataaatgcttgttacctggttttttgccacattgtggttgctcttaggaatttccactattctgcatttccctttgaacataagatctacattgtagttattgcaatctccaatcccgccctgtccttttaagtttggggcatttgtaaatttgccaccggttttttcaatattgcaaggatgccactcgaatgacagttctagtggcatttttgcaattttctagtggcaattttgcaataacgattcaaagtagtggtaaatttgcaattgcccctttaaggttcaaacataggcgagcagtctaaatggttagaacttacaatatttcacatagcaatagaggaacatagaacattgttcatctctttttgtttaatatcgtagtttgtttttcttagcagagcgtggttgattgattggacaaattagatgggcacattctgctgatatcttgcatgttaagttgttattcgttgcttttgtttgaatatttgacatccatcacaatacgtagtttaacattggcttgtggctaactggctacttgaatacatatatgtgtatgagcatattttgatgcactcttctgcacttttttcactttgatacaccttccaacagaatgaagctaattcaatatcataagtcttctgtgaaacttaaaataatgtgtgattgaggtctttgccctgtctaatcattgcttttcattaatatgttataatatgaaaatttcagcttctgatagagagttagagac

SEQ ID NO: 8923 - DNA, 790 bp, Oryza sativa
  unsure (1)..(790): unsure at all n locations
atgtattgctanaatcctccattttttagcggcttcaactccttgggtttatgtttggatttcatttatatttttgtctgtgttatcttctaatcattagttttagttgtccattagattttttctttggttcctcaaattaaaataggccaatttgcctggtaccatcgcaaaaatcatggaactggaaaatactaatgtatctgtcattgatgtgggtccaggacccacatgccattctcagatacgctcgtattttgcaactcacatatctcaactatagtattttccgattttttttattgaaataggtctcgtgtctatgtggagtgtatcagtctttgggagtaacttatctttctcttgtataggttgtggcagttccagaggacattggaacagctggtgcactacgagctatttcaaagcgactgactgcaaatgatgttttggtaatgttaatgcttttatagaaccttaagaatgctaaaatatgcatgctaagtgtaatgtagatattaatgtattagaaccttgttacaataggtgattagcggcgacctagtaactgatgtacttcctggggctgttgctgctactcatagaagaaatggtgccgctgttactgctttactatgttctgttcctatcagtggtccttcagatgctgcttcttctggagggaaagataaagctaaaaaaccaactcgactgaatatagttgggctagacataacaaggcaattcttgttgcatattgtatcaggtttgtatgtcttgttaaaaaggt

SEQ ID NO: 8924 - DNA, 619 bp, Oryza sativa
acctgaatcacgccatgaagggagactacggggaaagggaactctcggaaggaaagcaataatgacggtagacaacaatttattccgtaaagcccatttcatgggtctgcaacaatcttcattggtagctccttacatcgaggagcacttggctctagttcgcgctaggaacatcggtaagtccgatgcatggattacacggcatcacattgatactttccccgcatggctacgacaacatctcatgggtaacaagtcgatcaaccaataacttgccttcctggcgaggggaccgtttgggtcgatcgcgacattccagggatatgagatcaatgggtacacattctacacgagagcccaagacatgaagagcacgaaccaaaacagcgttgttcgtgttgatgccatgggacatgatagaacaactggcacgtattacggtgccatcgaggacatataggaacttgactatggtcctctcaaggtccctctgttctggtgccaatgggttaggttgactggtggaggcgtaatgattgatgacagtgggatgacaacggttgaccttaacaagcttggatactcggacgaaccttttgtccttgccaatgatgtaacg

SEQ ID NO: 8925 - DNA, 668 bp, Oryza sativa
atcggcgttaaggtcgggcaaggacggcggagctggatccagtggcgaagctagagagaaataagggggtgcactacatcatcacatataaatgacaatgtacagaattttcaagcaatattatactagttaatatatttttcaatagtctcattagcatagcataagtggcgatggtacaccgacaaaggaacactgacaaaaagaacgtaccataccgagatgaataaaccactaatatttggaaatacaccacctgtcctcaatatcttgcaacaaaggataatataaacatattaagtttccattgtaaactatagaaaaaccatgtgaaaacaaacaaattaccttttcataaatcataaattatatttgggctctgtcatgttcataaaacgatgaaccacagcttcgttggtgactttcttcatttcttctttttctatatagcaaataaggctatgactcaagtagtcatcaccgatgcgattacgcaaagaacttttcacaatcttcatagctgaaaaacacctctcaaccgtcgcagtggcaacaggcaatactagaactagcttcaaaagtcaataaactaaaggatagcaaagatgtttccttgtctctaccaacttttgtgaaagctcaccaatagtttgtatgttggagaatct

SEQ ID NO: 8926 - DNA, 921 bp, Oryza sativa
tccaaagcatcactgcatataactaattgccattattatccatagtagatgggtacattattgtattaaccatgtcatatctatttactaatccaagttagatttcatacttcctaccaaaatgaatgccattatttcaaacacagagcaggctggaccgtatgctatatgtaggacttacagaagaacatgaagaatctgcgaggttgtttgctcatatggtaggagcacaggtgctttcacaatctggagcactgaacttagatatcaaggacaatcagcccactggaaatggtaagagacctcacaagcttgcagccttacccctttatgtaacatactttcaggaagcatacttatgtagtatttatctacctttttaagactgagggacaaagcccagctagttttatctatagaatcagaaagacaagagaataaaactgaaggatcagattgtctgggttccagcctatcctgcaagacaaaaacagtgcaatacagttacaaagaagttaaatgtcagtacataacaaaacaacatagaagctagaactcaacaaagctcaaacaaatggaaataagttacttgttaactactcagtgcataagtagcagatgcaagccacgtcgtgtggactctggaaaacaatgttttgttaaagctgcaactcaatagaataatgaataaataaaacaacagcactcatggaattgtggtacgcgttatgtctattcttggcgtatggtaatccgtttgtgggatatcattgtgcaaaagcaaattacttagtctatcttacttgttctcacagactctcactcatccacgctggacccagaggacgaagaaacaaatgaacatctggtaatagggtgattaagctttaatctttactttgcgtgttaattggttttgca

SEQ ID NO: 8927 - DNA, 9247 bp, Oryza sativa
aacaaattagcaaccagattgttgaaattgacagggaagtcatctagacagcattttgtataaataaaagttgtagcgtacaaattgattgggcacataacatggtggttctactgattatttgcaattaaatttctaaacacacaagttgttgattcttgctaggaagttggatgatggcatatatagggcatatgaattgcaatgagagaaaacaatgcacatttttggtcattctatccaaataggctattatcctaaggactcttgtcaaatagttggtgtatgttattcacaaacaaggggtaaaggaaaaacaaaagaaaaaaggaatgtgaagttgccactggtaaagcagccagagtgaaaaatgttgagatttaacaagcgaggacatggtctactgtcaactggtaaataacatgaagtggtttatgtcttgtatgataaaaaacagaaagaatgtagattaaaaagaatggcatggatataagtttcatttagacaatacctacagcactaccatcactgttctaaattttactatcaagtcccaacaagcaaaagaacaaaaaggagtacagctgcacaatggttatgcaaaagaactttttgcatttaatcaaaatttctaagtttgtcacatttttctactatttcatggtgtctaacttaaattttcaagttgcataggcatgaaacattcatcagacatatcaggaagacatgcaattaacgataggcactaccaattcaccaccacagtaagtattactgcgtgatttgttagcaggcagaccaatatttcagggtcaaagcaattgcacaaagaaagtttatagtttccaacacattgagagatgcattagagacagtgaccaactaacagcatagacaagtcatcatacctgaaaggtagctccattatgaatgatttcatgcgcaacaggatcattaatgtactggtgtagtggcataaccatatcctccacatcatatgcattaaccctgtggctacttctcactttatcaatccccctagcatctctctgccaaattaacagtatgcttttatattattgcaaaaatggtttagtataggcatcaggcaatgaaaacatcatcatcataataatggtaattatatgtgtgttgattccaaatatttctgaactctattttcctgatcactcacatcaacttaagtgtaaactaatagcgggacaatgacactaaaaccgatgttcaggtgttacaaaagcttaagagatcccacctgaaagtcaaaaccttcctgctgacaaaaccttaaattattattattcaaacactggagcataagcattatcttagatacttggagttaaataaaattgattcttgggaaactggcatgtcctagatggcttccaaggttcaagtatatagtctccgctccatgtagcaaaggttcaattgactagattattgcaatgtgtttttgtttgattgcttctaatcaagactagatttaagatgcacctgtggatcatgatgttggataaatacattggcatataaaggttcaattaaatagaggcttgattatagtctgctccatgcagcagatgttcaatttactgttagaatggatcaactactttatctttgctgcaatgtgtgtttgtttgattgcttttggtgaagactagatttaaggtgcgccttctagaacctgatattggatgaatacattggcatagaaaggttcaatatctagaaatgcaggcttgatagtttgtcctagttgttttcctactagtggaaaaggatgatactaagcaaaaggtttggctgaaataagtaaacataccctggcaaacagatcttctctcatccacgggaccaagtatttccaaggccatatatccaatgtacttacagcacgagattttgttaacacacggctagtcattaactttgcagatgttaagtttggatgcacaagaaatctggctgcaacttcgaccgagaactcatatgtgctgaatactcggtcaactgggttccttagtattgtgacaacagaagtcctctcacttggcagcttggacatgaagctatagtcatcatgactaacaaccagcttacaatcaggatggctgacacaaagatatataaaacatcattattaattgtaactgcagaatcatgtgaaataaacaggagtatgaagccgctcaacttgtacagcaaatactagtggataattacatatcagatgctttaattgaacaatcaatcttgagtccatcacaattttctcgcatgactgacacgtgttcacgatagccatataagttgttgattacgttgttcaagatgtattgaatgcctggtaatccgtataaaggtaaaccatatctactgttttcagtcagataagcactaagaatgttattccaatacatgggaatactctaaatcagtgttaaaccacagaaaacatgttaatccatgggaatgttattgtctgaatctgaataggatagtacatagtgtaaagtaataatattagtaatacacaaaagacaatctagtttattttaattctcatttggttggccaacataaagcttgacaaatatacaatagaacaaaaacagagaacaaacttttctacctggggtcgaaccgcagcttatcgtaggatcgcggacactcctcagcattggtatacagctttttcaggaagctgccaaaaacaactagcatgagtgaaatgcacacatcctttgatgacgatgaaacaagctactatgcatgtccccatcgtaccagtggaagtaggtacggccaccggttctaggaatgtgaaggaagaagagcagatccctgaggctcagcttgtccccatccttgccctcgctccccgcaaccgaggccgcccagcccttgacgaccccctcgcagcgcgcgtggtcgccatcggagctcgcaacctggagcaagttcactgcaaacaaacgaaacaccaaaaacgacacgcgcaaatcagcgcagacacatacatagctacccaacgcagcgatgattccacggaatgatcctaccaaaaaccgaagcgcgttccgcccaccacaaattcgcacgcggcgggggagggcgagaggagaggggattgattgattgatcgattacctgatacgacgaggagcgcgagcgcgagggcgagtccgccgaacgccatcgggggttcgggcccagatccagccggggtgccgcggccccggttcgaggcggaggaggaggagggcggcgcggcgtggggaaggggggggcagagcggggcggtaaaaaggcaaaaacccggaagggagaagagggggagggcggcggcggcggtggcggtggcggtggggaattgagcgcggcgcggcgtggcgtggcacacggcgcggcgcggcggtgtctcggcgggcgcgggcgcggggtggtgggcgtggcgtggcgtggcggcgcgttccctagtttattgtgctttggcgctcgctttctcgcgcagtgtctgctgctgctgctactggcggtgtctctctctcgttcgccttctccacctctccgcgtgccgaggcagaggaggcggaggacgaggccgaggccgaggcggggcgacgtaaatagtctagtggtggaagtggggggaaaatcgcggcggaagcacgagttttccttctcgccacttgcgccgttgcgctgcgcccacccgccgtcctcctccgcctcggcgcctcccttttttacccgcacggtgtccaacgaacggagccagatcgccggcctgatggtggagaaagatttacagcgcacgcgaaacgagaaaattcattacctccctccatctacttttaatagtcatatttcatcttgacacacagaccaaggataagtaattctacttatcatttatttaagcatgctactagtcattcatcgtaaacaagcgattcattaatatttacatttctcaaagcccatatagccaatcatgtgtggaagaatggagagtcacgcattaaattcgagaaaatcattaagatgatatgttgttggattgaaatatacctatcaaaaataaaattttcagatttggaaatatgactatcaaaaatagatggagggagtattattgttataaacttgaaaaaaaaatctatttgattctttaacaacttttatatagaacttattttttaaatacacaccatttaacagtttttaaaatatgctaacggaaaatgaagacgttgaagtttggagaccctgttctaatcttaactccaaacattaacctcctcattttcacatttgatatgttttgtgaaacaaaaaaattatatatagaaatttatttagaaaacaacatgttgtcgttttcgacaactgcgtcacgtcgaaaaacgtggttctctcaacagtggttggaaaaaaagataattgtattgcttagtaaaaattttttagatccccttgttacatggccctaggggcctatttatagctctattatagactcctccatcattagggtttaggttttacatagaatttacatgtatgggcccctaatgggctaagtggctaggcccaattgttggcgaaacctctggaagacacgatggcccgctaggccttctcccgatgaggtttggtacttggcgaaacccatgccttcgtgcaaaggctttcgtcccgcagtcttcgcgccgtatggccctccaacaaggtccgcatttagtgaagcccgcgtacttcatgccacggctttcgccatgtggctttcgcccatgtgggtgccttctcggccttcgccgcgtgcccccggcttgagtccttcgcctaggtccttggtttcagtaggcccagccgaaggtccacgtggtatacctctaacacaacaataaacatatatttcacatttgtaataattaatacttaattaatcatatactaatatattttcttatttaatatatgtgttgaaaatctctcttcaaccctaatgaagctttttaagtcactaatatagacgacttattttactgtagtccatacgtcaatggtataactatagattgcacaaagctatagtggtcttgtccccaaccaacacatttaaaatagtaaaatttcattgttcggctaatcctcaagggattataataggattaaggtggattaatttcacacctcaatagtcatggaattaattctctccaaatccctctcaatcctcctatctctaaatctctctcaatctttttgtagtgataagtgtggaataatacttttgactttttaggggcattaatcgaataagatccgatgggttttgcagcctccagcgcacggtaaaattagaagcgtgttttatactgatctaaatttagcaggttgttaataggtatttaagggcctatttagcacagctccagctctagctccacccctcttggagctggagctcagccaaacagtttcagctctaccaaaactgagaatgaagctgggtaaagctctctcacaaaatgaactgacttgtgtagctggatctagggagcttcacaactccactctagacccaactcctgaagctaaatttaggagttggggctgtaccgaacatgtcctaactgtgtgattacaacatctttgccgtttctgcttagaaataatcggggctacctctaattaagcctaaagaaggttacacagcaagggagcaacttgtggtggcagtcacgcaggcttgccgaatcttgctgctactgaagaacaatctttttgtggaagcaggctgccggattcaggcttatcttgtccactaccataacactacaacttagtgccgtttggtagagggaagatgattactcactaattgatcaggttatcagggtccctgctcctgccaaaccttttcttcattcatcttcttgtgtattccatccatctttttttaaaaaaaaaaacttgtggaggccatcgtttcgtttattaacggaataagcgaaacgttatatttacaaacaaaaataatttgtaaataaaacttttatatacgttttcttagcaatctaaaagtaaaatcgaaaaaataaagtacgatgaaaaaaacctcaaaatcaactccaaatttaaggtttaaaattcaaattttagcttataagtataatcataagtcaaaagatgaggctgtgtcacaacttatagttatgaatgtgactatattcaaaatcaaactaaaatattgattttttttctaaaagaggggggatacattcttgtaggtactgatgactctctgtcagagtgcaatgttcagtaggacagtgtcacctgaaaggacttaatcttatccaatgaatgattgagcagttgttttcaatcaacctgggaagcctgcaactgaacacttgcatggatgatgcattactgacagtgaaagtgaccagctttgctcactgaatgcagttaaccaatagggaatatactgttctcatacaatcaggtcactgtgatctatcaagtctggataagtactcctaaagatcactgaactacaaggtatttgtccaaaactacaaggaaactgtgtgcactgtactgctaattaattccatgacatctcaccatttcaccaatatagtgacgtatatccaatacttcttcacaaaactcaaattcaaattataaggtttccaaaaggaagaactgattatggactagaacttaactagaatcctctttgagtgactctaaaatcctcaatagttaacaagtgtcatgtaacgactcatcaacactaaacaaataaaacaagaacaaactaactgattactactccatgcatactgctgcctatcatgtcatcaagatacaaaaaaaaaaggaagttcaaattaacaaaacgaaaatcatagccacgtcaggtgacacgtggcacggttcatcacgcgtctctgtattggccgtacatggaagcgtggccaaacaatggcgggaacggcaggtgcgggtcgacctcgccgtggtacagcgggtagtcgaacccgccggcggcggcggcagggtcgaccacggcggaggaggaggcggcggcggagacgacctcgtggagctccgacgagtcccctcggctcatgacaaagtggccgccgcctccccgtggctcgtaggagtgctccatggagaagtagctctcgccggcggccgaaccggccggcgagacgaacggcggcgaggagaaattattacaccctcctcctagcgcgtcgtccggcggcggcggtggccccaccccggcgtggaacggcggcatggaggggaagcagaagtgctggtcgtcgtggaagttcgtcgtcgtcgtcggaggcggcggcggcggaggagccagcccgttggtctccaccttcaggccgtgcctgaagttgacgagcagctccacgctcgggtcggcctgcggcggcggcggaggcggttggtcgccggcggcggcggcgcggcgctgcttctggtggcaggtgtgggcgccctggtaggtgacgtcgaagacggcgaggtcggcgtcggagcgctgcacctgcttggtcgccgggcagccttgcgcgttgcgatacgtgcaccggtagtaacccctgcgaatccatccgacacgtgtcagtgacaggaggcatcagatcatgcatctggcccgttcatttttttactttctttttgtcggcccacaagctttaaaaaactgagaatgttaattttgacccaattttaagaaatgaatttgccacgataaatcgattgggctcggactaggcctcccaatcaaaagcttttatcgtttgttaaccacaaccaaaatataaaaattgaaacttaactttattttttaaaaaaatatcatgttttatcagtaattcatcattaacttttaaatcattaaatatacttatataaaagttgtacccataaattatttttgactgcttcgattttttttaagcttatcaaccgtagagtcagccatgaggctgtaaaatgattcgatttttgtgtttggaactatgggggcttcaaataatggtgaattttgtagggtttttttttgtggggaatgaattttgtaggtttaactccctcccgtcaagaaacaagctgttttgggtatttacagtcttcaaaattgatctttcaccactagttttattcaaaataataataatcctgacaaaattattataatatttttttaacctacaatatgttttcatgcatccaatctaaatatttagaaatatacttatgtttaaaattaccaaggtttaaattaaaacatgtataaaatgatatgttgagctaaccttgggaatttggcaccgaggatgtccttctgaccatacttcctccaactgaatccatcatctggtgtagcctccaaacttgcatctggcactctgaatttttctgtccatcttggcaggcccttcctgtatgatgatttagagccaagaaaattataccaaatggtcagtcaatgatatttgactcctttttttcctttggttgactcaggcaaattctaataattcagtacagctgtatgcttatgattatgactgtttccacttatgattatgactgtttccatgcttttgaccaaagaactatgacatggatttctacattgcccgtccttggggttaggtccttttcaaatatatttttgacggttgcatatgattggtttgaaaacggaatttgttctttttatatttaagcaaataaccacaaattaaatagccttttttttaggaaattaaatatcctctgtttagagtcacaatgatatttcgaatgggttttccccctgacattgattaaccggagacatcgatattttggaactaccaaaaacatgtggaactggaagctaaaaaattcacattgcaccatgatacaacacagagacgacatacatactcatctacatccataacgcattaggtagatcatttgccctttttgctaaaaagaaaaaaaacagtgacttgattttaaacctagtttttttagcaaattaaattttagagttggttttgagtttttttaccacggtttatttttttagccttgacttgtaaaattttacctagatactacctccgttttttaatagatgacgccgttgactttttctcacatgtctgaccat

SEQ ID NO: 8928 - DNA, 1063 bp, Oryza sativa
taagatataaatcacacctaaagtactatgagtgataaaacaactcataacaaaataaattataattacgtaaattttttgaataagacgaatggtcaaacatgtgagaaaaagtcaacggcgttatctattaaaaaacggagggaatattatttttttattacttcgttaatttgtctacgacttatagttatagactgtagctggactgataagagccattcttaacattaaggcaagagatttataacaaaaaaaaagtttaaggctctaaacaagtccaaccatgtacacaaataggggcttagaaagggtgacacgaattttatccttattcagtttcagataagacaagccgatgataatatactctatccattatctcaatttgcttaagtggcgacttacgcgtggcgggcatgtccttagtttcgcgccatttttttaaaaaaaattaaagtgatgtgacgacggccaaaatgccaaacgtgtgtgtgagacagtgatagagattttaaagcaaattgaaagagaaattttaaaacgaactgaaagagagagatttttttttgtttagacgaatttgaacacacacacgcaccttctcttgatcgtgtcatggtggcgttcttgctgcgcgacggcggcgtccctcgccgtccggcccgagctctcgtccgccgaccgtggcgagtcggagcggtcgccggtggtgccgcgcgaccccgacgcgccgccgccgccgccgccgccggcgaaggccgccgcctcgatggccctcgcgatgcccatcgccctcgcgagcgtgccctgcagctgccgcgccacgcccctgtagtactcctccccgcggccgccgccgtggtactcgtcgtcggccgccgcggcgggctcgccgagctgccgggcctgctcctcgccgtcggcgaggatgctcagcagcaggtggatgtctcctccgtccatggggcacaattcttggacacgacacgacacgcgaaagctaagctgattgttcttgtagctttggatcaatcagcttgcagattcaggggctgcagga

SEQ ID NO: 8929 - DNA, 601 bp, Oryza sativa
ttgagccctctgcgtctcataaaatgatgatacttttagccgcacactgctgggtggtatggtatgtatacattgtcatgccatggccatgcctaaaagccatgaaatggcccctttggccacgtcactcttggtatggagtgtatacatacccaaagggattgcttcatggaaaataagtttcagaagggtttcttttgaatatttttaaatgggacctggtttctcctagctagcactcttgtttttctctcttaagctaattgtacttgcttgcttcataaacgtcagtatggaaatattttggtatttgtgctcatttttcacaagcatttattcagattttgtctttcatctcgtatattattttctgtaatgtaacaatgtccgtgatgtaatatttctcaaggtttatctaatcttataatttttttggttttctctttcagggctggatagaaatggtctgcagttcctggagttgctctccttggaaggttgtactatttggtcttggggtcacaataaccatcgcacttatcatacttgctttaacaacgagaagaagaacgtttaaacttaaggtctgatactctgatga

SEQ ID NO: 8930 - DNA, 15643 bp, Oryza sativa
gtttttcagacttcagatattgctccttacgcatactccgttacaatattccatttgtcacctatgactcttgggtggttaggatgcgccttcacgcatgatgccactttggtcaccacagataatatgatgtcgccaaagaactcgatctccttcagctttggtagattctccagacctgaaatcccatacttgggttctcgcaggaatgacaatgtcagcctctccagattagtcactgaacccgcatcgaactgcatcttctctatcctctccagattatcaatgatcaacagcttgagcttcacgaatttaccgtgacaaaaaactatgcagttgtcagcatatgatttgtgatagagcttgaggcagagcagatttggcaggtccccaagaactcctatggcatcagcatggagttcggtgcgacgaagagcaaacctggatacgtttcgaagcgatggtatccatggaggtagcctttccaactcaccggccaggctaaacttggttatgaatagaggaggcgactcaacaaaggctagattatccagtgataagctgtgctccttctcatccagagtgtggatggagagagagcgaagagggccaggcaacttgctcagagactcaaggaatgcgttccagttctcttccacaccgcgcaagagaacattgagctttgtcagattttgcagcaggccaatttcccgcagtactggcgatttatccttgactactatatggacaagtgattgcagagccaccatgttcttgaccaccccagtcgccacctccaaacctgaagattgtctcaagaacttcacactggctgtccttgtaagctgtaccttgtgccccgcaaacaaatgcttgagacaactcaggttgcctgcactagctggtagcttcttgataagagttgccctaatgtccagcgtctctaggtgtttcagattccctagaagatgaggtaatttggacacgttggtatttctgaggcttaggtacttcagctggaaaaacctgcacatacaatgcaaagtttcgttactcaagcagctgcagccttgcaagtcaagtactcttaataaccgtagctgcggaaagaagaatgggacttcctcaacagaagcagacatcgtgaaggagcgagcatgagatacattggcacttgttttttgagacgaattgtaactgctgtggatggagaggcgacggattttgtcatgggaagccaatgtactcccattgtcacataagaatgatgcaaagttctcctcaattgacctggagacaatgacatctaacatcaaatcatgaactctgcagctcctcaccttgccagtccaatcagtcctcacaggctgcacaatgcttctagccacaaactcatcaaagtaactttctgcaagctgttccatgctttgtccatgcctttggctgacgaaaccttcagctatccaccttctcaccaagggtcccctcttgatcacataattttcagggaaaatacttagatacaagaagcaggccttcagatgatagggtagatcattgtagctcaaggttaagacttgcttcactccttccagggtagggttgttttcaagttcagatcctaagttgttacaaaccttctgccactcctccttggtcctatttgtcttgcttgcgagaaggctgccgatgttcactattgctaatggcaagcctccacatttcttcaaaacggaatttgacacttcctcaaactcatcagttggtgatttatcatctgcaaaaccaaatatcttcttgaagaacagttctcgtgatgtcgtttctgatagtcgctggatattgtaaatccgatcttggggacgagaacagacgtgttggccacatctgcattccgggtggttactattatcctgctaccctttaagttgtcaggcaatgcacatctgatgctctcccatgccgatacagtccatatgtcatcaaggatcacaatgtacctagaagaaacagttcagtaaacaaaaggaaacgtggtaacagataggattagctaggaacaacccccccccccccccaaaaaaaaaaaaagaataattagcagtaaatacgcctccttttcctttgcatcggtaaaaaagggaaaacagaaaacgaattgcaaacaaataggtgaaaagtccttcattgcatacgatgttttttctcttttacactggatagtgtaacactgtaacctatttggatctttgttatatttttcaggtacacatgccttagatagtggaactttcaagattcatcaatactaaatagtggttgggccctctctctctctctctctctcctatatatatagatagatagatactagaatagtagaagaccttacagatgatttctccatcacaactcgtaaaactaattttctggctttgaatggttcacattgaatccaaattattaagccaactctaggaaattgagactcgatttgtatgatggccttgcattttgccaatggtggcttgagccaaatctctgtatctggttggttctatatgaataactagttgtctctggttctagatgtgaaggttttatctgcaatctgttggtttgttttctgctcccttttgaactatgtaacatggtttatttaatggaaatgagagggacctccttataaaatggatatggtcctatatttaagttaaacacacttatgttttggcaataaatacacaatttcaaattaaattgcctgacagttaattacatccagcaactacctcaaattgaataccaactggtcctataaaatggagacggtcctatatctaagactgccattttgacgttctacttcaccataaccagcaatatctcaaaagaaaatatggattatttttaaagcacaaactattatagttcactatcagggaggaataacaaaaaaactctggcataccttttgtcttggaaatacctcctgagattcttagtcagtgctgcaacctcccacctttccattccctccaggtaatcatctgtaataaggccatgcttgcatcctgctattgccatcgccttgtgtggctcctggattagctcccttaccatgtgctgaaaaagtgccctgatgttgaacgtctgtgaaatgatgaacaatggacagcactgaaaatcagcactcttcaccacagggcttccacacaccatccttgccagcgtcgtcttcccaaggccaccaaacccgacaatagcaagcacacgaagccgaaggtcctcttccatcagccagctgacgagctcattcctaggctcatcgatgccaaccagctgagcctcctccgcgaagagagcatgcaactgtggatcgatatggagagaggcatgcctggtgagtcttggatgtgcttcttcatgtgtggcctttgctagctccaccccgtaccttgaacgccggtcaccgacatcctgagcacgggccttcagttcttgtagctggagagcaattcggtgacgacaggctagcttgcgaagcatagatatgagcccaccaaaaaatcccatttctgatgactcccctaggttatggatgaactcatcaatacaatcctcagagtcgtaggctatctccctcacctgcttcatccagatcctaacttggtcgtcatgaatctgtgatatggtcagattgcgtaggaatgcattcatgcactcgagctcatccttgatgtactgtatctcaccatggacaccctgcaccagccaagtatcctcagttagaaggcagccaagcttgcacagcaggctcctgactgcaccctccgtcaaactgaagacagcaccctccatatcttactatggagcatggaaatggaaacactgctgctgttgaagttaggatgctcaggttatatttgtaagacatttggttagctaatggtggaagaataagaacattccagaattcagaccatggttttcctggtcaaggagacatgcaatgacaaggagacctgcggttcgccgctgatggcaaacagaaccctgaaacatgctgacaaggcaacttgacttcatgtcttacaagcctgataagcaaataatagtattcctgtggtgcataagaatatcataaaaagttacaactcatagaaaaagtcaatcagtacggaaaactcattgctgtatgtatatgtaagaggccaaaggcagcttaaaaattggtaaaagatccagtaatacttagagaaggtataaaagcagtggggaagagtatgaacaagtgataccctaaggtttgttacattcatagctggatgaaagggtgatccaaacaagtacccagacaaggacaagcagcactgaaaagaggacagaaaacagctaggtaactctgacattttgacaacacaactcatacgtgaaatggaaagaaggcggtataggacaacagtcgtatttttgtgatgaatagcttggtaagattggtaaagtatttcgcccgccttcttacatctgacctatgagattagagtgctacttgttttaacaatgtgaacattgtacaacaccatatataaagcagagtgagaaaactatggtagcaataagcagatgaacactaacataatcacagataggacgtggcgacagcaaagcaaggtttagttaataaagatgaaatgcaagtcaaagtattgaagcatattatatataaataatcaaaactgttagctagtgtgacacaatgaactgtaaaggcatatatgcaagtgaagcgaagttaacatataagagaatagtgcaggaaggcaacaagctactcgaggtggttccatatactttacagcttaatatgcaccgatcgcaattgcacaaataagataacaatggttaaagcattgcgtgttccccttgtaattttgtataataacctagtactagtcaccttgaaagaaatggcgatgtcgacataaatgcagaaaggcaatcaagcaaccattggaaaaacaggcacagttaccagcatcatcttgactgtagtgtttgactctcttctttttccccttaaagatttgcataaaagatgaaaccgagccacagcatatccagtcctgtgaaagagactccaggagctcaatggttccatttgagagcgcaaaagaaagttgacatggaagaagacaaatcaagcaccttgattgtgaagcacttcagcgggggccgagtcgagcaagacctaggagagcttggttgttacacctgcgacatctctgatctctcccttgcgaaacattcagggccagctgctcgccgccgctacctagtcaggcccttctcgtagactagctgggtgacgcatttcatcgaacacatgaagcacagagccgcccacccgcgcgcgctcttcgattagccaccaccacgatccgtgcttcacccggctcccttgaatcttctgcgcatgcgcatgcgcatccggccggaatctctacccggcacgtcctccgccgccgccatcgccggcgcggagggctgcggctgcggctctctctctctctctctctcttttccgaaagagacagtaaggacgcgtacattcataaggcgtcaccgaacttcataggcgtgtgcctcccccacgtgatacagaaatacgccttccaagcacggatgtgtgttttctacttttgtttaagtcatgctcatatgctatccttaggtgaaaggaaaatgacggtggtaatttttttagaacatttttttttaaaaaaatacagtacaaacgtagccctagaaacgtgcgtgtacttatctttttaaaggaatcaacacgagactatactatttcattaaaatagaaggaaaagtacaacccctagggataaaactatacaaaactgataaggcctagatacggtttagtagaaaatcccgtatcctccttgctcccgccatagcccaagttcctgcctcctcttttatttttgccataaggctaaggtcgcaatctccttttgttcgaaaacctgctgatttttttacttccagatttcccaaactattaaaagaattagggtccgcaggcttttcttggacacctcatttgtattggctagcatttcccaccaattttggacgctatggcacggagcccagtgacaagggtccacctattggtaggggcacttatccttataaacacacagcatatctctaattctttataagcacccctgaaagaccaggcatgtatatcttgataatgacaaagtctccacaaacgtctcattgttaacgggtatatcatctatccctgaaagaataaatatccataaatacaagcactcgtgtcaagcctaaaatttaaactcgaataggcaggttcaatcacaagaaacctaacaaagtagttgacaagcaaaatgttgtgcttatgaaataggagtacatttgataagtttaaactagcaggggaggcctagccacaacctgcagaacactgaagcaaacgcaagcttcagatgaaatgcttcttttactgttttacacctcaattgtacaccgtcacaatgttccatttgtcacctacaactctcggatgatttggatgatccttcacacatgacaccactttgctcaccacagatgatacgatgttgccaaagaactctacctccttcagtttcaggagattgttcagacctgagatgccatccttgggttctctcaggaatgacaatgtcagcctctcaagattaggcatcgatccctcattgaaatgcaacttttcaaggttcaccaggttatcatcgatcagaagcttgaccctggcaaatcctccctgtggaaaaacgaggcgatcatcagcatatgatttgtgatagagtttcaggcagagcagattttgcaggcctccaaggacatgtatggcatcagcacggagttggctcctgcgaagagtaagcctcgagacgcttctaagtgatgctacccaaggaggtagactaccaagcttgccagtcaggctgaagctagtgatgaaaatgggaggtgacactaaggaagaaagcatctccagtgatgagatagagatgtttccttgtgcgtcgaagatgtcaatggagagtgatcgcacagagccactcagcatattcaacaactccagaaagggcttccagtttacctctataccataaaagagaacactgagcttccgtagattttgcagcaaggcgatctcctggaacactgatggatgttcttttatctctacatggacaagtgattgcagctttgccatgtttctgatcactccatggctcatctttagacctgaggatggcctcaaaaacttcacactggatgtccttgtaagttgctctttgtgccctgctaacaaatgctttaggcaagtcaggttagctgcactactaggcagcttcttgataagtgtctctcttatatccagtgtctccaggtgattcagattcccaattaacctcggaagtatggacacactggtgtttctgaggcttaggtatttgagctggaaaaatctgcagatgcagtccaaattcttgttactcatgcaacggctgccttgcatgtccagcactcttaacaaccgcaattgtggaaagaagaatgggatattgtcaattgaaggtgacattctgaaggtgcgaacatgagctacactgttgcttgttctttgagctgatgagtagctactgctgcggatggagaggcggcggattttgtcatgcgaaaccagttcggttccattgtcacagaagaaggatgcaaagttttcctcaagtgacttggagacgatgacttcaagcattatatcatgaaccttgcagcttctcaccttgccactccaatcgattctgacaagatgaaccatgctcctgctcacaaactcatcaaagtatctttcaccgacctgttccatgctcaatccatgcctctgggtgacaaaaccttcagctatccacattctcaccaaaggtcccctcttgatcacatgattttcaggaaagatactcaaatacaagaagcatgccttcagatggtagggcagatcattgtagctcagagttaacacctgctttgtgccttcaagagtaggatttgactcaagttcagagcccaagttgtcacaaaccttctgccactcttctttgctcctgtttggcttgcttgcgaggaggctaccgatgctcactattgctagaggcagccctccacatttcttcaggatggaatctgaaacttgtttcagctcatcgtcgtctggcgctccggcatccgccatgccaaagatcctcttgaagaacagctcccgcgatgccgcatctgagaggcgttggatcttgtagatgcgatcttgggggcggcagcagcaggtgttggcgacatcctcgtttctggtggttactatgatcctgctaccctttttattatctggaaatgcgcatttgatgctctcccatgctgatgaagaccatatatcatccaatatcacaatgtacctatacaatgtaatagttccacatatatgaacaaactcggcaacaaataaaataattaactacatatatgatctgtttttttagctactacctgctactggaaggaaattttgtacaaccggcaagactgagttgaatagtagtaaaatcgagtttggttcaactaatcaatagattatgattctctaatagagaacaaataacccgagcaggagaaggttgaacttcatcaaacctacctaataaaactaataggataaattcaatggaagagtgtcattgttggaaacaattttgtgttactgtaactcattaattctccccctatattataagacattttggtttttctaagtcaaacatttttaactttaagcaattttatagaaaaatgtagcaacattttgaacacaaaacaaatatagtatcaaaatatatttaatgtttgatttaataaaactaatttggtattactacggtttttctataaagtcaaacttagctgaagtagtgttcttagttacttgaacattttctttttcttagtatagtaatactaatgttctttttcttagttgttatagtaatactggttagtatagtagtactacattgttgtaactcgagaaattaagttgaacaaggaaaggaaatactcctcgcgtttcagattataagtcttttttgactttgatcaaaatcaaactacttcaagtttgaataagtttatagacaaatatagtaatatttacaacaccaaatcagtttcattaaatcaatagttgaatatatttccataatatatttattttaggtcgaaaatattactttttttttacaaacttaatcaaatttaaagcaatttgattttaactaaagttaaaacaacttataatctgattataatctgaaatgaagggagtactaaccttttgtcttgcaggtattccctcagctttgctggcgagcgctgccgtctcccacctctccatcccctgcaatgcatcgtacgcgacaaggtcgccgccgccgccgccggcggcggcgacggcggccattgccttgcgcgggcgctggatgagctccctgagcaagtgctggaagagcgccgtgatgctgaacgtctgcgacacgacgacgagcggcggcgagcactggaagtcggcggcgcccttcacccgggggctcccgcacaccatcctcgccagcgtggtcttgccgagcccgccgaacccgacgacggcgagcacccgcagccgcggctcctcctccatcacccaccccacgagctcctccctcggcccgtcgatccccaccagctgcgcctcctccgtgaacagcgcgtgcagcctggggtcgagccgcccggacgacgacgacccgccgccgcccctgaccgccgccgccgccagcgacaccccgtacctcgtgcgccgctcgccggcgtcgcgggcgcgggccttcagttcccggagctgggccgcgacggagcggtctcctcctcctactcctagcgcgccggccagtaggcggacgaagcggcggagtgaggccacgaggcgaccttcgtctccggcggcggcggcggggtggctgcggccgcggacgaacacgtcgatgcagtcctcggcgtcgtaggcgatctccctgacctgcttcatccagaccctcacctggtcgtcgtggccggcggcgtcctccggcgacgtggagacgctgcggaggaaggcgttcatgctctccagctcgtccttgatgtactgcacctcgccgtggacgcgctgcgccggcgagctctcctgcgcgagcacgccggcgagcttccggaggagcccccgcacggcgccctcggtcaagctcacaatggcgccctccattgatttcctaacaccaaacgtctgaaaaaatttgcttcttaaaatatataaacatgttgaattttaaatactagctatctccgtcccaaaataagtttatttttcatctatcacatggtaccaataaaaaaataagaagactagaatactcatattttatcaattctcaatgcaattattcatcaattatctactcccagttatccctccgtcctataatataatgtgttcacgtattttaagattctaacatttaaaacatttgagcaacacttagtatatagtataaaagtataacataaaatgaatttatttgttaaaaattatattattagattgagatttaatttactttcatatgctacaaaacttatagaatatgagaaattagaagctaaagattagttttgaagactgtgccaactttgaccacgttttatattaccggatagagagagtacaattattccttactttcacaaattccgatgcaatgattactctaaaaatgaacttatcttgggacaaataaaatgagctaaaagataaacttaatatgggacagaggtagtataacatttgggctatcctctcatattaatattttttatacaaatatgtaaaaatatgatgcttaaattacttttaaccacaaaataagtcatgacaaatatcaaatgaatggtcggacaccgtggtgaaaagtcaacgacttcctatatttaaaaacgataatagtaccagtagtgaccatcaccctatatcattgcaatactgtgtggagagagagttgcgcaaaaatatgccatccgaagacaacctaaccatgtaaacaatttcacaaagaaacgaatggaatcgagaggattccccgctcttacaagcaaggtaaatacaatacagagttgtactttcaactactcttgacaaaccaactcagcttgtcttcttaggaacacaccctgaaaaactatcaatacatactgtccagctggttacactacactttctgcattgcttgaaataagcaatgcaaactacttcccaaaatgcaagcatttctggctttaagcctagacaagcttgactagattcaaagctagaaatacttatatttcgagatgaaggtacaagcattgcccaactagctagctgaacctgaacaccaaaaccaaacaggcctctagaagcaatgttgtttagagcttgctccttaagcgtactccgtcacattgttccatttgtcacctatcactctcgggcgatttggatgtgccttcatgcaggatgccactttagtcaccatggataatatgatgtcgccaaagaactctatctccttcagcttcagcagattctccagacctgtaatcccatccttgggttcttgcaggaatgctattgtcagccactcaaggttagggactgagcccttctcgaagtgcacattgcgaatgttctccatattatcaataaccaacattctgagcttcaaaaaattaccatgagcaaaaaatatatggtcatcagcgtaggacctttggtagagcttgagacagagcagattgggcaggtctccaagaactccaatggcctcagcgtggagtccagtgtcacgaaaagtaatcctggacacatttcgaagtgatggtatccaaggaggaagcctctgcaacttgcctttcaggctaaaatttctgatgaatagaggaggcgactctgcgataagagctagatattccagtgatgagctgtgctctttctcatccagaatgtgaatggagagcgagcgaagagatccagtcaattttaccagagactgaaggaatgcgttccagttctcttccacaccgcgaaacaagacattaagtttctgtaacttttggagctggccaatttcactcagcaccgctggccgctccttgaccactatatgggcaagtgattgcagagccatcatgttcttaaccaccccagccgtcatctccaagcctgagtccggtcggaagcacttcacgctggttgtccttgtaagttgtaccttgtgcccaactaacaaatgcttgagacaactgaggttgcttgcactggctggtaatctcttgatacgcgttgccctaatgtccagtgtctccaggtatttcagatttccaattagtcgtggtaatttgccaatattggtctttctgagtgtcagatacttcagctggtaaaatttacagatatagttcagagtactgttgttcagacagctggaaccttgcaagtctagtactcttagcagccgcatctgtggaaagaacattggaacttcctcaacggaagctgacattgtaaaggagcgaacatgagatacgctgactcttgttctttgcaccgaattgtgactgttatggatggagagacgacggattttatcatggcaaaccaatggatgtccattatcacacaagaaggatgcaaagttctcctcgagcgacttggagatgatgacttctagcatcatgtcatgaactctgcaagtcctcaccttgccactccaatcaattttcacaggttgtacaatactcctggccacaaattcatcaaagtaactttcggcaacctcttccatgcttagtccatgcctttggttgacaaaaccttcggctatccacctcctcaccaaaggccccctcctgatcacataattttcaggaaaaatacttagatacaagaagcaggccttcagatggtaaggtagatcattatagctcagggttaacacttgctttgcaacttccagggtaggattagtttcaagttcagagcccaagttgtcacaaatcttctgccactcttccttggtcctatttgtcttgctcgcaacaaggctgccgatactcactattgctaaaggcaagcctccacatttcttcaaaatggaattcgagacttcatccaactcttcatttgatgatatatctgcagaaccaaatatcctcttgaagaatagttctcgtgatgcagcatctgatagacgctgcattttgtaaacctgatcttggggacctgaacaacatgtgttagccacatcttcattccgtgtggttataattactctgctgcccttcttattgtcaggcaatgcacatctgatactctcccaagctgatatggtccatatgtcgtcaaagatgacaatatacctacaggaaaaaaagtacttatcactttatcagtcatgaacctatcatagaagataacagtgtttcttacccaaaacaaaaaggatagaaggaactacatatattttatataaaggagtgagcacattaacccacgattagcaaattaaggctttagggatgatcctgattttaaggggaaaatatatgtaccttaaatacctttatttgaaaaatacgaaaaacttagaagcctttctcttggctaacaaaacactttctagttctataccagttctgcatcacatccagtgagtttatttacagcaaaaaaaaccacctgaaagtgctatcagccagtaatcctggtacacagcataaaacttggtgatacgggcaacagtagggaacagggtggaaacaacctttccattcctatgtagagcagcacagggaaggtcgtgcaccctctatttctcatttagacagcctttctatgtgagcagagatcattggaaatcaatggtcaagatctgacataggactaaattctcctatttcattgctgaattgaagtaaaaggtgcatgattgtctttgattaaaccttttcgcaagcaatgcatcaatcatctagatatattcaccaaagcaggaaaaaggggagtctaacagataatcaattaccagtaaaataaaacaaaagcactagttaccttttgtctagcaaatactgcctaactttttcagccagcactgcaacttcccatctttccattccatccatgttgccgtccattgtatgaccgtgcttacctcctgctacagccattgccttgttcggacgctggatcagttcccttatcatgtactggaacagagtcctgatattgaatgtctgtgacacaatgaacaatggacagcagtgaaaatcagcacccttcaccattgggttctcacacaccatccttgccagtgtggtcttcccaaggccgccaaaaccaactatggcaagcacacgccggcaaggatccgcttccattacccagcggacaagtttatcccttggttcatcaaggcccaccagctgtgcctcctcagtgaagagagcatgcaactgcggatcaagatgacgagatgcatgcctggtaagccgtgggcctgctccttgaagtgtggtctttggcagcatcacctcatagcgtgaacgccgctcactgacatcctgtgcacgggcctttagctcttgtagctgcatggcgattcgatggcgacagcatagtttgccaagaatatagattagccgataaaggaaaccaattcctgatgactcaccaagatgatgagtgaactggtcaatgcagtcctcggcatcataggcaatctccctcacctgcttcatccagattctcacttgggtgtcatggtcctccaacacagtgaggtaccggaggaatgcattcatgctctcgagctcatcttttatgtattgtatgtcaccatggacaccccgcacgaaccaactctcctgggagagaagggagctaagcttggacaggaggctcctaacagtgccctcagccacactaaaaatagcaccctccatgtctaactatgagcatggaaatgcagatgctgctgctaatgcagttgtgttccctaggccacacacgcacatatatataaggtatccaatagactaaatttgaaagtgatagcaggataagagcgttgcaggcaatagtttcctagtcatttccagttctcaataggctacatttggactccagcataataaattgtacaaagggaaatatgttgattgcagtgttagctgatgacaaggcaatgaaaaggagacttcaggttcataaggtgatgacccgaatgatgaacaaacatattgacatggcatcatgacttctatttgtttattctattctccatagcaatttatgataatccagacgatccaattcacatttccactgccactatatacaagccaccttactgattgataaaggaatcataatctaagaaggtgc

SEQ ID NO: 8931 - DNA, 6114 bp, Oryza sativa
aattcctgcagctttggcaatatcacaattcaatgacagaaaggacaaggacatatagaaaggataacatagttttatcgtggataacctggtaactaaagttggtagaaaaaaagaactccatacaatttagaaagccacctaactgcctgaatgaaatgtttcacacgtatgcccatcccaattagtttactgatgcggcccatattaactaagtgaatctccctctacaagaagtgaaccccaggtaagatcctatataaagaattaaacattactgggacagaaagggaaaaccgtcagatcgcgccaactgtacaacggacaaacaaatcgccatcagtcaagaagtcctacaactaagaaagaactaacaccaatctccatcagacaaagatgatttatttcctgtcagacgtggcaaccacaaagcacctaaactgctacataagatatgaggtttggttgataatatgctaacaaatcaatgaaccacaaaatggcagtcgttatagcttgtttgatactttgacataacatgacgcaaagattaaatatgtcaagagaagccaagacactctaaaagagtgacgcaatgcaggctacatggagaggttccatacgcttgcttagcattcaccgagcgcacgttccaaatttaataacaagtggtggttgtgtgattattggatttggtttggatatgaacatgaatcagaggggggggaggaacattttggataaggactaagactatcatcaaacaaccaacacaaccaaatcacagcagcgtaccatttgatcttctcctcgaagattaaactaatgagagcaagcatctccctctgcgaccattggggtgattagctcgatgattcccttccagagttgaaacatttgcaaattgcaaaatagtttgcattggatctctttctcttacctgcatcggcatgtcgtcatatcagtgacctcaccggcaaagctatctccatgcccagactcggtgaggcatttcatcgaacacttgaacctcacaccgcagaggcgggttgccgccggcgaagtgaaggactcgccgccctccgctccgagcgaaggagtcgccgagtctcgccgcccttgaccgatcatctcgcgtgccctcgccggctggttcgcccaaccgcggcacccccgtccgccgcctcttggggtaggatggaaactgcagtctccgttcccgttgggcgattagcctcattggttgtcatgaaaagctaaagtaaaaaccaaattttatattggttttaagatattttcaatgtagttttattttccagcattgtctttattttctttgtctataaaaaacagatatgctacatcctaaaactagaatgtgttatatctcgtattaggtttgttttttattggacggagagagtaatttacttttaaaaaaacatatataaaagttttacaaataaattattttattttatggttagtggtcactaataaaccattacggcttattatttgttctggataaccgatgaggcccaacgttaattggattgaagtattttaataacatgctaactgtagtaataaaatgtttaaaagtattttaataagatgctaactgtagtggtaaaatgtttagccacaaaatattcgataaaatgtttatactaatggctaatgtttgtcaattttcattcgttttaatgcttatactttgaggtttttatttgctttaatgcctatattttaaaacagaagatgcatgccattgccgatgtttgccagtttttctgttttaatgcgggaacattcatcttttccattttaacgtttgctaggctgtgtttagttcagcgcaaagtttggattttgattgaaattgaagatgatatgactgaaaaattgtgtgtgtatgacaggttgatgtgatggaaaatgacttaagtttagatccaaacacagtcctagtttgccatttcgtttcaaatgtcagacacgtgaaatgacaaaaaatgggttcattaatttgccaggatgatacatgatctcaaattgtaagctagctcttaacagctactccctccatcccataatataaaggattttgagtttttgcttgcaatgtttgaccactcgtcttattcaatttttttttgcaaagataaaaaacaaaaagttgtgcttaaagtactgtagataataaagtaaatcacaaataaaataaataataatttcaaaaaattttgaataagacgagtggtcaaacgttacaagcaaaaacttaaaaaacttaaaatcctctcttatattatgggacggagggagtactatcaaaagcgccaagaaatcggttttttacattgacatgctacacgttaattgagaacaagggtcagcaaaagatagcgccttctctttcataacaagtaaattcaaaactttgcttccttccagtaatatcctcattcaaatggcatagacacacgaagaaggaagcaaacacatctcttggatctcgataacagtaatatcctcatgaggttggtacaaaactttgaagtggttacaattagcacagctcactacagcatttgtttcaaaaggctactacagcagtattcttggccagcaagttgaacagtgaaacattccccattttttatgtccgtgccgatcagattcttggtgctgcattacatatcgaaatgtgcctcaggttaaaggtaggagatgattaacatagaagacggatttgatagagactgccaccagcacaaaatacattacctcctccgattgtagcttcagggagtcgttctatcgagtacctgtgccgagtgatatacatgattggaacaccaggaacctaccaaattgagaacacaaacatgtaattagcataagagcaaggctgctgcaatgttcaggcttaagtgcttgtaaatgtacctttcttatcctccttttcaaatctctatcacatgttgcgacgatgtagcacttgtgctgttacagaaaagttgcagtttagcaaaattagcgaaattttttacacacaagctacatagatccaaatgattatcacaaaaactagtcttaaactttcagtagccaaccagccttaatttaaggccctctttgtttaggcttataagccaacttataagtcgaaaagtctaagccaaaacaaacaagcagctttttcatttggcttttttaagccataagccactctaacactattaatccaaaagctaggtttgagaagctttttttggcttatatgagatagatgtatgattttaccattaaacttaggacattaaatccactggcttataaatcatataagccaataagctgacttaaaagtctaggccaataagcctaagcctaaacaaagagggcctaagtgttcactaaaatgtaaatggaagctgtaaagatgaagagcagaaattggcgagactaaagaaagttatattagtaatttcaaaaggagattgcgaaaatttcagtaacccatacatgcatcatattctctactactcaactgcaagtaccgtcaagtcacctaacatctgctatccaaaacaatgctgccacttgcacacataaaaactcaattcgaacaatagaagttcaagtaggcagaattatacctgagtaaccctctctacgatacagtcatcagcataagttcccttgtgtgtgcatgctaatctctggaacctagggtcctttgcaattctgtaagaggtaaaaatagtatttattgatggatgaaaatcatagaaaattatattatagtaccaaacatcagaactatgtccaactgatactaatatgcatagaagacaatagctacagatactgggatagagaaacagaatgaataacggaatttgcaacaagtgaagaatataaattaaaggaaatgcatgaaccaattaccacagtaattattgggaatgaacatacctcaatgctacacgatacttttgtcccagcttttcaagctccgccataacacaatccgtgatacatggtgtgccttcataacaagatggtagactttgtcagcaaagccgtatgcatttcaaaatatgctaaaaaggatagcttaaaccctactcgttccattccatattataatgtgttttggatttgtcctaagtcaaacttcttcaagtttggccaactttataaaaaaatgtagtagcatttccaacacaaaacaaatatattaatttggtattgtagatgttgctacgttttttctataaacttggtcaaacttaaagaagtgtgacttagtacaaacccatcacttcttataatttgaaacagagtgagtaagaagatgcatgcttacattttgcataaaggcagtccatcattcctttctccaaatccaactgcataggtgtcaaagaagcatttagctattacccataagcataagctcagagaaactgttagttagctccataatccagtaaacccacatgaaaggaatacactctgaccaagaagggatgtagctagcacttgcaccagggatgggaaaagatacgatgatagatagatagtcaatgtatttctctgtcctagaaatgcaagatttctgttgtgtttgaactgtcaatatggacaatcacttggtcatctacccctataccctatataaagcctcataattcaattagttttcaatatggttctagcatctaataagtggctccaggttggttatgaaccttcttgcactcagatggatgtaaggcactccaaatgttatgttattccctctatttcacaatatttatccagtagatagagtagtactaggtctatctaatagatgtgatcataatccatattggttaaaaaatgattttaagtattgtgactcatacatctgcataccagaaaatattgtggagcagagtacaaataagttaaatgatgtgccagcgcttgttacacatgccctatactatatgcctcttattaagtgccaatgggcaataccattctgttatttgagggctgttgaatgacacttgagaatgtccaacagttacatactcgacacaattgagattaagctaggcttcacgaaatcattcagtggataaacagaagagcacctaattcgaagcctcaaagaacaaaccttgttctggatggagaaattgatgaagtttgtatccacaataacccggtatggcggcccgagcgctgtgttgtagctgaagaacagcgccgaagagacctgaggcctaaaataataaaccaacaagacttgattaatccaatcatcccaataatcgttaaacactttaaacaaatggatcccaaaacgcggtaggcactcacacattccgcccgagcttctccttctcgttatccttcttcttggggttcaacacatcctccttgtacctagaggagacaaaatttagggtcgcaacaaaaagaaccgaatcaccaagaaaccaataggagagggagatggtttgcctacttctggatggtcttcttggtgatgatcttcttgacggcggcgaacttagggcccttgctcttcgccctccccatcctcagactaaaaatcccagataacactatcaacaccagcagcagtctcgagcactacgcgcaccgcgggcggcggcggcgttagctctctcggtggagcgggtcctcgcagctgactgctcactgccggcggcgtgaagcggtggaaggggccgcgtgagacgagagcctaccgaccgagagcggcaggggcgcagagcgcgacgccaagtcaccgaggcgccgagctaccttctcctaccggcgggaggggcgacggcgacggcgacggcgacggcgaggcgggaagtgcggcgagccggagactctggcggcggcgtcgcgcgttcgaggagagtgagaagcctagggttggcgttgctgacttgagaggcctcattggtgggcctggaccgttgagttgggcccacctgtcagctaacactatgatgggccttttcaagctttgggccgttggatgcggcgagagatctgggcctctgggccgtcggatctgagagaagt

SEQ ID NO: 8932 - DNA, 4871 bp, Oryza sativa
tacgcgctgcaaaattttaatgttggtgcgttcaatgattaaaaaaaaagtgttccttcatgtgctatgttcgtggaaattctggctctaaggagaaccttttcctgaattgttagcccctggctataaaccagctaacgcaagtatctgtttttgaccaatttcaacatttttcattgcgggtagcatctcaactaagtttgggcaggatggagtcagcattaactgttctcaggcactcctgttttccctttggaaaggcagcaaattagtctacagtgttcagatgtgcaggtaaaaatgttagtggattgactctatccttgggaaacagtcacacttaatgagttgatagtgcgcatcacaagtccctgcatttttagtacaaggatcttgtttgcttgactttgtgtggttaggcctaccctaggattgatgccttggtagaatacttatccaacatccatcgtggccctattgctgttctttcacatgtagaagtgttggatatgctaggttgttgatttgctattctttttactcaccatgctgagtaatgaaattctgcatgaggaatagtgtaaccttaagtttcttttacatattgtttcttgtgtcatcatatgcatttctttttagcagaggcatactatgttccgcagaaacttgtgctctgatgatttgagaattgagatactcaaggcctcaagggatgatatggataccacaatatacaacaaaaagttcgcatggcaattggatctccttgatgtaattggctgagatcaatataaagcttccattatctaaaaaaaatatactacaaaaaaaatcaacaactagatgatgcttttgaaaaactcatgatctcctaattctgaagtcatctacttttttttcctgttgttcttactctacgtaacattgacaatagtcatggtagccagatagcttggtatggtagctttaagatcaccccgtatgagtatgaggtataatgcatcttgttcatatggagataatcaatatgttgaaaacttggcactttgcaatttggcattgtaaaatccagtgctttcttagcaatattatatctagtagtacagtagttactaatgttaagatgtctttatctttttcttgagatattatgttatccttttgcagtcgaacaaaacatggaattgttacctgaaaattcatatacatttgcagtaatcttgcatcgcagagaatctattcttcgatgctgtcattcactgtaccagacataaacagtacagttacgaaattattgtcgctgggagctgagttggatgggcccatcaaatatgagatccatggaaaggtaaccaatagcccataactatagaacatgtctatttccattgtttcttcaaaaaaattttgtgatactagttttcttttttatacaggttgcagccgtacgatgcatcgatgggcacatgcttggccttttcgaaccagcgtgaagaacctacactgcaatgtacataatgaaaaaattatttcaatttcttgcagatggtatgttttatttctgtggactgaagttgttgttgacagaagcaactgactgggcctgtagtgtctgaaacactgatgaatagttagatgggcatctctttctgttaagagaaaccagtatgagaattgaggtgctgtagctctttcgccaccgtttgcctggtaattgcctgtcgtattgcaatcggtagagagccacactgtcatggctctgctttataatggcctgaactattgctaacttggcaatgttctcatataagctttcaaaatctaatgcatggaatattctattaatgttgaagtcaagatgatataatttagtatctactttgagcaactggcataaaaacaacggtatttgatgcaagcacttaaaaaaatctgagctaaacataagttgttaattacgaccttaatgtccggctgactgtctgtagataggagcagatacatataccagcctttgttgtactagccaccagaaaccagtgatcagaatatgatcaagaatctgctggaatcctggctggagaagagaggcaaccagcttggttccatgcagaaacaacaatcaggattcagtacttgctccgtcccaaaaaaagacaaaccctaatttccatgtccaacgtttgaccgttcgtcttatttaaaaaaaattatgaaaaaaattaaaaagataagtcatgtataaagtattaatcatgttttatcatgtaacaacaataaaaatactaattataaaaaaatttcatataagacggacagtcaaacgttagcatggaaaaccagggtttgctttttttttttggaacgtagtcatcaacaacaaacctgcacccactcgcatgagcacatcaatcaacaagaccttttcttttgtcacatctattcatatagtaccatgcacaagtcaacctgcctgcaaagctgctctcccccaatcaatctcctgcacatgcactcaagaattccctatggttatttaacctttcaatccttgcatgtttgatattttgattgatatttgattgataaaggtttctcttttttttttctcttgggaactgattgagtgattggaaaaaggttagaactcactgcaattgttaatttgttatcaactgctccatgataaactggaaaatgatggttttattatgttgcaacttgcagtcagattagttgctgattaacagccagtgcctgctaaatatagcaaagcacacatttcctcttctctgtgctgattaatctctccctctctttgttcctcttcttcctcctcagacatcatctccaataatattccttcaaggaagccgcttcgattcccacatcggagatggcggcttcctccggccgccgccacgcgccgccgtcgggttaggaagggctcgaggttggagaggcaacaatggcgatcgcttcgtcatcgtcgtcgttgctgctgctgatgtttcttgcgttcttggatcatggcgccgcggtggcgaacctgtcgtccatcgaggccgccgtccgcgaccgcgcgttccagctgttccgccgcacgagcgagatcgtcgccgtcgacgtcccggcggtgctcgccggcgccggcgtcgaggcctcggcgacgcgcgtgcgcagcagcgccctgtgggccgatggcgtcaacgccaccgtgcccgggctcgccgtcgccgtcccgccgcgggtcgtcccggcgccgttcgcccgccgcgtcgccatcgtgttcgtccgcttcctcggcgacgcctcctcctggctgttcgacgcgccgcccgggtacgcgctggccgcgccggtggtcgcgctgctcgcgttcgacgcgtcggggcccaacggcggcgtcgcgctccgcgcgctcggcgcgcccgtccgcgtcgagttcagggacatctcgccggcgagcgggttcaacgccacggcggcgaggtgcctgaccttctcgtccggcggcgggaaggcggtggcggcgcacgccgtggccatggagcccggcccgtcgtgcgtggtgtccggcacggccacggggcactacggggtggcggtgcgcgtggagacgccgccaccaccgccaccgccacgaccaccgccggtgagggagcggtggtgggtgtggaaggtcggggccaccgccggcggggtggcggcggcgagcttcctggcggtcaccgtggtcggcgccgtgaggtggaggaggaggcggcggagggaggagatggagcggcgcgcgatgtgcggggaggagctcgggaggatggcggtgagggggagcaggatgccgtcggcgaagatggtgaggacgcggccggagttggtggaggagctaagctaacctccgccgccgtgagttgcaccggcgagccgccgtagttttcgtaaggttttttttttctcctttcgttttttaggtgtaattttttcttttcagattattacgagacaaatgtacagtacattaaactctttcaaaaaaaaattcacgtgcaactcaaactcaaattcaaattggattggaatgtacattgcagttgggttatgttaaattttgagagcaaacaccgccttcctttttcgaatactacttgcatagtttactttattcccttcagctcataaccaggatgggatttttgtcactaaaatgaacaaagagaaagcagtatttacccactttgatttattggctataagaaacagagaattattgtattttgatttgttttcacttcacatttcacacaatcttggcttgttcagtacctttaatactagtctagtatcccgccaaaaaaaaaaaatactagtctagtagtaagtagtacactctctgttcatggatttagtacctttaatccgtgacattgttaactttatttggtctaagaatttaaaactttaactattaatagttaaaaaaatatttagcttgaagacacaaaatcatatggatatatttttctttataagtacttctacaatattataattttatatcaagtattgtcgttatatactaatacaagaataatgttccaattcacacgccatgcactgaataaagtctacagtgccatatatttaaaaacaaaggtagtatataaattcacgaaaatgcacatgaaggggctgaggagacaccattacaaaatatacacacactttgatttactgtggctatggaaaaacagataagataccttcaatccatttatgagtgcataatatgatttagtagatatggaaaaatagatcacatatattgaatacttttttctctaagcagtttgcagaatttccagttgcacagt

SEQ ID NO: 8933 - DNA, 2024 bp, Oryza sativa
cacccatggacagaagctgcacgcctgcaccagcaccacatattgctcaaatttcggctaatgacagatggcgaaaatgtgcatttttgtggcactatcatctcatcaaactccaacataccaactcttctatgagcatgaatacagatttctgcctctgttaactcttcagaaactgaaagcatgtgaaaattcacctaaacatttccactcgatgcgtatgaccagtactccttgacgagctctcggaaaagagaaccttctgtttccatgagcttcgtaggtttgtcatactccaccactttacctggaggtgaatacagtttagtatagaacaattagccgaaaaaataggcattgtaagtcttttttttccttttgttgttggtcagtgttcactgtacgacgttaatacagaaagttagaagggatacattgttgggaaaatgcaaaaaagttaaaagcatcacacatcagtgaaaattggggaagcagaattatccacgcagtttcaactttcaagtataatccatatattccagaataagtagtgctgatccattagacaatgatcacaggataaatatatttctaataagttggcggtaagaaagacgtaccatcgctcattgcaaggaccattgtgcagtccataactgttggtatacggtgtgcaacagtaataacagtgcaatctttgaactctgttctgattgttttctgaaggatagcatcagttgcattgtctatagaggctgtcgcctcatcaagaactaagatacggcatcgtctcaaaagtgctcgtcctaaacagaagagctgcctttgacccatgctccaattcgacccatcttccacaactatatggcaatatcacagttagcatatgaataatgtagcttcattatatcatgctagaatatgagtatggcaaaagatatctacgaaaagaatggtatatgcagcccccaaagtatttctagctacaatttttgtgatgtaaatgaaaagacatattttgaaaaatacattggaaacagaggaagaggttctttaggcaactcgaatctcatttacaaagtcattttccgtgacgattcggcaatagtgctaaaagagtggaatttctaattggttttttaaagttcccttcatgaactccaatatatatcacaagtgtgttttcagcatttttagtattgactgcgaggatgtgctcagtgctatggatgtttttgaaaaagagtctgggactaatattggttccagattttagtgacatgtatttttccctcatgtggccaagctgttaaggaaggacacagaatgaattcaagaaatcaaagtacatatgaagcaatgtcccctaccaagtgaatccaatccctgttccttctcctggacagtctcaagaagttgacatttgtcaagaacctgcaagagacaatagcaaacataaggaatgattcctataaaggcgtccatatgcaaaaaaaggactaactaaatctgatgtagacttccaaagcctttggttatttaatcacataaactgaataaatcgccattgtcaagaaaagtaaacgacttccatgatttcaacaatacatcatggtaagcttatctaatcattgattacaattaaaaaaagtgaataattgtgtagggtacacatcttacctcccatatctgttgatctgagaattgcccaagggggtctagattgtatcttaaagtaccctggaaaagtgttggatcttgtggaatgatgcccaaccgtgatcgcaggtcatgtaagcctattgtggtgatgtccacagaatctatgattattttcctccagcaggttcaacaagacgaaacaaaccaccaatcaaagttgtcttgccacttcctgtccgaccaactataccaatcttatgtccaccttcaaatgtgcaagtaattccatgcagtacaaggggagcatcttgcctgtacttaatctgttgaatgaaagtcagtagcataaaaacttgttagga

SEQ ID NO: 8934 - DNA, 40317 bp, Oryza sativa
  unsure (1)..(40317): unsure at all n locations
tgcagacatatactccctccattccaaattgatctacatatagtttttttgaggttattcctaaatgatcatcatatttgtgttcattcattaagtctattcgttatttgtgcatttgagtaaatgggcattgatgcatgcatccatgcacacaagtatttataacccacatgtaatatcttgatttgctattggctaagaaatagtggggatggtgcatgcatcgagtttgttgttagagtaaatatagtatgagagttattagcttttcttggtcttggtgtacctatgaaatatgtagataaatttggaatggagggagtaagtgataagtagggatttaatcaaagtgccttttaggaagcgaagtgccaacaattatactggccatgattcctcttagacaatgaataatacaacccagaaggaacaacaaaagcatagcatgaacttgctacttgacagctgtatgattcttgatttcataataatcaagataaccaaaggaaacttactgtgccttcggtctttgggacctctccaagtactgaagctaaaagtgttgattttcctgatcctacctcgccacagattgcaactttctccccagatttgaccactaaatttatattcctcagagtatgtttcgacgggttctcatcccacgagaagctgcaggagtttagcgcaatgggatactcagtacccgctatatatttcttcctgcattgcccattcagctcaggagcatcaagaaattttacaacccgggtgaaagcaactttagcttgaatcacaactccaataacatctggtatctgtctgattggatcttgcacgagacgtagagttgccacaaaggtgaatacattgctagcattcagaggaactcttaaaagatagcaagtcagaaatgttgctgctgaaaccagaactggtgatgaccaaaacaggaaactgttgtatgccttcctaaggttgaatgctgacagccacttgtactcaacctccctcaacccctcaatgaccttcttgaaatgattttcccaagcatataatttcaagaccttcatatgaactaaagactcagacatggccttcaatctcacatcttgtgcttccataagtttactctggtacttgtgttgcagttttgccagtggagcattgcagagtacagtaataatgatgacaaccaacgacgataccgtcgcaagtccaactgcattgtaaaggattgccagagcaatgcagagctggacacttgttgtccaaatttggtggaaccaatacgggaattccccaatgcggtaggcatcgacagtcacatagttcattatttctccagaagagtgcttcatttttgctgagtttgatagcttctgttgcttcttgtaaatagctgctgacaggaatgacctcacctggaggcctaacctccgatgcggaaataccactgtctctgagccaaagattcacagaatttgcaaacgaacattgtcacagctagcacaattccttcatatttgaaggtcccttcccccagcgatacattgatgagtgccttgagaagcaatgggcctgaggataaggtaacaaccttgagcaatgcaaagaagcctgagatcagaatcccactcttatggcaagaaacaatggtccaaaatactgatggtgtggcatgtgactgcaactgcttctttctattcatcatctccaagaacatcaagtactgattctgcgctcgatcagtggagcctaaaagtggcatgtctttctcttcgagaggcttcgcgtaacccatcttcatcaaagggttcaaccaccaaaatgacatcacactgaaaaatccagctttagcaaaaggagttacatgactctctgaatcagccgtcccatgatccctctctgtattcagcggcatgtataaagcattttcagttgtttcataaccctcttcatcacggctgtgccgaatggcataaagaagaaggataagggctccaggtagcaaaagaacatctaaacaagctttaatggtgatctccttctctccaaccatgtagacaactgaacagcaacagatgaatgctgcacatatggtaagcaaaagcgaccagaatcgaacaaatgtagctccaagaaatcgaggtctgatgctaaaactgaaactagtaaggatcaaactgaatccttgagccaagatcacaagccaccaatgcggccggtaaatggaggtttcctgattgaagctaatccccaccatccacagtcctaggccaagattaagcaaacccaagcagccagtgaacactacagcagccaactgcagcagtgaattgaatgcgacaagctgccgcgcagatgctctactctttggaattttcatgagcaactgatgtacaagcgcaacagtgagcactgcaacaatggaaatcaccaccagatgattcacgcaagtcgaagaatccaatgtttccttcatagcacatgagaccacatcttgctcggagcaaattgggctcccacacaagctcatcgcccaagaacctgaaaaatcattaccccccaaaaaaatcaatgttaggcggtgtttagttctttggccaaattatttttgaagcatacggacacacatttgaagtattaaacaaaacaaattacagattccgcatgtaaactgtgagacgaatttattaagcctaattaattcgtcattagcaaatatttactgtagaatcacattgtcaaaccatggcacaattaagcttaaaatattcgtctcgcaatttacatgcaaattgtgcaattagtttttttttcgtccacctttaatgctctatacatgtgtccaaacgacacatttgatgtgatatttttggccaaaatttttgggatctaaacacacccttaataggaaagctcaaaaaaaaatgtgacagtccaaaagtgaaaagggctcaatgatgaatcaatgatgcaactgtcaagcacgagagaattgtgagaaaacaactaacttatgagggaacccatctgtccaatctctgttgcaccgtccgttgaatcagacagcttaaacctgcagcaaagcaaactagtcagagcaaataagtgaagaacatggactagatagggacttgtactgcacaagattagtactagtgtttcgggtggctatagaagctcaagataaccacagaaatttcactatacccagcacaaacatcactatatcaccgaaagaaaaaatcaagaaacttaaataagtcagcagaagaagagagaaaatggtaataaagtctaagattgcaatgtttcttcttaataagtcagcagaagaagagagagaccaaaaaaaaaaaaaaaaactgtatgcatgagtgttcatcaaccagctacctcaacagtcaacaccattcattcaccgaggaaaggaaagaaaatattcagggaccagtgatccaaacgagaagaacaaatcgcaaccaaaatcgcatcgcctaggggtaaaaaatctcgtcccctcgacaaatccccaagaactcccataggaattaatcaagacaatgcgattgacgttgtagattcacgatgccctcgagcccagagcagccgcactggagaagaaggaggaggagatcacgggagaagcagtaaccaaccaaagatcaaaaaacctttttactcaccttctttttcagctctccaaagcacgactccccaaaaacagcttcttttcttttcttttctttttctttttttcccctccttcctgcgccaaccaaacaccttcccaatcgtggcccccttcttcctcgccgccgtcgcactcgtgtgttgaggcgagcgaacagcggagacgacgagacgacgcgctgggcgcgcgcgcgcgcgggtggtgtttattataggtggcgcgcgtcgcgtcgcgtcgcggcgcggcgcggcgaggcgggtggcgcgcgctgggcagcgcgcgaacgaacgtgcgatgtctcgactctcgacttcgtcccaggtggcgacgacgccgacgtgccggtgccgtggcgtggccgctggtggcgtctcgcgcgccatccgtttcactggcgcgcccggcacgtgttcgactcgttgctccgtccgcgcgagccaaggttggcatactcacgttgccgaaacaagccataggccctgtttgggcttttcccaaaagccgcttctgctagaaactgccccaaacaattcataacttctgagaatatgtagttacagattttaaaaaatgaactaagaagccaaaagctggagaagctgggtttcggagcttttctagattctcagaagctggctaccaaacagctgtttctcagaatctaaagctcccccgaacaggcccataatcttattagctagcctgcctgactaataaaatcaaagccgcacttttactataagaaagcaagtttgcaatgctttaatgtgttaataatatatgggacacacatcctgatgaagaaattttatcattaatatggcacgaactaaatgaacgtctaatttagtcaaacatgtctcattttagatgtggtacagtaaggtaaattgtggtagtgcaccaaacaggctctagtcacctagtgtgaataggtgactctggtcaaacgctgctcttctttaagacaaaagaaaatgcgcactggtttttcttattagcagtttagcacatctctgcgagattcgtggtgtcttgaaattgatcgacaaatacactctatcattcttactaggagttatcgtgatattaacaaagtcaatatatatatatgtatatatatattactgataaatatatctgttttactaaacaataatttattataaatacgaacatccgtgtcaaattgaccataccataaataaagttaagtatgttcgatcaagttacttatcgtttgatcacgtgttatagatttcttcattattacatgagctttgtatctcgttgtaaacttactctcttctagctaatatatggcttttaattttattagtcacatgttagtaaaaaaaagtatggtgaattttgacgatttgagtatgccaatcaaactaatactcaccaacgagcttgattcccaattccacgtaaagttctttaggtgattatatatgtatatagatcgaccgagttcatgattagtactagtgtttagtaaataaatttactaagggcatgttcaaattgttttcaaaataaaccttattaaattttagcaagttgacatattactaaaataggatttttttcatgcatttaccaaaattggcaacaagctaaacgtagacatttttttaacaacttttttaaaaaatggtataattaaaaatggtatcattctgaacaacccctaacgttacttcataaatagaactctcttgatcaaccaccactactccataagtagaactctcttgatcaaccaccacatgtcataccatatactccctccgtcccataaaaaacgaatatatagaactgaatatgatatatcatagtacaataaatctggacatatatatgtctaaattcgtagtattggttttttataggacctaaaaagagtagccactggtgcgactgcagagcagagaggcagagtggtcaccggcgcaacgccgtgcattcatcagcgccactagtgcgagtgtgcgactgcagagagccagagcgatgatgatggtgattggccctcaatagtcccaagatgagaccgttttaaagtttccggatccatctcaagatcctagtatttagtttatgaattaaatgaaacgtaatagcacatgacctcactgctgccttcacccaaattatttgtttgcaattactcctacttgcaaggagtggtggaacgtatacatctatgtttctattcggaacaaatacgaattactccctccgtttcaaaatggttggtatcgttgacgttttagcacatgtttgactgttcgtcttaataaaaaaaatttgcgaaatatgtaaaactatatgtgtacataaaagtatatttaacaatgaatcaaatgatataaaaagaataaatagttacttaatttttttaataagacgaatggttaaacacgtactaaaaagtcaacggtgtcaaatattttgaaacggatggagtacctctctaaactatcacggttgctcgatttacccccctcccctaactataaaaccagacattttacaccctcaattgtttatattggacaaataacccccctaaacactgttttgagcggttttaactggagcgtgcacatgtgacgccaacgtggagatacagtcaacaaaaaaaattaaaaaaaaacacttccctggacccacctgtcatacccctcccttaacccaatccttccccaccattctctctggcgcgcacacatactcgggtggctggctatggaggagaaggcggaccgggcggccggcggtggacggctaaggaggagctcgcccgcgcggctgaggaggtggactagtgtaacgacccacctctcctaggccgggcccgcttacatttgatagctttcataggtcggtccgatggcagaggcggagatcgcccgcgcggctgaggaggtggactagtgtaacgacccgcctctcctaggctgggcccgcttacatcgcggaccgggcggccggcggtggacggctaaggaggagctcgcccgcgcggctgaggaggtggactagtgtaacgacccacctctcctaggccgggcccgcttacatctgatagctttcataggtcaatccgatggcagaggcggagatcgcccgcgcggctgaggaggtggactagtgtaacgacccgcctctcctaggctgggcccgcttacatctgatagctttcataggtcatagactgtcctcacataccaacacaagaggtagactagtgtaacgacccacctctcctaggctgggcccgcttacatctgatagctttcataggtcatagactgtcctcacataccaacacaagtcttttctgcacactttgtcctcactcgtgtgcacccgggaagaatttcccggtcctcacataccaacacaagaggtggactagtgtaacgacccacctctcctaggctgggcccgcttacatctgatagctttcataggtcatagacacactttgtcctcactcgtgtgcacctgggaagaatttcccggtcctcacataccaacacaagaggtggactagtgtaacgacccacctctcctaggctgggcccgcttacatctgatagctttcataggtcatagactgtcctcacataccaacataagtcttttctgcacactttgtcctcactcgtgtgcacccgggaagaatttcccggtcggtcacccatcccgatattgctccaggccaagcacgcttaaccttagagttatttcgagatcggcttctggaaaagaagttgcaacttattgatatgagtattctattaatcctattaagccctaggccgggatgtcacaactagatggctggcggcagaggcagagaacacccaggcagcgggcgactgagggggagctcgcccgggaggcccgcggcgaaggcagagatcgctcgggcggtgagcggctgaggtgaagctcacccgggcgcccggtgaaggaggcagaggcggaccgagcagccctccccaacgcgcctgccacttgccctcccccgctgcgaccttctccgttcggaccaccgccgcggccttctccgcccggaccaccatcgccgccgcactacaggaaaggagagggggtgtgctgggagacggcggcgggcttgtcgcctccttcatgagagctacgactccgccaccacagatcccgaccgacggcgccgcgatggtaggtcaggcggtgccatccacgcagaggctcgaggcggagccgttgaccctcgaggaccgctgttgcctagccttctcgctcatcgagatcgatgtgcgagacacggccgagggagaggatgtggcgaggacgctgccttccgccggggatgttgccgccgccgccgccacctaatgcacgtcatcttcctccgctgtctcatggtggccatcgtcgccttcctctgcctcctcactgctcctgttgttgggggacagagaaacagagatagagagagtgcgatggaaaggagaagaggtggaagaagatgctgacatgtggagcccaccgattttttttctgactagattgccacgtgtgtgccacgtagaatcaaaactgcttcgggctgattcagggggtgattcatccaatttgttaagttcgaggtgtaaaatgtctggttttgtagttaaggggggtaaattgtacgaccgtgatagttcagagggtaattcgtactttttcttttctatttttaaccttttttaatttacttcaaacagtgtcaagtcattttgggcgtgtttacttggctgcttcggttgcgacttttagggactcttgtttagaagctgtttggtttatatgatttataagtcaataaattttaagtcctaaatttaatgatggagtcatatctctacctcacataatgagaaaagcttttccaacctagcttttggcttaatagtgctatagtagtttgcgaaaaaaactgcttgtttatttagtcctagattttttgactcataagctaacttataagcctaaacaaagagttttgacgaattttggttagtatgttttggggttgatcatatggaatgtgttgggctttggggtgaagccttatcaatttttttagagcttttaagagtggaagctacgggaattaccaaaatttgtagggtatcaatgataaaatatatttagtttgttgttctagggttgaaaataattacaaggtaaataggctcttcgtgcgtagcttgtggacaatgatttcacttgcagttgcacttggttgtcaagtcattttttccctgccttgttagttgttagaagtattaagtacttcccctcttataattatttgacgtgtagctcaatatttggcatttatgaaactcttaaccatcattagttctctcaaatgctcagttcttttttttaaaaaaaaatatagtatatgagttggtttgccttggaaagtactattatattatcataaaccattattttgatgggaactacggtgagcatttgacagcatgaactttattgatgtttaaaagatggttttacaagatggctgtattacagttgcactggtggggggaaaggattataaattgcctcatcttctcgcttatgcttatacttatcagtaaaatttgatttttcaaccttaaatttagagttggttttgaggttttttcattgaagtttaattttcagtgtttttagatcgctaagaatatgtatataaaagtttttttcacaatttatttttcgtttacaaatagaccgtttggctaattccccccaaaagtggaacgatagggccgtataaccctgcatggcaagagcatatttggcggctgctttgcagcttcggttgatttttacaaatatgaagtccgcttttttcttatacttttatacaaatacaaatgtgagagcaaggataatagtgggctataagcaaactatatgcttaggtggaagagagagataaacaaaagtggggtgtgttggctcttatgcaagagctaactacacacaagctccaagaaatatgcattaaattcatagtgagagaaagagagaggataaagaaaataaagatgaccttatagccaacctactatacatgttagctttaacattgactaatagtaaacagtgagctatactattattaaacttgctctgatgtagtaactcgtacagcctgtttatgttactttctgtagtctctctaagcaagcatcaaagtcttgagagcaatacacaaacgacagtagcaaaatacctgctccaaaatttgtgtcgtgattgatctgaagctaagggtaccctgtactggtgaccagacacttagtccctgtttagatgagactataaaacttttaagtccctatcacatcgaatgtttggatattaattataaatattaaacatagactattaataaaacccatccataatcttggactaattcgtgagacgaatctattgagcctaactaatccatgattagcctatgtgatgctacagtaaacattctctaattatggattaattaggcttaaaaaatttgtctcgtgaattagctttcatttatgtaattagttttgtaagtagtttatatttaatactctaaattaatgtcgaaagacagggactaaagttaagtccctggatccaaacaccacctaagatcttgttgagtagtactactaattattgtcccgtcaacctgcacaattacacatcttaaattgcactcttaaacctgtcaaattggtacagtagcagtacagttggagtatcaaaagcagtcaaccccaaggacaataaacttatgggaaaaatttcaggggatcagaagaatttcaggggggaaaaaaggacaccgaatgaaacggacttcctggcagctttgacaccacgtgttgcagtttcagactttttcaggtacagacagaaatcttaacttagggtgtgtttgtttcacggtcaaggttggatgggatatagcgatctatattttattggatatgtcaatccagtttttttgtttgggagagtgaatatgacgatccagttatttgtttggttgtagggatgaagatggatttgatgatccatttttttgtttggttaggaggagtaggatggatgagtggttgcaatcacctcatcattagaggtggtgagtatacccccttcaaattcaccaaacccaaacattatcaatctactgcaaaataaaaaatcttaagagaaataaaaaaatcacaaagaaataaagggaaaaaggagaaaacagaaaaaagaaaaaaaatcacaaatcttctcgccgcctcgctcctctcgccggctgtcgcccgcctcaaccgccgcctcgctcctcttgccggccgctgccccgctcctctcaccggccgcccatctcaccttctccagatccggtcgctcctctcgccggcccactcgtcggctcgctcctctcgctgctccgcctcgtcgctcgccaaccgccgccacgctcgtctccttccccaccggccgtcgcgccgtctccttccccaccggccgttgcgccgtctccttccccaccggccgccgccccatttctcccagatccagccgtcgtcgtcgtttccatccccaccggtcgtcgccggtctccatccccaccggtcgtcgtcgtggtgcaccggccgctgccgccgccgcgtaccaggcgctgcctcacttgcgtcgtcgtcgaggtcgcgtggtgaggggtgacgcgacccatgttggtcgcttgccccgctcgcccaggcggctgcatccggccaaatcggccggatcccccatccagcatctgggaggaatattcttcttcgggccgccctatcccacccccgcccaccaaccaaacatccaccaaagatggaccgtcatgtcctatctacccaaatccctctatccaaacacacccttattgggtcgttggatccatgcaaccgtcaagctacttaccgtcaaaaaataattatgggtcactcgtttagctagcacaaaacgaagtttgcaatgtcatctgaagacgaggaaattttgtattggcaaattcaccaagcagaaggcagaaagggacctcaagattggattgatcatgtaatgtatgcgtgaatgattcattctttttttgccccctcactttcttagacgtatatacgtccatgtccacgagtacatgtttgcgattggaatgaaaacatggctgtgtcgtttataagttaacaccggcatcattcaagactatattgattgcggggttgtgtgtggggttgagtgttcagtataccatccttcttaaaaataaatttatttatagagttctgtcttcaacattgattgatcgtctgttttatttaaaaaattttataattagtattcttctttatacgtggcttattgtttctaatttcttcataaattttgcagataagacgattaaacgttggaaagaaaaaaactcacgaatatattttgagaacggagggtgtacttcagttgtcttgtcattttggttgttgtgtcttttttttctttggagaaatacgtacggagtacaggaatcaatcgtcctgtattgtcgccgaccgatgtcgatgcgtgcagttgttgcgttcgcgttctcgtcctcgcctcgcgcctgacgcgccggctgctgtcagcgacctacctacctacatgtacgaaacataccctgtgttacggacaccgggtaaatctcaatttctaacacaagttacgtaaagtactctatctgttctggaatatagggtattttgtactcttaatatgtccatgaatataaaggagtttaaggcctcatattttcgtttatacttgtcagctaaaatttaaatttttatcttaaatttaaaattgattatgaggttttttcatcaaagtttatttttcaacatttacttttaaatcgttaagagcatatatataaaagttttatttataaattatttttcatttgtaaatatgccatgatgggtccgttaatttacccgaggctaacaacgacagaagtaatcgatgccagccattagatattaagtactccctccattccaaattaatctacatatagttttttttgaggttattcctgaatgatctacatatttgtgtcaatttattaagtgtattcgttatttgtgcactggagtaaatggacattgatgcatgcatccatgcacataagtatttataacccacatgcaatatcttgatttgctattggctaggaaatattgaggatggtgcatgcattgagtttgttgctagagtaaatataatatgagagagttattagctttcattggtcttgtgtacctatgaaatatgtagatcaatttggaatggagggagtatccaccagttcccatcaaaataaaaaaacaaagaatgtacaccgttcaacctgccaaagtttaattaagtacacccttcgtcacattttaaacgcaaccataagtttacgtgtctaattttaatcgttcatcttatttaaatttttatgattagtatttttattgttattagatgataaaatatgaataatactttatgcgtgacttgtattttttttagaaagattttcaaataagatggatgattaaagtttgatacgaaaactcatggttgcacttcaaatgagaaatgagagatagtttattccccaaagatgtactttgtgcagtttattcactgtgccagtgtgtactctagatgtctgagatgcactctttcatccttcttaatttgtgctaggtcagaaataatcccctatatatacctggatggagggagtgtattgtatctctatcattgactaatgaaatatcctactattaaaaaagtgaaataatataccatacctctataatttttagagtaaatttcacaaaactacatatactatgactaaattatcacaaaactacatatttaactcagtgtatcacaaaactacacatttaacaccaaatttataacaaaactacacatttaagatgaagtgtcacaaaactacatgtttagtaactaaattatcataaaactataggtttagaaccaatttaaccacaaagtaataatatttatagccaaaaattgtagttttgtgataagtttaatattaaatatgtatttttgtgatacttaatctaaaatctgcagttttgtgatagatttgatgctaaatgtgtagttttgtgatacaactccttaaacctgtagttttgtgataatttagtcaaaatacctgtagttttgtgaaatttactctaatttttatttcaagttcctcaattacactgcacggtgcacacgtgtggcaactgttgctccgtcaaccgggttttggttgctcgcattgtttgcagcactgtccatccagtcctgctctgtttctgcggcaggtgactggctggtcgctgctgctcttgaatgcccccattacaatagatcgaccaaggatttctaccaagaaattttaaattctttgggaatggtaggagatttcggaaagaggttttggagagaagtctgtgtatgaggtgtaatctaaaactctctgttttatattattagtcgttttatttttttttctaatcaaactatgttagatttgattaagtttataaaaaattttagcaacatccaaaatactaaattagttcattaaatataagattaatatatttcataacatgtttattttgtgttaaaaatatctttttataaatctgataaacttaaaaaagtttgactaaacaaatagttaaaaagacttataatatgaaaccaaggaggaagtattgaaaaatttcctttaagcctatgctccctctattttacaatgtaagtcattctagcattgaatgaattacaatataaatgtgagaaatgctagaatgacgctagaatgacttacattgtgaaatggatgaagtagcatatcttatcaagtgttttttcatagcctattcaaatattcattcatgtattcctttcctttttatatgtatatctattgagttctttttccgtgttctgtcaggagttccaaacgaggtttaaggcccgtgaaaataaaatattccatgcgtacgttttcaaataatcggcagtgttcactttaaccaccgataacttttaaacggttaaaatatgatgctgaaattttttatgcttatattttaagctgcaatctactccatttcgatactatacattgacaatttttaatagtgtttatagtttctctaaaaaaaaggaagatggccggtccacgtctgaagatgaatacacattgttgattagtaattaatggagggaacacatgaataactctcctactacgtatgttctagtcaaagaacgcacgtgacaatttggttatcaacgtcaaatatttaaattggtggtggagctgatgacaacggtttttagagcacctgcaatagtaaagtaaggtgctctctatataaaacatgtacatctcagcaatagactcgattaatagtaaaccaccttaatagtatgtctatattggtatctatagctctctcatgcattgtctcgtttttctctatagactatctctaagttagtagatagctttcctctctctcttcatttaataccttccaagtaggaaaatatgctgacatggatctcttgtagagagcatatagataacctgtaacgctccgcttctcgtgagtcgttaaaaactaattcgccaaaatcctatatgcgaaaatctcgttctttgtgtgagagtctaagttgtgccaagatctcaattcaaatctccatcgttgttctctctcgtcgccatcaaaatcctccacctcaagtttccaatcccgattcaagactccaaatcaaattccgaaattcaattccaaatccaaatcccttccaaatcagttctctgtgaaagtctagtttgcctccctcaagtttttgtgggtcgaatccttttccctcggcccatccctcctctcagtccgtttccctctcccctcgcacgtgcgttgcacgcagccgagccgagaaggagcgccgtttctctccctctctctcgttttctctctctccgacgccgcatccaccaccgctttgccggttcccgccgccgcctttgaattccgtcgtgccctcgcgtcgcgcgcgcgcgcccgcgtggtcgccgcctgcaccgcccgtgccgcgccttgcctgcccgccgcctaaaatggaaggggcaaagccccctttcaaccgccctatctccctttttccctctccggttcgacctctctctctcccgcccttgtccacttgcgcttggagacagagacgctgacgccggtgcgccagttcgccgcccccaccttgaccgcgccgagctgcccctcccgcgctcgcgaatccttttccaccgcccgatccaccgccttcgccgctccttgcatcctcggcatccgccgctcttgcatcgcccgtgaccgccaatgtcggttccctctcccaaaccgacttcccgtgcctataaaaccgcagccgagcccctcctctcaacccctcccgcttcactctccacgctgccacgccactgtcgcccctgccctgcagtcgccctcaccgcccgtcgccgaagcaccagggagaccggtgcgtgcgaaggacgcgagaagaggactccgggcacccttctccttccccttccccggcccgaggccggagagctcgccccgcgccgtcggccgcccatcgctgcgcccggctcggtagtgcctcctccgttctccctccccgctctctctctctctcatgcccttagcttttgagctagcaaccgtagcactaccgaacgcgcgtggacgccgccccgagccccgctgccgcccggcatggcctcgccgccattgccgtccgctcccggaggccgccgctcgtcgccggccctcctcggtgcccctccgtcccatccggcgccggaaacgggttccccaactcccatggatgatcccaccgccttgaatcgacctctcgtctaccgccgccgtttcccctctttgctcgccgccggcatgcgccgccacgattcgtcgtcgccggcctccctccagtgaatccgggccggtgattcgcttcctcttgtccctcccatcactccggtgtcctccccctcccttgaatccccgtgtgctgcctcggcgaatgtcgccgccgtccgccgtccatctcggcctcccccatcttcctcctcccgccggcccgcgtggctgccacgaaggcaccacgtcggcgccagctcggccggactgggtcaaagctgacctcggtcagccgcctccctccgttcctcactcgcgcgcggggtccacggagagccgagaggctgcgcgtgggcccgccgcacaccgcgtccacccgtgcgccgcgcgtggaccgcttcctccccgaaccctagcaccacccttgcgtatgcccatccctccgtgagccgtgtcaccgacaagcgggcctcacccgggaccccgcgaggtgaacttggtccaccggaccgctccctctctcccgcgcgcccctaatgggccgcctcctcgcgcccgcgccggcccatttggttcggccgagccgcaatagccttcgggccgcgccctagccgcccgaaggaagtctaaatgacatccctctttccttttctttttcaagggacttaataaatcctttttcctttgtcccataaatcaattccttattccaaaattccataaaccattcctttggtcccgcacgtcagtgactgtcaataatattcttgagaatattatttctataaattccataaatcatctctcctattccagaaattccgattaagcttccgaaattcatatctctcaatccgtagctccgattgactccgttccagttccaataattttgtaaaattgagatctatttaatggcactattatttagtctaaataggatctttcttttggtcttttgtttaggtttttgattgtttgcgtatagttgcggttaccggattttcgtcgatcgcgggttttctcgaagattcgtgaagcttcgtgaagaccttgagcaaggcaagtcaccctttgatcaattgctcctataattggaaaatcattattattttgtttgcaacttgcattattagaatcactcacttaacttgcttggcctcggtttgcgtgccaaaccgacggacctacccagtagtcgcactagttcctgtaggctgtactaccctgattccttgtcgctccacccttgtggtacttcggtatccatgctctctgagcgcgcataccaaatatcccacatacaccattgattgtcgaaaacttgggaaatgggtttgtgaagccttcaaaacccgacatgtggtgtcggtgtgtttggaaataaaatgaattgtgaaaactcgcgatgcgggggttgtgcctatgtggcactgtcccgtattcgcatataaggaccgattcctgtgggaaactcatcgagcataatcaaagtgcaaccacaaggtggaataggacaccctggctaagtaactagtcggttcagggaaacctcgcatgccaatagttaggaacgccggggcggggtcggacaaaccgggttcctggtaaggcaaggacaagaagcttgctgacttaccgatcaaggtggttggagtttgatttgtgaatgcctaaaatggcctatacttacgtgaggatttgatccttctatgtggcatgaggtaaccctgagtcggcttgggaaaggctttgtcgcgaacctctgacaccggccagtgtctggagtaagttcgtgtcttgtgggtaaagtgtacccctctgcagaggttaactgactgttcgaacagccgtgcccacggtcatgggcggatgtgaggtggttcccgttgcgtagatttgtttgcctgttgtcgagggaagacccccgatcgcggggagtcgcgtgacccccctttcgtgagttcggccgggggcagagactcgtctctccgaagtcgcgtgttcgtccctccgatccccggttagctagcacacaaatggattacccaggttcaggccgctctggagcgtaataccctactcctgcgtttgggattatcagtgaattttaaaaggtttccctccctcccctttggtgggcaaggtcctccttttatagcttaaggggataccacatgcgccatctctaccctccctctccatcggagggaggggagggggcccttctcgctactgcgaccgggtttcaacccgtgccttttgctggaagctaagcatcggtcggtccttgagtggggcccagcgccgtctccctcctgacacggggggcagccctgtcatttcctcataaacaagggaggacttgcggcagccctgcatcgaacgccgtccggatgtgatggggcgtacctaccgccactccactgagacagaggcgacgtgggggcacgaccgcccgtccaatcggccgtgaccggcaatagactggtcacagaccggtcgcatccgactgacaggggtcggtcgggcgcgccgcacgtctgcccccgccgcattgaatgcagcgagggacggttggggcgctgcacatttatggccgctgtcacgcccagaagtttccccctttttccttgctttaaaaatttgttaaataaatcgtccgaagaaattatcttaattaacctagagctaattccataattaataaatgcaattaataatcggaaatagcgtggtggaatttttcttgagttccccatgctccaatacattaacaagatttttagttgaattttcagagccttggaaataatttttaccaattaaaaatcaccaaagtgcaattataatcccaggaaaatccttttttctcttttttcttttcttttccctccttttcctttgttgggccgtcggcccatccctctcccgcggcccctcctccttgtgggccggcccaagccgcccctccctcctctcttgggacgccgacaggtgggccccacctgtcggtcgtctcctacctccagccgttggagccggagctccaaccgctgccgccgaaaccgccgcgccgctgcctcctccgctcctcccgcgcccacgccgcgccgctcccgcgtcctccccacgtcgccgccctctcccccgcatctcccggcccgcgcgcgcgctcgcaagtggcgggattcgaatttgaatcccccattctctgtctctccacccccacgtcgccggccaaatcggccaccttcccggccacgtctgcctcctcccgcacctttaaatcactcccccgagctccctctctcgtttcccccatttgccgtcccctcccgtgcctcctaccgagcccgcgccgctcgccgctagcgccgccgcttgccgccgcctccggccgcacgctgccgtcgctagagccgtcgcctcgccgcgcaatcaccgccgctagcttcgccgccgcgagagctacctcggccgccgctcgctttccgtccgccgccgccggtccctgccgtcggtggtcgtgcctcaccgcctcctcgcctcggtcggccttgaggccgagctgagcccggccgatgcctccctccccctcccttttctccccttcacgcgtgcgccgccgcctttggccgtgccgccgctccggccgtccgccaccgcctttcgcgccgtccgctgccgtctccccgcgccgccggcggtcgtgtgccgtcgccgctcgccatggccggccggccggttttgaagccgagccgagccgtgcctagccgccgccgtgccgtccgatcagcctcccggccgatctggaccgtcggtcccgtggaccggcggtggaccacccgcgtggtcccggtccacggtggaccgaccccctttgagccgctgacccgtgggccccgcctgtcggcgccgccccccttggatgacgtcagccctgggtattattgcgcaataattgattaaggacttttttctttattagtaaaaacacagtttatcttctaaaattcatatctaattcatccgagctccgtttaagtccattcaagtctcagtaaatcaagaaaaatgcaaataatccattaaaatggttttgtttcctgtttcagtagtcttatagcatgttttgcttgtgtgctttgtttgtcgcgtagatttcggccgtttcgtcgatccgcggtttctcgaaggcattgctgaggtctcgtcagtgcgagagcaaggcaagtcatgcattataattgataatattgtacccaatttacaaatatcccgcatttctattaaatgttgcattcttttacaatgtcatgtgggatgggtcctattacccagccatatattatttaccttatgccattgataacttgggtatcaaaatgattagatgttggtttaggaaatgcttagccatgcctagttcaactggtacacaaatggggattacactattacatagactctaactatgagcatagctttggattggtgacaccgcaagggtgttggttaattaaaatacactgaattgtgggctgtgggtgcatggttttgctggtcgcacccatggcaattaaggaccggttcacgggaaaccctgggagacttgccgtgcttaccacaagcgggagtgggtaactgcttgatctgaggtatagcttaacccttttctaggcaccggtggcgagggtgggcgtgatggagttgggtcggccggggtgtccggttgtccagctgccggatttaccgtggcgcaagaggggaccgcccactgccttttgaggggtgggggtgaaaccttaacgtggtgtggatggttaggggagggtaatgcggagggtcttgtcacgatttccccctttacagtatcatggtgatacttcggggcatggtgacatgtgtggaatcgtgttttgtgggtatagttgtacacctctggccagagtaaaattattcgaatagccgtgcccgcggttatgggcgatcaaccagattcaccgtgattagtctcacccctagtttagcttaatgaactggtgtagttcaagtggttggttgggcctgttgcaacgcggtgtagcgttggacagtgattggttaatattgattaatttactacaattgttttactgctttcaactactgcttttaaatgctagctttatgcaaaagaacccctagcctactttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccagtttagctcgcttttatcttttccgctgcatttgtaatcttttctatttttgtaagacgtggatctgtatgtcaacaattgtcgtttgtgtaccctagctggtcctggacagggatttaatgcacattcagcttagaaattctggttcgagaatttctgggcgtgacagccgcccagcctggactcccctttcacacttccccccgagggggggcctcggggtaaaacgacgggagagcccgagggggtgacgtcacccccgaggggatgtcgtcgacccccgaggctctccccttcgccttagtgactcacgaggtatgtgggtgggaccagctcgcagagccgcgtggctggaaagggaagtagctctcctttactccacatacccccggacccatatctccgacacctgtgctttgtgaaaagttgttgtggtgtgggaatcgtaaccagaatcagcctttgtggcagatggatgacctgagtggtcagaaacgaatctgtgtgattcaggatgtctacgggcatcatagactaggcttcccgagtggaagcggattgttgtgctgctgggcagctggactctgggagtcggagaaattgaaaaaggttctgggagccgcctaatcaagtgaaatggctctgggagccgagaagtaatgatctgacccgggaggtcggtacattaccaattgagttgttgaaaagcatctcttaagtcgatttgagacgcaagtctcttttcgacccaaacttaaaaagaaataaatcacttagtgatttcaaaatgttttcaaacaaaagatttgcaaaactgccttgcctctcttctaagcttgcattaaacacctaaattcccgtggcttgctgagtacgaaagtactcacccttactctatataaatatatatagtttcccccgccttgaagtgaagatgaagtgaagtgaagattagggtttcgtcctggttcccagccgtcgcctgtggtgttgggtgttagtccattggttccgctgctgctgctgttgttggtgtttcctcgtccgtgtcgtcggttgcattctcgggctgttctgagctgcaacctaagttaaggtaaataagtcctctatttattttaaggatttgcaatgattcatatttgtcaccgtgggtaccagcactacgtcctgggactggtaccgagatcgcagtttcgtaggaagcggttcgcgccgttattcctacgacacgctcctatcaggtgccgttgtacggcggtgccggattggagtgtgacataactattatgggtgcccttatgtcgccgataacttatttattacgtgagattgcagccatgcattcctaattaaattttaaaaaacacctctatgtcgacttacgatttttagccgtcgaaaaccacacctaaccatacgtgtgtcagcttacatgcctttcaagtaggaggtatgaatatgatgcatatgtccatcattgctaaaatgctgacttatgcctccagtctcatctctttcccttctccgcttgggcccaattaacggagtagggctcgggaatagctcatgctcatgtgttatctgccttttcgcatcaaaactaacgtacgatgtagcgttatttttcttctcaagccttttccaagcacaacaaacaatgtgtttccaaaataaagcttatacatcgtttgtaatttttgttcatcaataaagttattttactgtgggggcttcccctacagtgctttccttaaaaaaaaaagcttatacatgaaaattgcatccatgataattttatatgtagaaactttatacatactttgtacgtgcgcataaacattccattgaaaaacttcctgtaaaaaataaatttgaaacatattggacaaacttttttttttaaaaaggaacaaaacacccttgtgggcccgtgagacccatgtgtcttgcctgctcaatagtctaccacttggaattcaaagtccaccatatccactattctaacagtgtgctaatttcgtaaaagaaaataaaagtgtaacaaaatacgcagtagaaaaaaacatgggacaaaattaaggacataaagtttgacatcccacaagttcattcatacgaacttcgctgaatagtccctcctagagatggcaacggggacccataacccgtgacccgacaggtttttactctattagaagctaattgtgttctaactcttgtacccatgggtatactaatgggcaaaactcttacctgttgggtacgtgggtatgggtccgttctttacccacccatacccaccaacccgtgggtgaaaaaaaaccgttgattgagcctaaaactataagcaatataagtttcaacgactactaaatcatagtatgaaactcttttcacatcttaagcattgttccattctagttatatgaaattattacttgatctcttgattatgtaatgtggctgtataatttttttacttacctttgaactttgaacgctaatgttaatagattgttgctagagaaaatattgatggtttacaactctaatatggctaattatagtacaaaactataaatgctacaagtcaactatatgggtatgggtacccgttggatacccgttacccgcacaggtgtgggtatggagaagattttctacccgtgatgggtgtgggtatttaagtgggaatatttagacgtcgcgggtgtgggtatggggcaagggaatccgatggatatgcacccgttgccatcctactccctccatcccataatatagcaatctagtaccggacgagacccttcatagtacaacgaatctagacatgcttcctgtccagattcgttgtactattaagtgttccatccggtcctaagtttctatactatgagacggaaggagtagcatttcccctttagagccatagcgggaaaaacgacactccattgccctgcctcttttcttcgatggctacacgctctaaccctccctcatctattccccacccccaaagccatcgatatattccgcgaggctgtccgctgtcctcactcaggtgaatcctctgccacctctgttggtggtttcattgtggtcatccacgtcttcagcgaggttaccgctctcaggtgagtcctctgccgcttccaccaatcatgagtcatctcatcatcaggtatcgtctcccatcttgcgtgttgctatccacgacattctcgttggtgtgttgagccaccttaatcctcaatttttttgcatctccatatatattaattttttcgcgaacgcgtaaaagcattacacatcaatatattagatctatatatatacaataaacttgtcatttttttattttctagtagggagtgtgtcatcaaccgtcaacaagaacgagaactcatcgcgtttagacttttggaccgagggagtagttcactacagtctactagactactacggatcagaagaactctgggaaaaaaaagacactgaatgaaatagacttgccggcagtttgacaccatgagttcgcaggccgtgtttagttgcaaagtttgaaaaaaaatcacatcgaacttttctacacacacaaactttcaacttttccgtcatattattttaattttctttaaacttttaattttaacgtggaactaaacacacctgcagtttcagacttcttcaggtccggatagaaatatcacggaaaatgctggctcattatcattggaccgttgggtccatgcaacgtcaagcagatactcctgtaaaaaaaataacttttgggtcactcgtgtaatactagcacaaatcaaagtttgcaatgtgaaatgaattagacgaggatttggattttggcacgcttaattaagcttagctgctttttatttttagttagcacgcttttcaagcagttaaacgatatatttcttataaagacataaaaagatgcttttaaataaacaaatttattttcatttttttataatttgtaattaattaatcgtacgctaataatgtttgtggttgtgcttgcagctaatcatccaacacttattgaccgaaaagaacacgccagaaattgtattgtcatgcagagagcagagaggacctcaagattatctgcattcttctttttttttcactttttttttagatgtccacgacgactaaatggttggaatgattggtatcttggtcgttttcatgtttccattggccttattcaaagccattgtggggttgagtatttgtttcttgcttttcttgtcactttctttaggtttcttatatattacttttcgagaaatacgtaggaatcaatcgttcttggtcgcctttaatggatttctttttgcacgatgaaatgacgtgtaaatctccatcataaatattctcagacagggaaggattcaggcctagggcagccctaggtctaggttcttgacttcatgtaaatttcatttgaatttctaaattttgtatgaatgagtggaacatcagaacaagtaatgcaaatgagactgtgttcggaactctgttttccaaactctcccctctcgtttttcgcgcacacgctttttaaattggtaaacggtacattttttaaaaaaagtttatatacaaaaattgcttcaaaaaaatcatattgatctatttttttaaaaaaatagctcatacttaattaatcacgtactaatgaatcgctctgttttctgtgcatggaagatgggttcccaacacacacctccgaacacagtcttacttgttcttagaaagaaagaaagaaagagacttcgcacattcaagcctcctttgaaacacggcaatttttactgatccttgtaggaattgaggttatcctgaaacgttaacaattttctatatatttgtcgataaattttctcctaaaaatttgacagatgtaattacagtacaatcgtagtgtaattacactataacttgcatgtaattacactgtaactataatgtaacttgtatgtaactttcaaaaatctctctataacatgttatttcggtaaaatgaaggtcgtgggaacaaatcctctcacatatgtgtgtactgtgtttttttcttccttaccagaacatatcttataatagatctaacgattcaaaattacgtgaaacttacatacaagttacacagtagtcacatgtaagttacagtgtgattacactgcaattgtactataattacatctatcaaatttttaggagaaaatttatcgacaaatgtataggtgatcccaaagttaattgcatttgaaaattgaaagggcttcaaagttgaaacaactgtaccgcaatgcaagcagcaactccggcaaaccaaaagcatcacatgactgcgccgaaatgcaggaaaggccagcccactgacccatctcgcctcggatgatgcatcacatgaaggcccgtataaaaagcccacattccggcccattgtcgtgtatggtcccaggttccaaaatggatggaccggaaattgggctttccaaacgaggcctgaccatgatgcagcccaagtgttgccggcctggcatttttgaagccatttccaatttttggtgctcttagactagtggcaactaaaaaacatcccgaattcgcatcccccccccctgaaattcatagagaatctcacaaagaaacgtgaaattcgtattacagagcaggttgatttattcccacaataatccaagctccaaatgagacaatgtttctttggcataccaagttaggttgaaaaaaaactttgggatggatcccggtagtttgagaaacgtcagggttttctggctagctccataaagtggtggactagctagcttaggtttaaagcctcactcattctaattatttgatattaggtcttatatatagatttatagaatgaataatatgatgattatttaaaaaaatatataagatgatcaattgggaatgaagagattaagaccatttgatttgtatgaaaaatatagaaatttaggaggattttatttctatgaaaaaaaaatctacgaaaacatttgaaacaaaggatcaaatcatatcctatatttaaaattcctatctaatgggtaattctataggtactttggaggctctagattatctgtgagagcgctctaaccagtttcactctaaaatcgatttggttgggctttgactctatagaggtggaactagagttggagctttgtcaaacgaaaagtattagattagatggatagtatgaaaagtattagattagatggatagtattgtattatatccgatttgttatgttatggtaggataagattaattttcatctctatctctaaagttacttaaaatctaatccatatatatactgacattcaatacttacaacgtgtccgatgttcccagtaatcctttccctctactatcgatcttttttccacgtcggtcgcggctttttcagtgctttgactggttgactccccgcctcctcttccctccgccgtctgatcgccctcagagtcgaccgttgctgtgggccccacccctcaccgccggaccccgccgccgccgtcgccgtcgactccccgccggcgtgcaacacatctactccaccatggctcccgcccactcccaccggcgtggtgcgacggaggcgaacgagcagatgaggaggaagaaggagaaggcgcttcgagagaaggaggccggcgacgacgacttcgacgagggccgctacaagcgcgccgtcgagcactacgcccgcgccgccgccctcgaccccggcgacatctccttcccgatcaagtgcgccaaatcctacttccacatggaccaggtcagccatcctcgtctcgcccaatccaatccaatccatccccaatttgctactacttagcatttaccttgttcgctgcagtacgaggagtgcgtgaggcgatgcgacgaggcggtggagaggggaagggagctccgcgccaagaaatcgctggtggcgctggcgctgttgttgaaggggacagcgctgctcaatctcgccgactgcgcttcggattgcaaggcggcgatcagggcactgaagcagtcgctggatgagcattatcataaggggacagaggctatcctggacgaggcggagagcgccatggaggagatggaggagctggagaaggaagctgccaagcaccaccgagaaaaaggtttggactctctctctctcttttctcctcttgaggaagaagcataatcgttgatcaggagacaggagtacagtttaatgtgaggttttggattatggggaaatgaggagtgcaaatgggtaaaaaaaaattgtttgattccttgtttggaatgtttttagaggctgcttggaccttgggggaaagaagagggtttgggaatcttcagacttcagctcatgaaaaataaatagatcacaaaagaatatatacagtcttaacccaattcaatcccatgacataccaaactgaaaaatcattttcagtttaagttctcagcaccaccaccaacaacaatctgatccatctgaactgtgcacagcgattgattgctttgtactgatcgtttgttgctgttggtgttagttcagttgacatccgcaattggatcagataccttctactcatgtagccatgcatgtaggatcgcttgtcctttgttaagtgtcaagtgttctaaagttctaggaagttaattctgtgatttaacttgatatttgcaaggacaaacataattattacgagttaattacagaaaacaacatacctctagtgctttgttaagaacaccatgttttaagtgatatttgtaatagtaagcattaaaatcaccttttagcaaccaacttgccaacagaccagataatgtggatagggatgtcatgttggctgggttacagccttagaggcttagagcaagtttaatagtagaagtgattgttacctcttaactttttccacatcatctactcatcaattgtgaggcaacatatacaatacactagctctaacatactggttcccaatgctaattttattttattcatttgctctcgatttactctttatcttttctttctctggaagtttgtgtacatgttacctcttgcataagggtggctcacaggctcctcctttctctactcccttctttcctccacctcatcatatggcatctgtggcatcctggggatagaggttaaggccgtgtacttcctctagaacttgtactttgcaacaagtgttctggttgttacagtggaagtagagtaactcaaagtaagctgaatatctggatggggcttgtattgtaggactatttgtctacatcctttctttaagcatgatataaccagctcctaactagtactagtaaaatgataattgccatctcattgagatgtacaaatgccgctgctgagtatgtacacatattgcaggcaaagaacttctcagtaagaaaaagtacaaggaagcagcaatccagtttactaaagccataaaaaggaatccattgaatcccagagtaagtattgataccgctactggttgtgagtcgaaagatattttgttctttggtgaaagatatgtctcgagctactcctttttaagttttggcattcattttttatgcccttttatgattgatcacccagaattttagcgacagagctaaatgccgcatcgagctaaatgcattggctgaagggcttgaagatgcagataaatgcattgaggtagatcctactttttggaagggatatttttgtaaaggtgaagttcagttcttgatgcacaattatgaagatgctatgacaacttacctagacggtttgaaatatggcccccaaaaaacaacaatttatgatggaataaagaggtacattcccagtcctctgttatctttagtgatcttattttgattatctgaagtaacattttgtccggtttagatgtttagaacaaattaaaatggctaaggaccgtgatgtcagggataaggacttgtgggaggtattgacccatttactttctttcttttaacaagtcttccatgataacctgttgctttttcagacagaaaggaatatgtcttgcatgtgtggtcaattctagtatagtaaaactgagtcaaaagggtcacatatctgtgtaataccgatactgctcctcataacttgagagattccttagataccaaaactagttccacaagtgggagtaggattgacaattcatttgtataattgtatctgctcttgagattttctacgatcattgagagatattggtaccgactgttagtcaagatatatgtacttttgtaattgacaggaaagatcatcatccaatcatttcttgttgtcaaaagttagattgcatagaatataggatgcaagacaacattcaacatccatttactcttgctgctgctgctaagcttgctatttgcaatcttggaacagaccaatgccactgtatttagtaccaatttgcttactcccagccaccaaagcagaatcttcattgaaaccaacattcccttgtcatatgataatactttttgacattcttttccctattcgaaagtatgggatgttgcaagctattaaatacacccataaatcaaaggtatctatctgaattatttgaatgagggtgtttggtttgtgcaggcattcaaaaaatcgagttctagccaagtcgaaaaacttacgatgcagcgcgatgtcgtcactgtggagcttaagtcagccaaggagcgtaacgctaatctagaactgcaactctcagaacagataggccgtattgaacggcttctgtcgatccaaaacagtgaacctccacatttcatctgtcctatatctcaggtgagcggaaaacgatatttcaattttcttggttcatgctggtaatactttttttccccctgaaaaacactggctactgtaagagtataatctttgtaccattgtccaatgactgaccataacattacttacatacgtggtcaaaattccaggaagtcatgaatgatcctcactttgcagcggatggacacacctatgaagctgagcatatcaggaaatggctcaacgatggacatgacacatctccaatgaccaacgagcgacttcaacataaaaaactcactcccaatcacgcactgcgctctgctattcgggagtggcaccaacaccgaaacatgaggcatacttctccgcggcgccaacagctttttttgtgaatttgtgtgaagcaagttgtaactatgaaaatttagccgcagttttgatccttgctacagagagagtgcttgccgcgacatggctagatcgcaatccacattttgtaaagaaccatcattaagatttagtactaagttatgtgacatcgtatttcagatattattcttgttatatgtacttctgtatgtctcacttgtgttggatggctaaatagatgaatgatatttattggagggtatacaaatgaataaattaactgttataaagttaaacaatagacttaaaattatatattatgtatgaaattcatacatatattgttagatgcaaatagtatgctctctagttcatgtagtttcaaatattacatgaatcaggccctgtttagatgggactaaaacttttaagtccctatcacatcggatgtttgaaaattaattataaatattaaacgtagactattaataaaacccatccataatcttagactaatttgcgagacgaatctaatgagcctaattaatccatgattagcctatgtgatgctacagtaaacattctctaattatagattaattaggcttaaaaattttgtctcgtgaattagcttttatttatgtaattagttttgtaagtagtctatatttaatactctaaattagtgtttaaagacagggactaaagttaagcccctggatctagacaccacctcaatcttgcttgtagtcaacataactgattgaccatggtttctgggctgaagtacaggactgacggacacggcgacggggcttacaatttcaacccagatgaatagaatggatgcagaaaccagaatatggcaagaaagaatgtcttctggggaaaaaaaagacatgatgaaaatagcatggatgctccagtatttttttttagcactatggtacagatacaagacactacagacttgaattgcaatttattcagtactttttagtgaaaactacaaatctagggacaaatgcataatggaataatttcagaaccattctgatttctgaacatcaaacaaaacagaacaagtgtaggataagatgaatttatcgcatggagccagacctgatcatccactcaaattgcaatcagttcagacaaatatggacagaaatttggggataaaacagattacttcggttgcaatttcagaataaccagcggttacattgcaactaagaatcaaagactacgacatgacaaggcaaggatctaataattaacaagaactggtagaacatgacaagtccctacgaaccaagcaagaaccaaaggagggcggatcgcctaagcgcgctcgccgcggatccggcgcgcgagctggatgtccttgggcatgatggtgacgcgcttggcgtggatggcacacaggttggtgtcctcgaacagcccgacgaggtacgcctcggcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgccgggcctgaagcggtggggcttcttcacgccgccggtggccggggccgacttgcgcgccgccttggtcgccagctgcttcctcggcgccttcccgccggtggacttgcgcgccgtctgcttcgtgcgggccatcgaggaggaggagaggagagcttggcgcggcggagaaggcgaggcggcggcggcgagtgatttctttggatttgagacttggcggtggtggattgagagggggggaattcgcggtgtttaaataggcgtgaaatttgggagggattcgctcattcgcattcgcgcgcagtggaaatgttcgaaatttgggcgaaattttgggtttggaattttggggaggcgcggccccgcgcgggatgcgaatgcgatccgcgcgcagctgctccaaccaatcacagtgcagagctcatgctcccacggatcgcgatccgcgttctgcccccgagatcaaatctgcaccgtcgattcgaacgcaatcgtacggcgctggttccgcgcggcaaaaaaaatccaatcctattaaaaaaattgcattttaaatttcgtttaaaatttctgcatttgaaacagcgccaaagttgaaactctgtagggctgtatgcaaaacctaagcatctgaagactggcctgcttcgcaagaaggcccaggccctcaacccataggcccatctctcctcagatcatgatgcatcatctcatcttcctcgcatgggcctatcctatgtatgggccggaaaatttaactaattatcaggcccatccatgtgaagccccgggagcttgggcttttccagacgcctggatgggaaagtattgctggcccggccatttttctcaattcataccgtacgctgccactcatcgcttaaggccgtatggaaataaaaccgccgttaaatttcctgaaaattggtcatactgtacttggttaatgataacaccgagtattattttcacaatatttttcagttattacaaacatatttgggtgtgccgaaatgcacaaataactttccttttgaaatctcgccatgaatttggaatggattttttttataaaaagaaatactaggttcctttttgaaatctcgccatgaatttgtaacattttttcatgtagtggaaatagcaactagtacatggttatggagaaagcacacatattaacttgcaggaattcttttgactacatgctgaacgcgttttgaaactccttaatattaatagacatttttttgtaagcccagctgcatgctgtagtggagggttggtcggttggagacttaagtcggtcaagaaagaaaatgaggtcattatgcccctaatggcctgattaattagaggtgaagctacgtcggtcgagcttatctgctaatcatccctgaagagccaaagagtttgtacgctgccctttggcctccatccatccatccatggctcccgtcgtctcccgcggcggcggcggcggcgggcgcgcgatgggggcgaaggagcggaaggaggcggcgcagcgcgagaaggaggccggcgacgaggcgtacggcgaggagctgtacaagagggccgccgcccantatgcnncngccgccgacctcgaccccggcgacacctcctgcctcatcaaacgcgccgcagccaacttcagcatgaacaaggtcagttcacttccaatcccacacgcaattccgcggagaaaaccgctccgattcacctcgccgctcgccgccggcgcgtttcagtgcaaggagtgcgtggcggactgcgacgaggcgttggggaggaggaggaggagggacgcgcgctgcggctgcgacgagaagctggccgccgacgcgctgttcctcaaggcgctggcgctgctcaacctcgccgtctgcgccgcggatcacgagccggcgatcacggcgctggaggggtcgctggagctgcgccccggcagcaaggagacgcgggctaagctggacatggcgaagaggaacagggacgcgtttgcggagcaggagcggctcgatcaggaagctgccaagacccaccgagacagaggtttgtgacatttttatttcttcctcttcccctcttgacgaacaaccactaaattcatccctaatcacacacaccatatatatttaaatatgtaattgtgcacatcgatcaacacacagtatgtaattgtgcacatcgatcaacacatcgtatgtaattgtgaacatcgatcaatttactctgtaccgatcactgacgttgttcagtttcaaaaaatcatctgacgttgttgatgttgattcagtcgagtccacaataggatcaggtacccatctatgtggaagaatcacgcgcacacactgctatggagtacttgccatcgcacatgcacggatttgtagtcaccggtagtgagttactactccataagcagagcagctgtcctgctcccatctgtctgttgtgctcttctgtgagtgtttggtgtagtgtgtagcgctttgcgccaatgcttctttctcctcaacgatcctgttgttgattcatgtaaaattgtaaaatgtaatgctttctccacatcttactataatcggtcggcattcttccgccatcccagcgggggaaaaaaactgtagtgcattgctaaaacacacacataggtgttctccaaaaaaaaaaaaagaatacataggtatatcttcaccaccgcaactatatcaaagtgagctggatatatgggagatatatgggacctgtgctgtttacagactgtgtagtagtctacgtccattctttaagcatgatataaccagctcctagtactagtaaaaatgctaaattgacattccattgagatgtacagatgctcatactgaatctgaatgtatacacaccttgcaggcctagaacttctccgtaagaaaaagtataaggaagcagaaatgcagttttctgaagctataaaaaggaacccaaggtatcccaaggtatgtaattgataccactacactagttgtataacaagtctaatgaaattttgttctttaattggtgaaagatatgtctccagctgctcctttttaattttggcattcatcttttcatgaccgatatgatcacccagaacttcagtgacagagctcgatgccttgtcgagctaaattcattgcctaaggcgcttgaagatgcaaatcgatgcattgagctggatgatactttagggatgggatatctccgtaaaggtctggttcagattgcgatggccaaatatgaggatgctattgcaactctcgtagacggtttgaagcatgacccacaaaatctcagtattcataacagcctaagagagtaactttccaatcctctgttacccatattgtttgcttttgttattattatttgaggtaacatcttctctggtttagatgtgcagcacgcattaaaatggctaaagacagtgatgccatagcaaaggacttgacgaaggtattgatccgtcaagtctttcttttaacaggtcttccatggtaatttgttttgtttttcacaatgaaaaggatatgtcttgcatgtgtggtagtaataaccggtcaatatagccatatgttcgtatgctcacaaggttctcttattttgggagttatatacctcttcattacttgagagatactctccacaaaaggatgtaccgaaactaatcttacaagtgagagattatctatgttcctgagtttttctacaatatatgaaaatatagttattttgtgttagttaggttctatctaacactatgaggtatatatgcctatctatagctctcaatgacaaaaagattcttactttactacaccttttgtctaatcaaatcagtttaaaatctttacattagggatcttcaaataattgggaggcacataccttctaacatattctactttatcagcaaactaatggatatcttacatactttcagcaccaaagagaaatagaatgtctgcataaacaactgaacgaaggtgagaacaaagcatccaaggagcgctcaaggcggatgaaatctgaaaagctggtaaatttattactgttttactaagtgttatatattaatcatttatgtctgcaaagtagcttgatcggaaatatatcatcatacaatcgtttgttgttgtgaaaagtttgattctatagggtgcataacaacattcacatttatttaattttgcagctttgcaatttatcagttgcttgaatttttcctaactgtttgtcacctacactaagataaggtgcaaactagacttgcgcaaataataaactaaacttgcataacataggagttagattttgtaagtttaagttagaatattgtttgtctcacaaaaagaaaaaaaacataaatatgagtaattggatattgtcctactgttggaaaaaatagtcaattgacaaatagacacaataaccccttgatcttggtgttccaagaaatgggtgatcttggagcagaccactgccacttatatactgcaaattgcctaaggaaatatcagactttttccctaaagaaatataggatgtcacaagctattgactacacccataatctaaatgacactccctatgaatgacaggtgttttgtttgtgcaggtcaagacattgtcaagccaagttgaacaacttaggtcagccaatgagcggaatgcaaatctagaacgcgaactctcagaatgcagagagcgttttgaacggcttcaattgatccaaaaccgcatacttcaacatttcacctgtcctatatctcatgtaagcccccaaaaaaaaaccctcaaaaaactatactaagtgccataaaatacatactagtttgtttataacttttgcagacagatcctctgcaatattgctcctgcagtgacaataactagttactgcaggtgtaatattgcagagaatccccacccattttgtgactgatgactcacaataatttatgtggttaaaaaatttcaggaagtcatgaatgatcctcttatggcagctgatggacacacctacgaagctaagtttatcagggattggttccgcagaggccataacacatcaccaattaccaatgttgaacttgaacacaagaaactcgttccaaatcgggcgctgcgttctgctattgaggagtgtcgcaaataacacaatatgatgctacttttaacctctgctacaagcatcaccaaaactgttttttgtgttaagtaacgaactgaacaactatgctttaataacgaaccatgatatagcttttcaatatgcagattcggatttgtaaactgagtttgtgtgaattaaactatgaccattttgtaataatttattacagactcttggtagaccagttgaaatgtttgctcaattataaaagaaaatactctatgcaaatttagaatgccttctccacgcataactcaattgatgccaatatgtaacactaacgcatcattcagtaagaaagcgaggccactttaatcctgcagactctgattctctgaactcggaaaggcattccacacattcatttcaaatctttcatgaaaaacaggcaaaacaaatggatagatttgaacatggaagaccgatttctcattcataatcagctcaacacttcacagccgtgctgccatgcattgcaggtttgcaacaagttacattactactactccctagcaattttctggtaagctcagaccaagcgactaaatcaatcaggcgcgctcaccgcggatccggcgcgcgagctggatgtccttgggcatgatggtgacgcgcttggcgtggatggcgcacaggttggtgtcctcgaacagcccgacgaggtacgcctcggcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgcctggcctgaagcggtgcggcttcttcacgccgccggtggccggagctgacttgcacgttgccttggtcgccagctgcttcctcgagtccctgacttgcacgccgtctgcttcgtgcgggtctgtgtctaacttattatacgtcaacaaaaccaatcgtatgcttctagatctaatttaattcgattttt

SEQ ID NO: 8935 - DNA, 7353 bp, Oryza sativa
gcccaccctctcccctatactactagatgtactcctccctcttcccccttcctcatctccttctcctctttcagtagaccacacaaaattttttgaaaaacaaaagttagaaaaatttatgtatagaaatactatatataaaaaatttgaattcaaattcaaatttgaatcgggtatgtaaacttttgacttataaactttggatctataaactttagatgtatagaaatactatatatagaaaatatttgaattcaaatttaaatttgaatcagatataattaaaattcaaatttgaatcgggtatataaactttaggtctataaactttacatgtatagaaatactatatatgaaaaatatctcaattcaaattcaaatttgaatcggatatttgaattcaaattcaaatttgaaacgggtatataaacttttgacttataaactttaggtctataaactttagatctataaactttaggtgtataaactttatatgtatagaaatgctatatataaaaaatatttgaattcaaattaaattttgaatcggatatataaacttttgacttataaacttttggtctctaaactttatatgtgtaaactttaggtgcataaactttaggtgtataaatttactaaaataggaaagtaatgcgatgccaaaaaaggaaaccaggtggagggagggagtggggagcgaatctgatcgctaccccatccccacggcgatcaatcgcccattaggggtaccccctccctcctggcacgcaaaacaaaactcgttttgttgcatgattaattaaatattaattatttttttttataagatagattaatattattttttaaaatattttttatatagaaaattttttatatatcattataaaaaacgtgcgcgtgaaaaacgagaaaggcaagttggaaaaatggtgataaagaacaaagctttaatgatgaataaactcgacgtaaaatatacgggccagtaatttacaactgtattgggctgattacagacctaacaggatcttatggtgtatttggataatgggaaatgagaggtgggattgggattgaaatataaataaagagttaggattaaatggaagagggagaatgaatggttaagatttaaagatggcttttggtgggagggaaatcatttccataacccattagccaaacaaggccttaatgtgaagggtaaatttgctacaggacactcaaagattgtggtctttgctgtgagacacccgaagatcgtgtatttgctcgtgaacactgtaaaaaagtggtaattagctgctggacattcttcccattattttattatttccggtcaagatggagagagaaagagttgtgtaagtaccaaaatgcccctggacactgttcttcctctctctatctttttttccccttcttcttccttgcagcagagcagaggtgcgagtgtgcgacggcggctggcccgagcttggacggctcagccacggcgaggcggcggcggggcggtgtaggccccacatcctttctttttctcttctttctctcctctctcgagcaggcgtggtggcagacttgcgtgaggcggccggcggcggagcagggggcgcggcgctggagagagggagagagacggccgacgcgatggcgagctcggcggcggagagtagcggcgcgcggcacggcagcgggggagagggggcgcgcgcaccgcccgtcctccatagcgatggcgtgtagcacgttcttgtcctccagcgacgccggcgtgccgacgtcggaccacaaccaggccacgttcttcttgtcccggaagtccagcaggatgatgaaggaggtgtctgtccgtaggaacatggtcgctgccatgagcgtgctcgtgccgtcgagccactggagcttgtcggcgtcgccgagtgcacagcccggcggctcgtagaagaagtcggcctgctcgccggtggtgcagtcccagacgccgatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgtcccttgttgcccgagacgcggccgattcgcgcctgccatctccagttgtacacgcgcgatgcggaagaggtggcgcgggtcgccgggaaggcagttatacacgcgcaggtcgccgccgctcctccatcgctcatttgtacacgcgcacagcgctgccgtgcgcgacgcagcagccgccgttgggcgcggcgcggacagccgtcccgtcgcccgcggcgttccctgccatggacgccgccagatgcagctggtccccgtcgaacggcccccaccgtgcctcgcggaagcggtcgaggaggccgtaagagagcgaggtagagcgcctcgcgccccccggcaaaaccttcgcgttgctgtcgaagaagaacagagaaagagagattgacaagtgggccatggacaaacttgtctttaacttaagtttctctctccgttttcatcgaaaataataaaataatgggaggagtgtccagtagctaattaccatttttttaccgtgtctacaaacaaatacacgatctttgggtgtctcacagcaaagaccacaatctttaagtcctgtagcaaattttgtctaatgtgaaagacacagggaatatcaaacctggtctacaggtatccgtcggctgctcctggcccagctgcaggagcagcagccgccgccaccaaccaagctcgaaaatgctactaggcgcggccacgtagcatcgcgcggagagccggacggcagagcgacgcgtgttgatacggggtgggcagaaaaataccgatccaaaaagaccgagaccgagaccgagaaattcggtgatcaattcggtcctaggtagcgaaaaaccgaaatttgttcggtcaatttggttagtctcttcgggtaaccgaatagaccgaattatcaaaaaaaattgtcaaaatacaacctacaatccactatgtctaataggattaaactttaattttcacatccctacttcttctaggcatttaacctaataagagtctttacttataagtgcttacgaattttttttttatgatttttgtgttgaaaatttccattatttctttgcatatatgaaaatgttgttgaatttcggtcaggaccgagaccgaatttgtcggtcctgatattttttcgcggaaattcggtcttcacttttcaaagatcgaaaagaccgaaagaccgaaaccgagatcgaaattttcggttagactgaatgcccacccctacgtgttgagacttgtgagaggactggcgcggttttttttcgggtttccctcgttttttttctggtttttccgatatttctgcacgtatataaagtttgtatacgtattggtttttccatttttaatacgtatgaatatataaagtttatatatgcatgtacacaaaatttgtatatacatatatagaaactttgtatatgtatatagtaaaattttgttagtatacgtataaaataattatataaatatatatcatacatatacatatgtgtatatatacgtatgtactgtatattgtattgatgggttagatgggggcggaccgacaacgcggctggccggctgccggctgcagccccgcgcgcaaccgatcagccacccccaacaagctgggctccagtttggcgagtcaacgagcgaaatcaagtagtagacgagcaacagtggacgccagcaaataaaccttcacaatgtaccgtccaaatctcaaagccccgaacgttcgacgagcttcgggaaagctctatcgggcccttcatgtacaatgtaccgtccgaatctcaaagctccgaacgttcgacgagcttcgggaaagaacgaatcgttcgcaccggttataaatagtgtgctgcgaacgttcactctcacaaccagtcaaccacaaccatccgttcgattgatcgatccttccaaaccctagcttagtcgttgactcctgcgccgtccggtgagccagccatgtctcccgtacgcttcaacccgtggcgtgcggcggaggcggaggtgcaaggtgtgaagaggaaaggtgactcctgctacaacaaggggagctacgggaaggccatcaagcactacacccgcggcgccgaactcgaccccagcgacatctccttcttgatcaagcgagccaaagccctatcgggcctgggacaggtcagactcctttttctttccggcctgattgaacaagacaagggaaagggtaggggagttgtttagacggtgggattagtcgacggacttactagtaacatcttttagttcccatcccttgtttggtttaagatggagattaccccgggatttgggggagatttggcacaaaatgggcatctctggaacgtgaatcgagtggcacattctgaaacgagtgtgaattgagtagcatataatgaaatttcttccaaattgatgttcctcgcggatttaattttttttttcgagggaaccctcgcggacttgattaacgccctgttcgtttcagtaccaggagtgcgtgagggactgcaacgacgcgctgaggaggggcgaggagctcggctccggcagctccggcaacaagctgatctcggaggcgctgttgtggaaggcgtcggcgctggagcatctcgccgactgcgccgcggattacgagcaggtgatcctgctgctgcggcggtcgctggaaacgtgccacagcgaggaggcgcagattaggctgaagggggcgttgttcatgagggagcagtacgaggaactcaaaagtatggactttcatttcctctgctttatcagtatacgaagccagttgattactgtgcacattgatcgattttccttgtattttcaagatatattcctccctgacatatggtcattgaatgatctactacctccgacccataaaaaaaagaccagtactgaatgtaatatatcatagtactacgaaaatctctgtctagatttagatttattatgctagaatatgtcatatctaattatatatttgttttttttgagacggagggagtagataccactttacccaagttttactttaaaccatctttagcacatacagtagtattatttcacatcctttgagaactccgcaacaaatgttgtggttgttatagtggaagtgcagaacgcaaagtaaattgtatagctcatggggcttgcaatgccagtgtagttgtaccaatatgccctttctttaagcatgagtaatatgggtgtgtttagttcacgttaaaattggaagtttggttgaaatttgaacgatgtgacgagaaagttggaagtttgtgtgtgtagaaaagttttaatgtgatggaaaagttggaagtttaaataaatagtttagaactaaacaaggccatagtagcaagttcctgagccctacctagtactactaaagttctaaattggaattgcattaaattgtaatttatagtcattcttcctgtaacatctctaataattagaagttgtagcttctttaaagcagagttcggaatgaatttcgttattaaaaaaaagtcccattaagatgtacaaatgttacaggccaaaaacttgaatgtggtgcttatccaacttacacgcagcatctttaccccgcaaggtacctttccagtcatctgttatccttataaattttgctattattattggaactaacattttgtccggtttagacttgaagagcgcattaacatggataaaaccaggctcaacaccttgttgaaggtattctacccatttactttctttcttttaacagggatgtattgcttgtgtggttatctctaatgttgtaaaaatcagccaaagtggccacaaattcgggtaataccaatatagctcctcacaacttggaagatacaatctgtaccttcttatggaggaggtaccgaaactaattctacaagaggaaataggattgaagatttttgactctcattggtatttaagggttagttaacagataatggaaaaaacatatatacctcccgagtcccgatatctctcccaaccaaaaaaaaaacaaaccttatattgccgactatacaccttcccaaggttggaagcagtgggccaaaacggccttaggctattacgcattcttttctctttcattttaactcatttcgcatagcacatatatttttcctttttgagcacttctaatatggtggaatattatttatttttatcagcaagctaatggatgcctatttttagcatgcaacaaaagaactacaaaaaaatgaggacaaattatccgaggagcgctcaagacggaaggaatacgaagacatggtaaaaaccattaccgatttgctaaatgtcactgcattgaacatttatttttgcaaaagtttagcttgaccagaagcgtaacatcatgtcatcaatcatcctcaattgtttcttattgtgaaaaagtttgattctatagtgtataacagcattcactgctgctattccaagatatggacgagcttggagcagatcattcccatatcagaatacttttcgattacatttttttttccaaaaattgaaaactgtaggatgcagcgcgccattgagtacacctatcaataatcccgatgtatgtctgaatgatatgaatgtgtttggtttgtgcaggtcatggcaattcaagcctcgattgaacaacttacaatgaatcacgatgcagaacttaagtcagtccgggaggataaagcgaatctagaatgtcaactcttacaatgcacagagaaacttgaacggctacaatccatcttaaaccgcgaaccgccattcacctgtcctatatttctggtgagcagaaaatgatcattattttttccttttccagttcatcttattttttatatacaattttctgaaactattgactattgtacaaattgtttttttttccttcaggggattttcacccattcttgtcatccaaacaatcataaaaaatgatgagttaatatgaggagatggcaccttcacaaatggctggtttaaattcaacctatatcacttgaagccaaaacactatttatagtcatatttattatttttttcaactggccttgaatttaagcttgagtattctatagtgtca

SEQ ID NO: 8936 - DNA, 448 bp, Oryza sativa
catgaatgggtcgaaagttgctgtgaccatgtcatggcgatctggtttggtgcttggtttgctccgaagcctggcgttggtgcttgcggccgaacggttggcgcctgagcagcattgatagagtcgaactgtggtccttgactccacggcgaagcccccagacctggctgattcgaaggcaactaactaggcgcaccttgacttgtattcccctccgggcaggccgaaggggctgtacttgaaatgttgtgaggttggctgagctgatgaaggaaagcttggagctgcgcctgcagagctgaagccccttctaccattgtttgtggcacttggccaggcggttgagtatgtacttgggtagcgaccggttgagcttgcagttgcacatgacgggctggatgcgctgctgcggtcaatggctgcccgacgaagtacattggcgcttgcg

SEQ ID NO: 8937 - DNA, 1155 bp, Oryza sativa
atagagcccatgggccgtggtgccccggctaagccccgcaagatattgtgggcttgtggccgcactttcagcccaagggcagtagtgccccggataagccctgcgcgacattgtggccgtttggttggtaaaaattttactcttgtgacaatagtttctagattttcaatgtacatgtgatttgcactatatatttttttacgcagatatgcattatccttgttcacaaaatcttactactaccagtttatcgcaacttaaaaattcgcttctcgttgattcttgtatagtagtatctcctataagtgcaggcgaatattgaaaccttaaaaatttaatagacgtaaaaatatttaaaatatgaaaagttatattggtatatttttatgagaaactctctttcataaagatatattcgccatgctctttaaatatatagtttagtctttagagactagtggccctgcggcggtcgcggcgacggatctagcctcccccgtcgtcgcggcggcagatccggcctccaccatcgtcgcagcggccgaatccggccccgagcttatggcggctagcggtggagaggaggaggccacgccccaccaccgcggagaggcggtagaggcgacggcagccggcggcggtggagaagggaggaagaaggtgaaaccgagagagaaggaagagaggcggcggaggggccgcgcagtgggggaagggagaagggagcggtgggggtgggggacagtagatttatatattcgcccaaaacatttttcgcagtggtcctccttacctactgccggtgaaaatgagatttttcgctggcggacacttaagaggtccgcctcgaaaaactggcagacacttaagaggttcgtctcgaaaaatagagtagtttttttaggcatttgtcttagcgtggttatcagcaaaaattggtttctgctggtggtccgtagccccccacctattgttatgtttttttgggcggtttttgcatatggacgccagcgtacaatatagggtaacatcacgaaaaatcgttttttatagtgtaaaattgttatgatgataaaatgtgtattgcggactatgctgatgatgtcactcatctgaaaacagagatagtaccaaggagtgaacacgttacatatg

SEQ ID NO: 8938 - DNA, 569 bp, Oryza sativa
ctctttatttgattgcagattaaatcagcctataacaagaagggggcccgaaggcctcggaagaagaatgaaaagctattaagattggcggaggcctgggggctcactccgacgcgcctgggtagccggcctcgccgtcgctgtcgtccgcaccgtcgtcaccgcactcctcgttggagttgaaggcaaacgcgagccgaggggccgctccttattgtcggtcggttttcccttgctgatgcgcgcgatttgcgaccgccgggattctgcccgaagagagagagagagcagggaggagaggcccccgagccgaacggcggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggaaatgtggcccctgacgaagaagatcggccccgccgaaaggtgcagcggcccgtctacttcgt

SEQ ID NO: 8939 - DNA, 601 bp, Oryza sativa
gtaccacttctcaccgtttcactggcacaaccatcacgtgagtagagattttcgggtatcaattgggcataaaatttctagtgataagtgcttgacctaagctttcaaacagttccagcatgcaacactttgtactttcagcaacatcactcaagtattctatacaaaaagaaccattatcaattaatatagatataggatcgtcctatcactatcatttcctcataagcggcaatatcttcttcagttcattctgaaagagaaataagaagtatcaaaagatttgatgatatttttgtgtgataatccagctgattcatgtggccatggatttctctgtggttttgtaggtgggtggcggcgcaaagtgtgttctaccacttgtacaaccaagtgtcctacatgtcattggacgagatctcaccactgacattcagcatcggcaacaccatgaagcggatctccgtcattgtcgcctccatcatcatcttccacacgccggtccagcccatcaacgccctcggagccgccattgcgattctcggaactttcatctactctcaggtagattttccgcacatgttttaccaaatcacatttt

SEQ ID NO: 8940 - DNA, 279 bp, Oryza sativa
cctgcgatgtccattacacattcagtatttgttaagctgactgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtactgtgacagtttatatatgattatgc

SEQ ID NO: 8941 - DNA, 987 bp, Oryza sativa
aatattgtcttgggatcttttttgcacggtttatgatagttgaggggtagagatttttgctatcgcggattagggacctcagacaaactcaacataaagttgagggccgtcaggtgaacttatattcccttatagttatgaagtgactttatccctcaaaatgagttcactttaggtcccttacttcatcgctccgtctgttttgtgatctttttcgcacggtttatgattagttgagaggtagagattttattgtggattaggaacctcagacgaactcgacttaaagttaagggacgtcaggtgaacttattcccttatagttaaggaagtccaagtggactttatccctcaaataagttcactttaggtctcttactttgtcgcttagtctgtttttcatccttatccgaaaaccatatacaatccatccttcaaagtgtgcaaacgaggtccctcggtaataatatttctggttttggctgacatgacaccttcttcaaactgtgcaaacgagctctctcggtagcaatgtctccggttttagctgacatgacgcctttgactaggggtcttcgtcccacgtgctattgacatgacgcttacgtggctatttgataaaaataataaggaggtgtttggaatggactaaaattttttagtcccttccaaattggatgtttggacactaattagaagtattaaatatagactattaacaaaacctatccataatcttggacttattcgcgagacgaatctattgagcctaataaatccatgattagcctatgtgatgatacaataaacattctataattatgaattaattaggcttaaaaaattgggttaattggatacatgccattgtaaattcttcagttttgaaatataccattactactcaactatttggaggtatgccattataatttttcaggtattggaaatataccattacataccccttggatatgtctaacaaaa

SEQ ID NO: 8942 - DNA, 3030 bp, Oryza sativa
aaagttgagggacatcaggtgaacttattccaactataaggcaacgcatcacggcccatggcccatgggatgcgcattctggcccacaaagcagcacacgctctctcccccaccagtaagccctagcctccaggagctcagccgtataaagccgcagaccttctccttcccctccccgccgccactcgccgcagcgtctcgaccagacaagggagcgcctccgaaaccctagctccccctttcccctccgcggccaccaaaatggtacgcttctccctcctccccgtccgcctctctccgtcgcacgacggcaagatcatgcgcgtgtgtgtcctcgtgccagtccacggcaccctgctctggtcgatttgtagggggattgcattctttattcatgttgatctgctgtagatgggggcgatcttgagccggaggagtagctagcttcttgttgatgcggtttcgggatttagagatttaacacggagattgatagtttctctttagcgatttctttttttcttgttgatataatgatatccacggtgattgtactagttatggtttttttatcttcaatgctttgaattattgtttttgatttgtgggtagagaccagattattgttgttaagatggacggattctttgagctggtcctttgcatgctctgaagcgcagaaaatttgtgtaatgggttatatctggattatgtgtagctattaacttctgtagtaaacattttcatcttcctttgaggacatgggatgaattcctttttttcttctcttgttgtgctaaaattgttcggtaatcttgtctgtggctttgactgatgggctccgatgatggcatgaaatctttgagacctgacattcttgtgatgacaaacataagcatatttcctgaggacccaattgagtttttaaccattggtctgctgaatgtgtctttgctgttgaaaaatatgtatacacatttgcttctgattatgcacatttgattgtgttgtttataggcctgctatgtgctttccaataaccagtatttgttaaatttgtttcatatttcttatgtatataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtattgtgacagtttatatgtgattacgcagtgctgtgtgtgattgtctctcttcattagaaacatatggtgtcatgatttgtgtctgttcaatgcaaacatgtggcaataaccatcatgtagttttaatgtatctgactttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactatagttgttggtctactgtgcttcaatatttcaatgttattaggagcttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaatatcttcgtaacgagatggaaggtatggaataccatggatggaggtgaattgaaagataggccttggtcttgtgattgttatcttagaaggtcgatactaatgtttggtcttgtggcgttagtgaaactgttttcgtagcaatgtttggtcttgtgatgttagtgaactgttttcgtagcattgtattacttgttccattcttcatgcatgatttggataggttattgacaattgtttatagtaatgaattaaatattacactcctaaatctattatataattaaaggaatagaaaaaggagcctccacgtttactctcatggcttagaaattctcacattaatcggagaaaaaaaaacagagtccatatagaaatacaatttagaaatagctgaaattcggaattaaaaaataaggaatattagaagagaagactagagttcatatagaaatacactttagaaatagttgaaatttggaattaaaaaataaggaatattagaagaggagtatagagtccatatagaaatacaattaggaaataatagaaattcggaattaaaaataaagaatattagaagtagagtatagagtccatatagaaatacaattaggaaataatagaaattctgaattaaaaataaggaatattagaagtagagcatagagtccatatagaaatacaattaagaaaaaaaatagaaatttggaattaaaaataagaaatattagaagtagagtatagagtccatattggaatttaaaaccaactaaaattcggaaaaaaaaaggagccttcacgttcgctctcatgatctagaaattctcacattaatcggagaaaaagaaaaagcagaatctatatagaaatacaatttagaaatagctgaaattcggaattaaaaaaaagaaatattaaaagaggagactagagt

SEQ ID NO: 8943 - DNA, 213 bp, Oryza sativa
tatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgactaagccgtgttattataggaaaataccacatcaccttagcacgaattctcttctttgt

SEQ ID NO: 8944 - DNA, 246 bp, Oryza sativa
tatctccaggatttcaggtggagagacagagagatgcagagtgtttgctcactcaccaatcatgttgaaattgagctcggtgatggcggcgagggcgcatccgccgatgattgggaggagggagaagtagaccggcgccgggaagtgctcgccgatgaagaacctggagaccagcacgcttaacgccggcttgtcgatcttgatgatgtgggtgtacgacaccgtcaccttcgctatgctcaccgt

SEQ ID NO: 8945 - DNA, 742 bp, Oryza sativa
cattatttttaatataaggtgaaacaacacccgatttaaacgattgagacattttcaatctacttagtgaaacaattccgatatacctggtggaacataatgcaatatttaaaaataataattcaataataagctatttttttcatcggaatatattcatgtgtgatcttgttttgaagatttaattacaacgaatttaatggtgcaatcggattataatttatataaataatttaagagaaaaatcagtttaaaataattttgcatttaaatcgacgcccgattttaatccccttccatcgggcgcgaaaccggagtcgcgtcccgtaatatggtaatgggatacaaatacttctcactgaaaagcaatccccaactaagaatggccggtgtggatgccacagccgccggcggcgacgaggccggcgaaacgttgcacgtagcgttgttcccgttccttgcgttcggccacatcaacccgttcgtgcagctggcccgtagcctccttaccgtccgtggggtgcgtgtcacgttcctgtgatcctgtcggcgcctcggcggcggccaacgtggcccacgtcgaggccatgctgcccgcggccgtcgccgtcgcggcactgcatcttatatgaagacaagagcacgacgtggggaactcaccgaggtgtggcgcgacgatggacgacgacggaagacggaagacggccgacggcgaggcagaggcggcgacgttgagtaattt

SEQ ID NO: 8946 - DNA, 16770 bp, Oryza sativa
  unsure (1)..(16770): unsure at all n locations
gtcaaagtgaccaatgttgcaaacgatggcattgttcttcatcttcctcatgtggtcaaccattatgatgtccttgttgccagtggtggtcacaaagatgtcagcctccgagacaacatcctccaaggtgaggacctggagaccctccataagggcctggagggcacagatggggtcaatctcagtaacaatgacacgggcaccagcctgcttgagagcagcagcacagcccttgccaacatcaccataaccgcagaccacggcaaccttgccagcgatcataacatcggtagccctcatgagaccatcagggagagagtggcggcaaccatacaggttgtcaaactgttcagaagaaacacagagttaatatatctcaagcaaaaatgataaaatcattgcaaaatataacagattgtaattcccagcattcagtaatatttcactacagatgaagggtgtactaaggagtccagtaaaatgccattaaacaatcaagctacacaagtgcacaataacgagtaaaataaaacaaatggcaagcagtttggtaccaatattttattccatattctgtcatcagatccgcaaaacatgcaagctaacaacaaaactagacatctttgacagctacgcaacaattagaccaagatttagatccaaccgcagtaacctaagacttaaattcgacgctcctactcctataacacaggagacactaaataaaggaactacaagcatcccgtctaaatcaagcaaccaaacgatcacgaaaagcaaaattcgcgcactacatcaggtgcaaatttcccccaattgttagtgttgcttaggtaaaatcaactaaacctttttaaccctgtctttttagtttgtgtcacaaaaggagatctagatgacagatccatattcaacatgccacaaacatcaggaatctaaaatgttaaagacacatgtataatccacctaaccaccactcctatagcataaactttttttatgcgtaatagcccaccagatctactgaatcaaccgaagcagataaaccagatccagatccacagtagtagcataatcaaatccataataccggcaaaatcaagtagtactaaggtaagaccagtacaagcagcaggctaggctaacgcaaacagcttcagatctgaaatataatgggattagaaagggagggaggggatgcttcaccttgctcttggtgacggagtcgttgacgttgatggcggggaagaggagggcgccggtctcctgcatctggtagagcctcttgacaccggtggtggtctcctcggagactccgacgagcctctccttcatcttgcggtacttgctggggtcggacttgaggccgtcgcggatgatggtgagcacgatcttgaactcggcgttgtcggtggactccgggtcggggaccttgcctgacttctcgaactcctcctcggccttgacgccctcgtggatgagcagcgtggcgtcgccgccgtcgtcgacgatgaggtcggggccgccgccgacgccccagtcgaggcagcgctcggtgcaccaccagtactcctcgagggtctcccccttccaggcgaacacggcggcggagtccctggcgatggcggcggcggcgtggtcctgcgtggagaagatgttgcaggagcaccagcggacctcggcgccaagggcggtgagggtctcgatgaggacggcggtctggatggtcatgtggagggacccggagatccgggcgcccttgaacggctgggaggggccgaactcggcgcggcacgccatgagccccggcatctcgacctcggcgagctcgatctcgaggcggncgaagtnncgctgggagaggtcctttcaccttgtactccctccccgacgaggtcttctccacggagagcgccatggcagcggcggcggcgagctcttcctggatcggatctgcgacggcgagagggtgggtgggtagagaggaggtagaagnagtagcagccggagtggcagggtgggggtaaggtggggttttatggagggagaagacgaaggggaggcgttggatctgggtgagggggagatctgggccgttggatctggtggggattggtggggtgggtgagattgggaagttggtgatgggtttggggttttgtgatgggggtggggggaagaggtgatccgggccgttggttgcgggggccggcccatcatggcccatctgaggaggaggacatcgagatctgaagaatccacgcgtgctggtttggacagtcactgtttcacatgacttgtcgctgctccattcgatgcgaaaaatatctccttcggacacacagagagagagagagggggatgggtttcagatcgcgtcggcgcgccgcgtcggcggctgcaccgtcatgcacacacgatccaaaccggggagcttgttggtgtagatcatggcggacccacgcacttgccactcagatatgtttgagttgaattttactcaaaaaagtcttttaaatttagtgaaatttgctgagacaggggacgcggagccctagagagcttgcttaatgacatggtgagtgatcttaggccattcccaacccaatgactaagatggtatccatagtattaaataaattgccatctagaataaaaaatgatatagcaaatgaataaatgaggaaagagaatttctacacaacatccaagacatcatgtgaaataagtagcattaaatttaagtatagaataatgatgtttgcattggaaaagttgtgtcttagtactagtttcttggtgatgtgaagtttttggaaattatatttagtgtcttgggttaggaatggccaaacgaacacatcaatccagagaggagagcaatctcgagaacctagttgtgtgcgagtaatgtagtatttattgtagtagttttttcaccattatattcatcctattgtgtattaagaagggatgtcgtcgttgattgtagctttagtctacttggcacatagtctcgcataatatcatacttataagaccagccactctcctgtaaatgttatagcacttaattattatagttataatatgtagccggtatgttttcatttcctaagcacccaaatgtgtcggggaaaagacaacatgctattttgtgagctcaccaatcatcttctatctttatatgtgtacaaagacggtgtttaaaaaaaaaacaagaaaagacatggtacccaagccatttttgacaagaagctagattttgcgattacatgctctggtggctgttggtcagttggcgtagttgtgcattactgcatgtttttatgtttatgtgcttggtatgtgaaggttatgtgaattcaattgtaattccattaaagaaaaagcgaaccatttgttgagggtatcaaaatgaaatactccctctgtactcgtaaagaaagtcattgacgaaagtcatttaggtcaatgttaagtctaaccttgaaaatataaatcataaataactcttaagttgttgagtttgaaaatgtaaaaattatatgaatagatttgtcttcaaaaatactttcataaaagtatacatatatcatttttaaatagatattttttatagaaataagaagtcaaaattgtgttttggagactgtgtccctgtccaaaacgacttactttacgaatatggagggagtataatactgataaacattttgggacaagtgttgttatactactccctccatccctaaatatttgacaccgttgacttttttaaacatgtttgaccattcgtcttattcaaaaaatttaagtaattattaattctttttctattatttgattcattgttaaatatacttttatgtatatatatagttttacatatttcacagaagtttttgaataagacaaacggtcaaacatgtttaaaaaagtcaacggtgttaatcatttagggaaggagggggtattttcaaggaaacaagaggtgtctgaactatatttttgtccaagacagacctttatgccaaccaggagtccaagcatgaataccaaacttttggtgacagtgaccaaaccgcacgaaattcagtgtcaccacaccaaagttccacttgcagtttaggtgcaatggcagcagatttctccgagctgtttccactagtattattaattaattgttcttttcctacaccaagcctgtagaaaaaactcaatgtccagaaagtgacatacgaccactgcaccccaaacaacaattaatcattaatcagctgcatgtaactcgtgttaacgcatcgttgccaaatcaaacacctaccactaaaccaaaacactaattaaaccacataataatggagcacgtactgaattatagcttacaataagttaaagttgtgttttggagaccgtgtcgctgtcctaaacgacttactttatgagtacagagggagtatagcactacatacttggggggttcaattattatttatacactacttcatcgaagataccgtcatgatgatcttgcttatttgatcagctcacatggtttattagttatcgataaacttaaactatgtgcaaaattgttgaggtgcgaatggtatcgtagtaaaaggtagtggcagtaggagcaaaggaattaagaaagagagaacatctttctttgaagtgtgtaaagaccaaacaagcatagccttgcttagcacttactccgggattaagatcttaatggaatgttttgactaaataagtttacgggaatcgacgcagctgtcgccatgtcaactaagatccgtaaaaaaacatggagatgtgtatggtacataaacattgtcatttatgtccattataggatttgcttaggggagtttctgataactacagttttttctagaatctttagctgctagaaactccttcaaacaatatagattttcatacaattcctatgaagctgcagttgtaaaatcttagaaaattagttagaagtcagaagctaaactcagcttctccaaattctcaccaattagcttctaaccagttgtttctcagaatcttaagctcctaaaacaaaaccctaggatgaatcaaatttcattctagattataatattttaggacaaagatagtaatatcttctctactttatcccgtatcttatgtctatatgaaacattgcacaagtttgtttttgacagaaaacaaatattgcacggcacgtatatataaggctgctcaactattctctccatcccataaaaaaacaaatccaataaaagatgcaacacattttaataccataaatcttctaatcagtactaagatttgtcacataccgtattagattgtttttttatgggacggagcctagccgccattgattgacgccgacggcgcacgtaggatcacacgatccacaccacacgtacaccaggctcatcgtccgtcataattttttttcttaagccattgagtccgatttcacggataatttccacgataatttgtggggttggtggtggagaagcgcccacccgccggtggctgcccatctttccctttctctttttatggagtcgtgggggcaacgtcgccgtcggttcatggttggtgcatgcagccaaactccccggtacttgtccacttctaaattataatcttaagaaaaaaaatagaggctagtccacttaatttggtctcacattaaaaatgcagatatattgtttggcctcgcaaagatacaaagcatatttcttcaccaaccacacgagagtgtacacctaccgattcaactgggacagtgagagtggggcccccatcatcttttaaaggctaagctagcactagcactatcacatgttaactcgttgattagggcgtgccaaacatgggcatttttgttttagctacactttgtcaggaggataaatcgttttgctctggactagcaagagctaattaagtataggaatttagtttgggatgaaaaggtagaataattaattcttcatccatcctaaaatataacttcttcggtaacattctctttctaaccaatcgcaactctccactatttacttttttctcacataaatttacttcttaaccaataacaacttttcaccatttgattatatctattttttttattaaccgtgttcaactttaaaacttcttatattttatattttggacggaggtagaaggttttactaatgataagatggtttgtagctaggaagcctagacctaggcttgggtctggtgggcttgggctaggccaagttattggcctaaaagcgggcctatcaaaacagaagagattatgtttgaatgagatatataggtggtgtttgaatgtctaatgaagattaaggctctgttagttctggggagataggggggattgagtctcgttttccacgcgcacgctttttaaactactaaacggtgtattttttataaaaaatttctataggaaagttgctttaaaaatcatattaatccatttttgaaatttaaaatagttaatacttaattaatcatgagctaatggctcacctcgttttgcgtatcttcccaatctcctcaatccccttctcctcaaacacacccaaagtgtttcacgcaaaacgaggttgtaataacgtgtgattaattgagttttaattattccagatttaaaaaatagattaatataatattttagaacaactttcatatagaaagttttcgcacgaaacgtagtgtttagcagtttgaaaaacgtgccacgagtatccaaaatttaatccaacttttattggacaaaagaacaatgccatattctaataatataaatctagagaacagatatctcattcagctaaaatcctagaatattaggatggaaagagtacattatagatagatagctgttggcagtgtgccagtgtcaaatacgggtaatgattgataatcaaattgacttagaggaaaattggagataagaaagccgatgtttatttgtaatacgatcaaatcatttgaatagacagcttgttataatttcatataacatttaaattaggtagagtttcgttgttctctttgtttgtgagtcattaacgcgtgaaacctagtttgttggaaataaatcttgccgatctctaaagcactcttgcacacaaaatcaaaagagatagagcccgaaacctacatgaagaatatgctaatcagtaagtgaagaattggttatagtagcaatggaaagtgaactcatgtgtgtatcaatacagtccaggctccaaaacgtcaggaacggccagcacctatcaaattgctgttcaatcgggtagaaaagcaaacttcattcaagtcaatggaatgtaacctgatcgattcgatgagatggaaatatagacatactcccttcgtttcgttttatttgataccgttaactttttagtacatgtttgactgctcgtcttattaaaaatttcaaataattattaattcttttcctaacatttgattcattgttaaatatacttttatgcatacatataattttacatatttcacaaaagtttttgaataagacgaacggtaaaacatgtgctaaaaagttaacggtgtcaaataaaacgaaacggagggagtatttaatttacaccatagcatttctgatcccaaattaaccaccgaccacatggaggcggaggcaggcaggcacacatcaactcgatcattttgctcggcccaccgactgaccgaccgatcgatcgatgagatcacgcgtagaaagcatgtcgtcggcaatgatattatatatattcttccattttcccttgccatccatcgtccatctttccttgctcctctcactaactcactcactctcactttactaattagtagaaattagttgccatcaagtatagtattggttggcaagatctgcagatcagtcaacctggttgcagctagctgagctaccaccaaattaagtcgccattagttcaggcatgcacaccatggggggttggtggattctgctctgacggctcagtttttctcctcttttcctttctactggcaaagcatgtctctctcatttggttggttggttcagtcagatcactgaatcttttctttttgtgaagaaatttttatatatatacgctgccttggatctgttcttcaccaaccacaggaatatgcagtacgcctaccgagttgggacagtgaaaggtgcccggatattccaacacttcgctgtcatttttttgccaaactgaaacttgcatatggtcttcacactacctttcttggttggagatgatttccaataataaattcccgtggatttttaagtgcatctccaagggtatgatgggctaagatccacgagtgctgagagtgcggcccataggccagcaaagaatgtggctttcagctctaatttgagccttcatttcaggtggaagttgaactataccagagataggaaaaagtccaacttgactccctcaactatagccaacttgactccctcaactatagctcgaatcttatccctatatctccaaaccacacaactactcctccaactattaaaacatgtgcaaaataactccctcggcagtattaacggtcgttttcgatgatgtggcacgttgacacagtatttatcctatgtaacggctaacgtggcacttatgtgaagtcacaatcaacaaaaaagtaaaaataaaataaatgggacccacatgcattatcgatttcaataaaaaataaaaaatatgtggagcccacatgttagtcccagcatagggcccacatgtcatccgttctcttcctcttttctctctcccctccctcttcaccctttcctcccctggctagctagccctccccccctattctccatagtgacgaggatgttgagctcgatgactgctaatactagccgctgagcgatggtggcagcaataggcagcagcatggatggactatagtgcaatgagggtagcaggatgacaaccacccttgcctctacaccacatctaccattgggtcgaggtaccggtagtgcacagcgagttgatggtgactcctggctccagtgtggcgtgatggagggaacatgacaacggtggtcagtgagccccatcgaactcaaccttgagctaccgcatccaccattccaccgaagcctaggcggtagcagatttggaacacgccttgctcgagcttgagtaccacgcacatgctggcaccaccccattgagttcgagctctgcgggaaggggttgtggcagtggcacccggcgagccctgtcgaggtcgatctcgcccacttgtccgcatgaagggaggcattggatgtggctgcccgttgaggtcaagcagtcgagtcagatctaagcgcacagatgagcctgcgatgatgaagatggccgtgggcaggagggcgagacggtggtgggaaggtgtagatgtcctaactcatggcatagaggtttcctctttggctctagctcctgctccctgccacagtgctaccaccttaaagtttatgttagttaataccgaattaatcacactaatgtcagggttatggataccacatacctaatagtagttgactaaatctcagcaggacccaccacataccatgtcttatacggatacaacttcggatataggaggagttccgcataaggaaggatgaatagagttctacatgaaaacgacaaggactactcggattgtatccatattggtttccctagttctacttggacaaggggacacctatgggtataaatacaaggccctataggaggagaggggagacggacaatcaacatagacgccacaaagccagaagccaatacaagccaacatacgccaagacgagctgccggatatcgacatcaaagatatgcctggatcgaccctattcaatacctacagaggccggccgtaaggatctagcattgtctctgatctcgccggacacgaactcaaggaggaagactaccctgttgtcgactacgagtcagagcttcagaccgccatatcgacaacagttagataggctaccccaaatattgtacaggtgtgattatggtgaataagatcaataccggcttcggccaacaggatttagggctattacctgacaattcaggggtccgaacctgtataaaattcctcgtccccgtctcttttactacaatctcgcatatatcctggtaccaatgatccccatactatgcaaatactggaatcgcgacatcaaacattgacactaatcaccccatttcgactttcaaaaaccaagtgtcagaatgcaaccttattcgaataggctcaacgtttgagctttttaatgacacgtaaaataagaaaactattagcatatgattgattgaatattatctattacaaatttaaaaaataaatttcatataaaaagtttttttttgaaaaagtttataaagctaattgaaactcagagtaaggttgtgttcaaaacaaatgttaccttcaactttttaattgtacataaaatgggacggattatttgggcgtgaataattaagtattaactatatgttggaaaatagatttatttaatattttaaaatacttttaaataattttttttcacaaaatatgtcgtttaacagttaagaacatgctcgtgataaacgaggaagtcatgctgataaaaactcaacctaagctgattaataaccattttaggacctgttgaccaaggttagcagtaggggaacaaaaatagtgtattcaaacttagtggaagctacagcacttagcaactactgttacaaccgctattgacttactgcgcttaaataatacaagatgggtaccccgcgtgttgctaagggagaattgtgtgataataatatatatgagttctattttttttcttacctactatacgattttttttatgtgtttatatatatttttgtacctttattaattatctatagtttataaatgattgggttgtatggtgtgccttttgggggaatagatgtaatttatacccttgataaatcgtcaaaaggttaaacacaattgaggtgatatgaagagatgcaatttacacccttgatgaatctccaaaggcttaaagcaattgatgcgatgtggcttcatgagaggagagagaattagcattaactatacttaggctctgtttgggagtgagggctcactccccggcacacaaaacgaagcagcgttttagtacgtgactaattaaattttagtttattttttttaaaatagattaatatgatttttttaagcgactttcgtatagaaactttttgcaaaaaaagcaccgtttagtagtttgaaaagcgtgcgcgtggaaaacgaggaggaggagttgggaacctgtactaccgaatggagccttagatatataggtttccttatgcatgatagaaaaaacataatgtcatgtgttcttttatcttgataatatatatgtcattttgtaaaccttgaccggggttagattcgttttgggtggcggataatggtttggtatgtattattgccataaaattaaatctatcatagcatatgcaatctgcaatttgctacctacactaattcattaggggctaccagattgctatttgccacttattatcttggtgaggatggagaaacaaactcattagcatataggtattatctttctttttagcggcatagaacagaaagaaaaaatataagcttcgtgcataatcttcaaataatcaactcctaggacacgtcttcgccgtctgtttgatatattctatttgcggttcttcctctcttctttcttcttatttctcttatagtttttcttttggttgtgtcataagggaaataggacaccggccctatcaagatctaattgtctgcttttagcttgatgtcgatagccttcgagtcttcaccaggcatgagatagctacacaaacctcttctcggttcaagtcgatcggacgattaggtttagggttttagcaaacagaattgggtcttcattttcttcgtctgcgaactctcccttatgcagctcgggggcttatcttgtattaggattcgaaattagttttttacatgtcacacaaatcagttccttgcatggatatgtcttcacggacagagactaatattgatatcaacaaaaactaagaagcaacttggatccaatgatcttggtagcatgacacggtgaccacacgaacaacctctacaggctctacttaccgtgccaattatgaagggtccttttcgctcaccaacctcaacaaccatcacaagggagaaagatatataccaagtgcttctgttaggtgttaaaagaagtccacatttttttgtagtttaagctggaaacagtccgctaattttgattagagaaggggtcattaacaaagtctcttaatatagataggaaaggaaaaaggcagaacaaggaggccactaattgaacctccaagcttttgtctaatcatcgagctaaaatgatttaggggttaaatatataaagagaggacttttgtgagtcgttaccatttcaaaatgttccatgaaattggtatgcagctcagagcagccgctagcacacatagcacacactgaatgcagctttttttttaggtgaactgaatgcagcatttttagtggtacactggtacttctatatattcacgttgagaccattgctcaaagctcactgaggatcaacaaatgagtctataggaatatatcaaaggaggattcgtccttgtgaattttcttcctaacttgctgtagtttgaaaaattcttttggattacaatcctatatctcaattccaaaggaaatttacatgtgagctcaaaccttattttatttttcctttgagaagtccaatatgcatcttctgtctttatctctcacatctgtatataatccactaatgttccagttcacttttctatgatccatctttcaaattcatgtgtgctaaattctagtgcattgctcttttcccatacgtatacctctatttttataatcgtgagtttcaaagtaacatagcatacaatctagcacatctaaatatgagcttgcatggtacgacaaaacacagggggtgaaggtgagggtaaaccataatgtggtctagatgtgatgtagatattgaatttgttgaaggccggatatcaataaagggtaccgccaacaagtatgcgtgagttcgtcatcttctagatctaccttatccgttgccgctcccatgcaccttaatatttgtacaccataccaaccaaagttggatcttggggaaaaaatcaccagggtcacttgtgttgtatacgttgtaccatagagtcaatcttgttttcttaaccgtgactaaatgatttaccataaagtttatagaagttcactgggtcattagacccgttaataattacactttagctctacccttgatatatactctcacacctattacctctccatggctcgtgacactgtggctcatgctcgtgcctacctcgatggctgactgtccataggttaaaaaaaacaactaatgtatagtagcattggcatggctggctttagtctagttttacacatctacacacgttaagttagttattcatacttttttttattctctatgaaaaagtatataatcttagaaaaccatgatatacataattattgatggtctatatcgctcattataaacctgtcacatattatttttataaaaaaaatttaaagaatgcacatctgccttaaacaatcttcgaaacattgagaccgatagctagtaccacgagactctacccccttgcttcgttatcttgaaagataatgtatctacacggttgtctctattgggctatcatatttgtacttccatatcttaaaattgttgatccatctgtatccgtgtgtagctagttgggacagaggtagtactaggtatttttgcttgtatatgctcaattgctgaaacaatctctgttttttttttgaaaggagcacaacacgggaggcccccgctggtagaaagatttgattaaaaataaataaaaaagaaaattacaaaaaaattgatccaattcaagattacatccttatctctctccttaattctaaacagcagaaggaggatgtcaccctttaagagttgcgtccaagaattcaaggaaggaattttttgctcaaaaataaaaccattcctttatttccaaatattccaagtaccatataaaaatttgtccatgaagcactgtccctgataaagggattaatttgcatggcgcgacatactttccatgctcattgaagtatcccaataaataccaagaacattccaacaattctgtgtaaacgagcattgaaaaaagagatggatcaagtcttccatagaattaactggaaagagcacataacttagatcacagtcaggaggagcacaatgcttatgacccaacatatattttgtatttagtctattcatcaatagcaaccacccaaagactttaactttcgaaattgccttgcactaccataatcagagaaaataagaaggtggctgcatagctctaattaaagttcaaagcataggatttctgagaagaatacttcaaattaccccaaatgtattcccagacatctctatcatgagacagattcacatcatttaaaatgactaacaaatagttcagctcttgaaaagcttaatgagagaggggtaaatgaaagttatcctcaatatacgtagagagaaagttatgcaaacctttttcaccctcgctttcatatcaactacttcctccgtttcacaatgtaagtcattctatcattttctatattcatatagttgttaataaatttagacataaatcatatagttgttaataaatctagaattattaacaactatatgaatgtgagaaatgctagcatgacttacatcgtgaaacagagtgagtatattttagagtaagaaccacgtgatttcatgtcctcgaaaaaaaaaagaagaaaatccacatgctaacatgccaagttcaaaagagacgtacacttgcacatacattacatttcttttctttagaaaacaacattactacattcttttcatatgccctatacattgctccaactcctgtgtagcgttgtttgctccgctagccaccacacacacacacacacacacaaattaaaagaagaaaaaaaaacgcctcaaaatgtactccctccataaagtaaatgtagttttataccgtttatgtctaacatttgaccgttcgtctttcttgaaatttttttatgattagtattttttattattagataataaaatattaatagcactttatgtgtaactattttttaaaaaaaaatttctataaattttttaaataagacggacggttaaacgttggatacgaataccactgctgacggcggacacctcagccgatgcagagatctccgcacgaatctccacgcctccttatccccgacccaaacatcgtctggctcgcacccgcacccgtaccaaccccgaccgagcgagccgcatacgcattccgtcgaacacctcacccgcacccaccaccaccaacctcccaccccacaacccacatccatgtgcacgcgcgccctcctttcctnctncgntatatatcccctgctttccaccccttcccaccactcccctctcctcccgcctcgccgccgcaaccaccgccgcctcgccgcagcatcacccgcagccgccgccgccgccggcatggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcgtcaacgtgcagccctactcgggctcgccggccaacttcgccgcctacacggcgctcctcaacccgcacgaccgcatcatggggctcgacctcccctccggtggccacctcacccatggctactacaccgcgggcgggaagaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggtataaaaatcctatccagtccaatcctcccacccccaactcgtctcgattagttgttgcatttcagaaatgaaaaatgaaatggggtaaaattctgtccgccggcatttgcttcgttgctgtctgctgtaaaggttggatttggggatctggatggtgagtaatcccgagttgggttttagagtgaattggatgcccgatctggggggtttggttgattggatctacaccttggtcccgaa

SEQ ID NO: 8947 - DNA, 21778 bp, Oryza sativa
  unsure (1)..(21778): unsure at all n locations
ggtggttgtatgtgattaaactatgtggtaactttagctttatacacatatatctataaggacctaaattgggtgaggggtgttggggttgtttggaataggcaaatcttggaaggatgtatgtctctttgtcttctagcttgttttgtttattagcaattcgatacaaaatttgagtctttcagtgtgctttagtgcaattctttaaatatgatagatctggtagtctgtggtagaggatttgttttcctgtgttcggtcatgcaacttgccgagcactctgatagtggatacacaatggaatcctagttgtcttcaatcaatttgctattttgcgctcgcccatctaatttgtttgttttgggtgttatagggcacaatatattcatttgtgacaagttgtgttttgcttcatcttatatatttataaacattgttatgaaacaatagcttttttgctgagtggtaacagatctctaaagaattatctgagtggatattcctgttagccataagaatacatgtttgacatattcctcaatttcttattacgtgcaccgatgctgggatataaagggcaaaatcataagatatactgttcattcaggttgtttttctttggtgtctggcatgtctgaactgtatgatgatgtattaatgttaattttagtcctatagtctctaaaatatgcttgtttcatttatttaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaagatgtgtgacctttgcagcattacacttaacaagaatgctgtctttggtgacagcagtgcattggctcctggcggtgtccgcattggtgagtgcattccccttcacagaaaatattatcatgctaatgtagtaacatcttatagtccggatcttgctgattgctatggaattgattcatggttacaaaacacaactctgcaaaatcatgaattaatctgatgcgaattgcttcgctccatgtttcactacagagcctctgtccatagatgatagttatatcgaacacaagtgctactactggacctttctttgcacaagcaagtatctcagacggattctggctggttttcaggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaggacatcgagaacctcaagctggaggtcgagaagttcgccacctccttcgacatgcccggcttcaccctcgacagcatgaagtacaaggagtaggaaaacaaaaacacacacaaaccatggtcctaccgccgctaatcgtcgaccagctgtgctctcgtggaccgccgtcgtcgtcatcttcttcctcggcacaagctggccctgtgttacggattttgtctgcccatcgagatgataggtttcataaaacgctctctcccccaccctgctgctgcctctggtttggttgccaacctcatcccccatcggtttttttcctcctcttgtttctaatttctaggagctgtgccttttggaatcatggaatgtcaagtatttgccaataatcaatccgtttgatttctgcctaccttgtgttttctgtgggattgctaaactatcaaactgtgcgaagctacgaaaaaaagaaatgctggaatttttcagagttgggtacatggatgtgccactgtcgtgcagcgcattgccaatacgccgactgctgtagattgcaacgtgacggtacgcgtcgcgcgttggcggctactagcgtttaattgtgtagggatctctgtgcggcgttaggtctcgccatggaagggaaagggagaaagccattacactagctgtacaggacggtctggcctggcggtgcccacacatgctgtgaggagcgtgtggcaccgctgctgcaaccacaacaacattgatgtgcttttcacgtaacctttttaccttacgtgccgtccttttttagaaaaggaaaactctcataactttattagatcaaagagcagttacatcgctcactaaccgcttaattgaagctactggctcctccaaccaaatagatggtggattaagccaggctgctctagcaagctcgtgagaaactaaattagcctctctaggacagtaaacaagagttaccaatgtagaagcttcagaaagaaccacacattcattatagatcgccgcagctgctgtcgtcgagaaccctccattttgcatcattgtgatgacttcgatacaatctaacttagtgatgattcgatcaacttgttgacctctagctagtaaaattccattcctcaaggcatgaatctccgcagtaatactccatgcgatcatttgccaatgctatgtactctactttatcatcccaaagaacatctcctggcaatggcatctacattcaatttaaccattccctcttatggttgacaccatcccgatctagcaatgcctatattcctcgggttggcttttcaatagtttaggggagtacaccaatagccattgccgccctcgttggttcttgcaccttctcaccatgaaccaattttctcccaccaaatataccagatacctaccaagattagaatctgagcactcacataggcaatcaaacttgctttctcatcacaacataatagatattctagcgatgtcgaacctgcttgtgtcatcttttgtaggggtacactgtactttcaaataaccacgtagaattcatgttgttttctttgagattagatcttcattggtcgagactattgggagaaggattaagggtgctttctagagagaaggttgggaatttctctcctgcacacgtaaaacgtgatgactcattagtacatgattatttaagtattagctataaaagcttgagaaattttataaatacgatttttaaagcaacttgcctatagaatatttttaaaaaatacactcaattaaacggtcgggaaacgtgtacgtgtaaaataagaaaatagaagttgaaaacatgtagttccaaacacatcctaaacaaatattactgtcacttcatttccatttctctttgaaaatccttcaaagcgtgtagacggctccccagctcatgccgcgccagtgtccgacaggcgacagttttgcgactctttaacaaacttgtttagtcacttctgctaccattgaacggttgaacctgaagtaattttattactaatcacaaatttatggccatatagtgatgatattgtaggatcgaatcacaagaactaagccaaccagaggggggtgaatggttggtatacccaaaaaccgaaaacttttagcggaaataaaagttatcctcgaagttgatggattgcggtctgaccgaaggtattgcgccggtctgaccgcctgatgaacgtcggtctgaccgatgtagatcgatcggtcgaaccgccgagaagcctgccgcccctgtcgctgccaccggtctgaccgcccgtatgccgccggtctgaccgccggtagatcgccggttagaccgccgaaacccgatgaaacacaaatcgaagaactcttaaagtagatgacgactttattgattctctctgtgtttacaaagtgcaccaacagcactccttacaaaaatttcgactaaactcgaaaccataactcaaaactcaactcaattgctctctaaagcgataccgggaagcctcacactccctctctatatatacccgaggtaggcagcctaaagcccacgaaccaaactcatactaagagtcctaaacaccttaggaaaccctctagtacaagaaaaaaactttacataaccaatcgtaccaaatttggagtccttccaaattcgactccgcatctcatacgcacacaatacctccatcgtatgccatatggaatctccatcaaccacgtgcattaactctagcctaagtatctcgcatgatctctgaccaccacagacgtcgtcttatccccaagccgactcccggtccatcaccgcaaatactctcccgaggcatcgagttagcaaacaacagtattacatacgtatagtatccatctagaagccataatcatgaaataatcacggatatccaaacaaacaacccgaaaccgaaaccgacacagcgtcggtcggtcagaccgtgagctggccggtccgaccgctcgaccaccgccggtctgaccggcatgcacagcccggtctgaccggtcacatgaaataataaatcctgcgatcacctgtgaatctaaatatttccaaaaaccacttcgtgaataaattccaaataacaaaaccaataatctccaatgcccaattgttcatcatagaataataaccaaaaaaacacctttgattttacagatattcacataaaaaatattttaccccattgaaatgttcttgtaattctaattcatgttgctcatttacatctccagccaagaccggttttattgcagttgattatctagatgattatatgtataaattaaatattttgatgaatatacttaacaaatagcttaaaacaagagaactaagcaatacgataatccacaaaattaatccagtgaaatagctgaaaagaacaatactcctaacttcttccaacagttttcatgaaaattggttcaactttcatatgaactgggaaacaaaaatccagcgaaaccttcgacagttaggcatccacaatgtgatgcaaatatagtccatagataatattatattttattcagctacctattaacattatgtaactagtccatatagagaaaacaacaaaagatatccattaagcatatggactacccataaataaataatactatctatctctatttctctctcatctcctaagagcatccacaatgtgagccactcctagagtgtcactaactatgaacactcgtaggggaactcagctcacactgggagatacccctggatgggctcctcaaaatctgaagcaacccggtgaggatactatagcccacaatgggtgtcttggcccaaagtatccctagatgaaaaatccccaaataccccttcctgccagcctactctccttttccttctcttttcttccgccctctcttctcgcttcttttcgcttcgtcgtcgcccatctcgccgccaccaccacctccctcctctctcccccgccgctgctcgcctctctctcctctctctcccgccgccgccgctcgccatccactcttcctcgccagatgtggccggagtgcgagggagattagaaaggccgccgctaccgccggagcttaatcggcgagggcgacgaggagggccgcctactccaccaccggatccatctctctctctctctctctctctcgtcgtggggtcatcgctggaggctgtgtgccgcgccgccacccctcttcctctgcctgtcaccgacggggagccacgcgcggatctggcatgccgatgcggtggtcaacagcgagatgtggccagatctggtcttcttctctccctctcactgccgtcatttgcctctccctatccctctccctctctcccatcgaggtggtcaacggcgagccaccggtggcgacagcggcggcagatgaggacgaggaggtcgccggccgccggctgtggatgagggcgagggtacaaggggaaatatcggggtagggcgccatgtccacgagctccccacgcttcaatgcagtgcctggctcagaccccccacgaaaaagtaggcaaggcgcggagggagccgcgtcccctgcgaggcgccgcgctcccctgctagggaacagatcagcctcaaaaagcgacgggaggcggacggccgtgaggagagacacgggttgaggaggtgcccattgctgatggcctaatgctaccttgtatttatatacattgtggagattgctatagttaaaatctctttacgtgggtctatctatgtggatcactttagccatggcgatgccaacgtcattgacctgcgatacaaacacactgtgcaacagtcaatttcttgtcagggcagtagggcactatttggggagtgcagcgcaggccggtgggagaaatgtgggtagatgacatttgtgtgattgtgtcggtgcatccatgtgatctctgcattaaggattggtggctgactacaggtcagcatgtggtcttcttctttttttttttaactcaccaaaatctctgttctttaaagaatctccctcgaaaaaaaaatccaaattcatgtgatatctcttgtctgtagttacaatatctaacatagtagcacttcggagtaatgctcattgttttgttactgagacactcaagtagatgtgtgaatttatgaagcaacagtgccagtcataatctattaagagtgctttctgaatttattcagacttatacccttctcttctgtacaattcagtatgttcggaagttgatacacaaactgatgatttcctcaccaagaaaaaagaggaggaatcacaccatgaataatgaattggtgaaatttgagtctttttcccctgaaaacactgcaaagcaatatctttattaaacaagaacgaaccaggtttcatcacacgactagctattaaaaaaaattgaagaaacgatgagcatccgaaaagattcaacgtgctcaattgcgtataccaactttaacataccagtacaattgtacaaacgaagaaaaggagcaatttccatgtcaattgatggcatcaaatcttatcaatgccgacaatttcaagcacaaagcagcacacctcccctgatccaagcttccttataatattatagcttgcaaccagatcttacatatacatactcataagatctttgaacatgtaaatcatccatgaatcacctacaatgattcagcaaatgcagaacataaagaagaagaaagaacagaagagagggtaaaagaaaaacaaaaaaaaaataaaaaccaagatttgcatctcaggtagccactcctgcaattcctctcatggcaagatcatccagcaaaacaagcaggcagtgcagtagtaatcacggatccacatccctgcacctggtgatggtctcgcatccccgggtgtaagggttggcggtggtcatgatcctgcagttatagtaagggacaccctgcctcgagcacggcaccacgtcgctcctcagggcgtcgtagctgatgtacctcctgccgttgctgctgctggactcccacagcatcctgctgtgagcctctgaatccatctccatctccatggccatgtccaagctcttcaggcagtggcctccatggaggaggaggaggagcaagaacagcttggtggtggtggtggtgattgatggtggtggcattgttgatggaagagggagatctctctttcttcttgttgttgtttctttgcttcttctctcactcagggtctcatctaggagtagctgaattttctctctctatggggctctggagtctggatctgtatcctgtgatgtactccttccttgatggaggaggaggcagaggcagagcctctcttgtgtgtgtgtgtgtgtgagagtgagtgaggaggtgcattcaatgcagtgccagacagccagttgtaggcacctgccattgtgtcctttctggagctgttcaatggaggagcaaatatcgaaggagagtggcccaggtttaccaggtcccgttcttttcttcaattggatgaaaattaagatttttgtgacatatttttaaaaactattaaatggtgcgtttcatacgaaagctttatattaaaagttgctctaaaatattatattaatctatttttaaagtttgtgataattaaaattcaatcaatcatacgttaataccacatcgttttgcgtaaaaaacttaatcttcatcttcaggagaaaagaacatcacctaaggtggtgtttgaatctctgtagataaagataaagattaagtgttttacgcaaaacgaggtgataataacgtgtgattaattaagttttaattattacaaacttgaaaaatatattaatctaatattttagagcaatttttatatatatataattttcccacgaaacgcaccatttagcaatttaaaaaacgtgccatgagtatccaaaatttcatccaactcttgttggagaaacgaacgcagcctaaataagttcagatttaccattggttttggatcttggggagttctgaacatgtttggaaaaattcatggtcgatttctttctttctttattgtgaagctcatttgacacattaatttggactttggggagctctgaacatgtttggaaactcatttgagattcttggttttgtgcaattttgttgaatgattgaaccataggggtggtggggttcatggtggctcagatctggaccatccatttgctaatcagtggttaccaggggagcagcagagcatccttctctcatacgccatcacgagtctctgtcgctcatgtggtcacaaatgagaaaattgtccaattgccagcagtgatgctgcttggtgtaattctgggcatgagttcagtcagttccatattttctgggtccaatccaaacactactgaagttatcaggtgctctgagagtcacaacatggtagtagtattaaatgtttcaagctttcaaacgattacatcgagttaagcttcagttttacagtagtacttatgtaaaagactgcaaactatactccgtatgtaaaaaatgaatagcggcagttaggaattcctggagaaaaaaacacaaattacaagtacgaggtgtacctggctccagaaatcgtaccaaaacctttataggagtagcaaattacggcagtcattcagcaccctggcaatctgggatgctagaaatagcaaaattttgacaggaagatttacatgcataagaagctaaatatctaatcatatatacaagattcaagaatatttacaaggcatcaggagtttcctgcatgtacttttttcagctatcatgcaacttgtaaatctcgtcaacataatcctcaacatcccaaagaaaggaaccaaatgcaatggcttcaagcaacaatctctttagggatgacggatcgagtatcactgcctcatcaggctctaggaaatctttcatgctttctctgaacagtgcccaactgtgcttctcaatgagattagaagcttcgcatgagcgcagccttgcgcataactccaaggtctttggatcaaagcccatcatgtaactcttcaagtcatgcagatcaacaacagaactcggttttgaggaagatgatatttctgcagaacctccaatggactcttcctgttcttgtttctgggtgctattaaattgtgcattcagaaactgaattggtgggcaaaattcttgtgactgagcaagaatcagctccaaacgatgccttgtagtgacagatttcagaaagtatccgtacattattgaagcagaataaatccgactaaattgcattcttttgattctaagtgttgagcgattgatcttgggaccatttctatgtacccatctgataatactggtcaagtgttccctaattaaacctagcacctcaggtccatgaattgattctagttctgcctcccttggtggccatatttgtagtcttttattgctgataagctttgatagatttggaaccaatggaacttcaatcttgaaaaatttataaacaatcaaagtgtacatgatatcctcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctagctacatgaaatgatttggtaaattttaagtttttaacaatgaagcttgtgactcaaaaatatcgatgcagtatcaactagaatggattaaagaaagacctgaccctccatattcttccatgtagatttactagtatattataagtgacgctcctatatgattcatattaaaaagactagaaatgacgttagagctccaggttgtctcccatcatttaaccattgaagctagcttttataatttcaagcctcacttgcaatctacaatattcacatgatttcattaacccaacctatattttatttctgtaattagttgagaaattttctaatccaacatatatgtccaaataacaggtagcttatggactgaagaggtatcacctaattggttgttcttcatcagcacaacaaaataaaatgccattctaagtgaatgctgttttttattctatcacaaaagtgcaacgttgtctgtttaataattaattaatacaatttacgcttgaaatataacagagaacttgaatggggaaaaaataaggatagcagcatgtcgacctcctgagaccactaaacacttttgacaaagggcatttgtaactaacctgtgaaggcagtcctcaggagaaccgatgctatgttcccagcggatcaaggtgtcctttctttgattagatagttcttgaagttgctttgccgcagcaactgggagtacttgtggctggttcttcaacaaaccacacaagaagcttccttcccacgtttggggctcgagtggtgcattgacactttcaaattcagagtcatcaggctttgcaccagcaactgtagtccgtggacttctggtactgcatttagatttccaattcaacatacttccctgtgttgcaaagttgatagggcagcaattgttatgacaatattctaggcgaaacacacgcacaaatcaatgatgcaacaactagattaaactaatgcagagggcatgaataaatcagactaaattcggtaagaatcaaagatgcatgttgtggctgtggactagtgaatttttgaaatatcttgtctggaaaacaattttgacggtgcagtggataggatactgatagaagaaagacgacaactgacaaataaaaaaaaaagagaaactaaagtataagttttacttcacataaacatacactctaaagctataaaaactaagactactattgagcagtaacaaggaaacactaaaacttaatagaaacagacattagaaatttatctcctttcacacatctcagtttaagtaaagagctcgaatccagtttgaaacagcctacttgagaagtaaaacctctcatttaggcagtacaggtacgtcgtaaccaaagctcctaacttccaaaaacaagagtgggaagaattgcagcgcaggaggtcgtttgctacacctcatctcaaatcaatcactccggtatgcaaagcaccgcccctaaatataaaataccacgtcatcatcatcataatcatcatccgccatgaacaccaacgatcaatgaaggcaggaaccacgagactccacgcatcccccctagtggatttacacatcacgggcaagagaggaaccgagaacgtagagaggcgggaggtgggggggggggacctgcagcttccagcgggatgaggaggagacgccgcctcggcgtacggcgaccgggcgggcgactgcggcggagccggcggcggcgcgggggcggagggccgccatgccgtggttgaggggggatcgaaggggataagagttggatagcgtttggggtgcgtgcggtgcggtcggtgcggtgcagtcagcggcttctctctcgctcgcacgagtcggcgacgagtggtggagagactctcgtgcgaggggtggacacgcgtggtggctgtacactcgctctactcggtggtgtgggtgtggcctgcctaccccctgcccccacacactggcacggcacattttgacacgagagcccttgtgggagaaatccaaacacacggcacaaactttttgaaggatggaaaaagctataaaaaccatcagttttacattccaccatgtaatttatgccttgtttagttacaaactttttcttcaaacttccaacttttatatcacatcaaaacttttctacacatataaacttctaactttttcatcacatcgttccaatttcaaccaaacttctaattttggcgtgaactaaacacacccttactttgttataaatacccaccactctacttggtttgaacacacggttcaaaattttcaatgatggaaagttataaagaccatcagtttggcattccatcctgtaatttatttatttttcaaatgcccaccactccacttagttttgatgtaacaaccacccagtgcgcactggcttaaccaaatcagctattattgctactgtagaggtacccccagactaagctagctgagtcaatcttatcgaggtacttgtatttgatttattctttatatttcatcgatttttttaccgtacatagcaaaaataagtgcgacattgtttaatctctcatcaacaattttatttatggaatctcaaaaaaaaataaagtcaagattatactcctaagggtgtgtttagataatgggaaataaaggggagattgggattagaaaataaatgaagggttaggattaaatggaagagagagaatgaatggttatgatttaaagatgtcttttggtgagtgggaaatcatttccttatcccattagccaaacagtacctaaaagtatttaggttgttttctcttggggtaggaaactttccccagctcataaacggagtggtagattagcatatgattaattaagtattagcttgaaaacttaaaaagtgatttaatgaaaacttgaaaagcaactttcttatacgattttttttggtaaaaaaatgtatcatttattagttcggaaagcgtgtgcatggataatgagggagtagaatttaggaaagtgtagtgccgaacacagccttagctttgattaagatcacgttaactgctcacaatttatgaaaacaaattgattcggttaaatatgtgtatattagggaggtttttgcaacaaatgatttatgtgggggaacgtaaaacttcaagtaattttatggggtgagttttgcaaattttcctctaaagaattagtagatatatgatctaggagacatttccctattttctccatcccaaagtatagctatctttagaggtatatatggagattaagaaaacaagtatagtgaagtggtacatggttgtgattggttgagatggtaaaaggtagctttggacaaatttaaattgtaaaaaacaattgtatttaaagatggagggagtagattcataataatattggtcctatgtggtgaacttgagaacttgatattataagaagtagcagatgagaattaaaaatgctgagtttgttagcttttggtttcatagtttattttactgtgtggagcggagtggttcggattttaaagcaatggtttactagtgtgaagatatgggtaaaacagttgtgcttgcaagactatgatcattcctactactcctatattctattgactggcgatcgaaatcaaagaaattcttggaattagattaggcctggtaagatccattgaaatcaatggtggcacactggcgataccggtcctcttttttcctcactcgatagatttcacacgaaaactccagtcctaatctaatttcaacagactcgataattttttaaaaaagaatatatattgtgttgctgtaaagaacttattgggttatcttcttttgggcttatacttcttccaatcaaatcaaaattatttcctttttgttttgaggggaaaataactttccttatgattgcaataaacttgtgagaaggactaacaccatcattcctagtcctcttgccctacatcacaaatcaaccaggaaccaacaattgtgagaatttcatgatttaaaaccgaagatccccctttcaaattgtccaatcacaaattgaattgaaggtcaggcctgagctcttgatgcaatctacagatggatcaagttactgtcataatcagtattaccctttggagagaaaccattggtagcatcatctctcttttcaacttttttcttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaccagagcagacatgtacagatgtaattaggccctatttctttcaacttaggattattataatctagattattgagagtaggctgaaagaaacaaacaacttattgaagtagcttattataatctagagcccagcttattataatctgataagctcatttaggtaagctttttccagattattgggtgaaaaattatccaccatgccaccccactccctatttagacttaaaaacccaataatctaggctctaataagctaggaaagaaacaactaaccgcttattctactatagattatagcaatctagcttatagtaatctaactcaataatctagattataataatcctaagctgaaagaaacagggccttacaagaacacgtatatacacttcacactttacagtgagtttatgggctacaacgcctatagacacgacatacaaacaaacagaaaactactgtgagctagcaaagctatacctatataaagaatgaatcaaatatttgatcaattgccgccgccgagcaggtaacccttgagcgctttcgcaatggcaacggcgaccctcgtggctccagggaactggccggcgacgggtccaagcagcacaaaccacaagccgaggaggacgaagaagaatgcaacaagggcatatgcaggaccgtcgatggcggaagggtctccagcagtgtggaaaactatggaggacccggcagtggcgacgaggaagatgccacagttgatcagtagtctagcggcaggagggagctggcggtttgcagcgggnatgttagnatgatggtgcaaccctggaacgggcattggtggatcagcggctgccgggttcaccgccgcgcgatctcccgtgatcttggaggcgcttctttgtgaaggctgtgagatttcagaatcaaataaacagggcattataagattcatcaaaaacaaaattaaaccattgaaaagcatgcatagctcaaagcagggatacaaacaggcataaatgtttgatactttgatatgaacttaaaatgcacagctcacttgttaataacgttttttatgcatttggtaacctactcctaacactacacaagcaggagtattgcatatgtgacttgtgatgagataacaataacgtgtaggtagcaaatattcttcaaaatgtagatacagaaatgataatgcattgcaacaatccatagaattagatcactcttttctagcattatgcatgtaaatcgcccatggggctaaactcttaaatctatctatcctgagtggtgtttcaggatgttgtaatcccttgattaagtttcttaggttgtcttatcagtaatcactgtcacgagatttagcctggtttccttttttgaaaatgatatacgtatgaccttgttgtccggctactgtgtacgaccatggccacaatgaaaggctcagacggcaaatgtctcactccgtgatagaatctgacatgcgcaggtgatgccgtaacggagtcggacatcagtctaacgctagcgtcgtatgtatagcagcgttcttaatttttctccctttccttttctggttgttgactcttttctggtcagttcttcaaagctgatcctcccattctatgcttcttctttcaccttcttttaatacaaagaatattgaactgcaattttcagaactagcaagaatccatgacacatgtaaaccatctcaatatagtgttccccccaacagggcatctttcagtcgaagaattcaattagcatagtttcatccaaaatggggggaaaaatccagttatatcagttccctgaaattggtcttggtttccacagaactcaaccgaacccccaccctctttctagtcatccctgcgctgcgaagagaatgcacctcgagctattacgtaaacctgactgcaactattccagcaagatctgtgaatcccttcgagaagggaggcacgaatttgggatgggaaagggaatccgaatcccttcggattcgaggagaagggcacgaatggggagggggaaggggggggaggctttaccgggaagccggcgtcgcggttatcgaggccctcgccggagaggacgtcggggggcaggatgccgctgtcgtcgtcgtcgcagtcgtcctcgatcgcgcggcggatggcccccgcctcgaactcctcggcgccggagctcttcgcgataaaactggtcatcttcttctcgccctcggccgccgccatccctcctatcgggtcgcgggcggtggtcgctccccctcgcgtcgtcgagcaaaccctacctctcgccgcggcggcgccggggggagcgcggtgatcgatggggatcgattgggtttggggggatctggcgcgagcggggttgggccttcggatggagcaggctgggctggggactatatgtattattgggttatttgagttggaggaagaaatggaggcattgcggacgcggtgtggccgcggtgtgaaaaaaataaaggttaaaacttgaagccaacagagtggctatctcattcttcaaattaaattttgatatttttgaatcaaaatcctaatccaacaaccttgccaaccggatgaaaaccatccgactggccaaagtcctctatgcgttagctaaagttggccaaccaaaatgacaaagttgtcttaccacgcatgggccccacacattttcccctttctcctttcctgtatgtattgtctttccatcccagatcgagcaccctccctgcgctcctagatcgagcacgaggccaccacccccttcccagatctagtgtgcgattgagcgcacggccatcgcccccttcctagatccaacgcatgaccctattgcgcgccgccaccggcgtctatctgctacgccccttgtccatcgccgcgccatcgtccactgttgtggccgccgccatccccagactgaaagttgttggccccggatcaagcgctcgatgctaccgtcgtctctccggtttccaccgtcatcaagagccctgccatcgtcgcccaatccacaccgactcctacagcctacaggttaataccctcttccacaaaaatagccaattttgttggagatgctcttattagagcaagtaatatgctatctaaactaatatggtaaggtggaggggagaagaaaagagagagtaggagttacaacttaacttacatggataaaattaggggtggcatttgcctcttctataaaacttgctcatagacagaaatttttgttaggctcttcaaccaaccgaaattaatttggttataattcggttagcactctcgattaattgacattaggaaatagacctaattatgtatcttgatcggtgttaagttgtaagttaaatctagtcaaaagccatgtgtgttgctgcggcactataggatgaacatatggaaaaatattaattatgctccacaacactcaatattgtacactaaatgaaaaaacatactccgtaccaaagaaacaaaattgattgtggataacaaatctgtgatctatataacccatgttcttcgttagggctagctgattcttgtcctttcatatatccttttcatatccacatcattacagattaaacaaaaaattccctgtcaaagtttagtgcattagccattaatgcggtaaaaggcaaactaccataataatatcgttgaccgttgtaaacatgtaagaatggttgaaaaatatagtaaattcaaaattaaaatgaattgcatgggacagacccaaatgttcgtaccaaaatgtaaacctacttgatagagtgtgttgcacttaagcaaaatgagtaaccgcacaaaataaaatcaagcaaccaatttgccaaagaaaaacacccacgagcaatctcaaatggggagaaaaacagaacatctttaaaatctgagactaactcaccaaatcaatggtatcgtgtgatcgaattgatgcatatataatataaaagtcagacaaagaacacatgtactaacattgaagggaaagcggagggcaatatgtggtttgaagtgagaagtttatgcaatagtctaactatttttatagtctaagagatagaaaaagtaactgcaatctctgaagatcacttaatgaccagaagtattacataggggaaagaaggcagtttcagaagaggaaagaaggcagtttcaggagatcaattgatcatctgttgtaatggttgcatgcatgcatgacaatagaagaggaaccggccggtgtaaagaagtgtagatgggctaggcttggtctaacattaacagaagatcaaatatggctggttgctacttggtgattaggagctaatctagacacacaagttagatccaacggttagcataaagtaagatgatgtggctgcaccatagaacaaaaaattggtactattgattacaccagagaacaaagaattggtattgattacagttagtggggatcaattgtttaagtatactagattactatgattgatgctcttgatgagttgatgtgttatatgtgctatttaattgtcaacatatatgttctgcagagagaaaagttgctacaattttactaccacacatttcggttatgactaaagaccggaccgaaccaaccaaaacataactattcattcttgagttttttaaaaatgtaatttgatattgagttttaaatgactgaatttccttaaacatgtcatatacttgcgtgctatactccttttcctaacttatgtttcctcgtttttcgtgtgcacatttttcaaattgctaaactattaaaaaaattaggaaagttgctttaaaaaatcatattaatctattttcaagtttgtttagttaattaaacttgtgctaatgagtccttctgttttgcttggaggattagttaccaaaatgcaatgccagacattgcctaaggtttgcgttcggaactacaagtttccatcttctaatatctcattttccgtagcacgttttccgaactactgaacaatgcaacttttttgcaaaataaaaacttaagtgaaattgtttttgaaaacttatattaatccggtttcaagtttatttaagttaaaacttagttaatcatgtgctaatgagccacctcattttccgtgtatgaaagagaagttcccaaccttttctctcgaacgcagccttaagtggtgctcgaccccatatcttcttttcttgcctcgcacgggaacatatgaacaatttgtatgataaaagcatgttagcaaaattttgtaataatatcgtgattatattgttttagcttaacacacataaaaaatggatctttgggagaggacctactcaaaattgtgctaattggtcattgacacaatccccatattcttattctcaagagtaaataggcacacctatcacaaaactactggctaagcattttttacataaaaccctaccgttgggggcatgttgtatcctacaacccatatttctttgctctcctcctgccaccggttacatgacctcattccctatttccacaatgaggatgcacttctctgtgctctccgcatcgtcgctaggcgtgaagtattggcgccaacctagcatatttcctgtcatttctctgccctagcccaacagcgcagtacgtgatttaatcgatgcctaatgaatgatcaaggagacctatatgaagggagaagagaagcctgttctgaacttcgcagcaggtaataattcttttcccccacttatttaatgcagatttggctatcttaacaaaccataattgtctatatggatgatggatttgaaatttcccctctaattgcaagtactatgctataaaagtacttattatttatgttacgtagcatccactaagctatatactctgaagacatccaaataatctaccatatcttaccatcctaaaaaattggtgattttctagaaacttttgcacataacaatatataagaatatttggcattggtagcaaaccaagtaaaacccacacacttcaatcctaccaaattttggtgttgaaaggttaattctagcatcaaactgaacaaacccttaatcttttaagttgtactctctatggtcataaatatttgatggtacgaagatatcatcaaagttttgaaatttggccatcaattcatattacatctaataatttttaatgttatttaatattttttaatataatatgcttataccattttttttaagaactatgcactttgagaagttattgataacataagccttaaaagttcgccctaacctattctaaatatcaaatattttattatcactaaagagaataatatgtaattataataattttcattatttactcaattaataaacaatatgaaaacaaattctattacttaccatttctggccctattgtcccatatttccgtaacacaattttaccggtataattttcatgcaataattccacccatctccagcctatatagaggttaaaaaaaaggggaatatttgcccaaccctagtaaaacgtacaaaaaaaaagcacaatatcaaacggagtctattattcctattccaagtacaaatagagtggtattatttcccttcttcttcttttattcggcaacggattctatgggctcggccggccccacccagcgtgcggcccggaccatcacacccaatcgtggccgtccacacctccgcatccgacggctcctccgccctccacgtgtccccacgcagccctcgccctcccatttctcctatataataatatcccccacctccccacccacccccaatccaacccccaatctcgccgaatccccatcgccgccgctgcgaaagctagggtttcgtgcgattcacctcctcggcgacgaccgagaccgcgagcgatttcggagggctcgatcgatggcggttgagggagagaagaaaatgatcacc

SEQ ID NO: 8948 - DNA, 7414 bp, Oryza sativa
tcaagaactgggacgccgacttcgtcaaggtcgaccaggccaccctcttcgacctcatcctggtataaaagcccccccctctccttcccccatcgcgcccctaccttttcttgatggggattcagatctgcggttattgctagatctggatttgttttcttggtcaatagctcgaggtgcattctgttccaagctttttgggatgtatttcatccggtatgtttgttactgggttggatgtggtttccatgcatcacgcattcattcatgtcagttgtggaaatcatggttgcgtgaatatcattagggaaaacaagtgtactttgtgcagatggggtaacggtatgattctgtatcctcatctgtatggtcgatgattgtatccatatgattggataaatgtgccctgctatttgtttgtttcatactggtaattatgtaaatcaggactgcgtagatgtggtaattgatattctgcagattttttggtatgatcggttgatgtattgctaccatgggtttttattaaatacaacatttagttaaagaaatacataaagagctatgcagttttgcgattgtatatatttgaagtatgaaatatgtttctagtgccatgttgtaataaactcgtccccttctgttttgttgttaactgttacacaattccttccctgttcataaggattttgtgcttctctatataacaagcatgatatagtatgaaattgattgtttagatgcatgcttgccaatttggtagattaggtcaagctttaaatttgttcccttctgtttgttgttatacattatttcctttcgtgttggtaagaatttgagattcatatatcaagcatgatatatgtttgtagttctatgttgtaataaattctctcccttctgattgtaatgtttttctttcctgttcataagtcaattgcttttgttatgtccttacattgatgcagcctccttatgattatgttcataaggaaattagggctgttacagataatgatcttacattgatgtagtcttgtgatgcatcttttatgtatgattgactactgtattgctaaaatggtgaagcattatcttaagggatttagtacttgttctgtatctctaatttatgatgtttcaggcattgagtaattgtgtctctgtatcttcactgtgatatttctttgatatccagtaataaattcattgcatactacagtttgtgatcacaaattcgttcttctcttgatcaattcattgcatactacagtttggggtcataaattctctctgctcttgttcatgaattgtaaacagttctgttattttgttcatttattctttctgctcttttttcatgaattgttaacacttctcttgatctaagagaaatgatggcagtctcatttttttctttgattgtcacaagaatttactatctaaattaagttgcttgatggtggtggactattaacaacactgcaattttacaatgagacgggttatggggtatcagtgcatgttaaattattgcaaaacaaaatgtatcatgttttaacttgttgctcaagtgtttgtataccaacttctttctatggagggtccttttttttttcttttttgtaaaatgccgtatttgttcacatgcactgttttatttgtgtactccactattgcggatctaactttgttgtttgtttctcatcccacggtgtcacgtacctatttctagtatttctgcatttcaatttggatttgctacacactcgccttttttcttgaagtttttacatatatctgttatttctaactttgttgtttgtttctcatcccacggtgtcatgtacccatttctagtatttctgcattttaatttggatttgctacacaatcatgtgctaaagtaatttgtttcagttcatagtgttctcatttctacatttatgctttcttttatattccaaagttgaactatgtattccttttgtggctgaatgttgatctgtgctttagccatagtgattactgcttcttataccatgtttatttgattctcaaatcccacaggccgcgaactacctcaacatcaaggggttgctggaccttacttgccagactgttgctgacatgatcaaggggaagactcctgaggagatccgcaagaccttcaacatcaagaacgacttcacccctgaggaggaagaggagatccgcagggagaaccagtgggcttttgagtagaaggcatcaaggcctctgatgtcttggtgcttagatccttactccgtatctacgtatgctctgcttttatatgtcgtgctggttgtaagtattttggagtccgatgggggttcatgtgcacgtttagttggttaaatggttaagttctatccaggaaaaaaagaactgatgtggtcagaactactgaacctgttatctgcattaattaatactatcaatctgcagtgaaatgctttgctgaaaagtatgtcatattttttgtgcgaccttagcccggtggagtggtggagttacgatctgatctcaaatggcatgggtcaaatatcatctctttgccgtagcgtctcttcgcctttttgcctgggctgcatggcatctcgttgcttattgactgtctttcctaaatagtgttaggttgaatttgggttgttgtttcgtggacattagtattctcaggagataactacggatcggggtatgattctctgcagcttgtatttttctctcctctcatgggtcgggttgcctcacttctatgcaaactttttttttaaatctagttttctaaatgattgatacaatctacaatccgattacgccgttttattcattttcacccttcaatttaaatctttataagcatgaccatattatgagaacaattgataatattgttaattgaaacatttttatatactatatgaaacatcggggtgtaacgattgaaacatcacttaatatttactgaaacatccaaataatacaaggtgcaacattaacaaatgaatcaacaaaatatcaaaataagtcacatccacataacaccacgtacaacaatagataaaaattgattataacatgaaaaattaaaaatgtccaacatatttggattccaactaaaacattcaatgtgcaacatatttggattccaactgaaagattctcttttcttttcacacgtgaaacatcgaatttgaacggtcgaaacatatatattattttgacgatataatcatgttagatcttgttatgaagtttaattgtaattagtacgatggtataaatagattcaagaaaagatgagtaatttaaaagaaaaaaagtatttaaaacttggtaataaaactttatcctttattacacataaggcacatggtaggttgcacgtgtgagcagaagcacacactaggctgtaggtgtgaagagaaaaaaatagaacacataaagtataagtagcatccgattttttccacaataaagtatagtagtagaccgatttaaagtattttcggtattctcattgaccgttttaacgtattatgtaatatagtagtatgtagtatcactattggcaatgagatctagtgggtgagtcaactatatgacacttccattcacacttcctcccatatatgagcgtttgagaggagataagaggattgagaccattaacgcatgattagttgagtattaactattttaaattttaaaaatagattaatattattttttaaagtaactttcctatagattttttttcaaaaaaatacacggtttagtatattgggaaacgtgtgcgtggaaaacgagatgttctctctcaatctcccaggtctcccaggaacgaacaaagcataatgctcaagtgaatcatctgctcgtgtcaagccgtccgcggtttagtcgctacagtcataattcagaatttgttctttatttttttttaaaaaaagaaggtaagaagtttgccttatactagctctgtattaattattttaatagtagatgacaacgttggttttgaaaaataatgtttggctgttcgttttattaaaaaatataaatacggtaaagtgtaaatcatatttaaaagtttatttaatgataaaatatgtcacaacaaaataagagatatttatataaatattttgaatacggcaaatggtaaaactggcgaaagtcaattatgttgtctagtttcttaatataaactggcgaaagtaacatttgattatttgttttattaaaaaattaatataaatatgctaaagtgtaaagtttatttaatgataaaacacgtcacaacaaaataagtggtatttatatattttgaatacggcgaatgttatggcgatgccaatgatgtcatctatcaaagagacgtagaggatatatatcgatgaaggagatattctgaccagaattaccggaaatggaaggaaaaaagggccaattgcatatttgccactagtttgaaccggtatcgtggatttgccactgtaaaaagtgtaattgcatatttgccatcaaaatggttggaattcaatatacttgctattggactgacagtttagataaacaccattagaagattggtttttatgaaaattaggacaagaataccccttcccatgaaattgaaagattaacacatcatatgattcattcaaaatcttgcaattgacaaccctgactacacaacagaacattgctacgaggtcacaaaatcttcctagcagttcctgctgctagtgatgtagtatgtgttggctttgttgctgctgcccaaacagcctgttaatgctgccgccattgccgcccaaaccgcctgttgttgctgtcatccaagccgcaaggcacaaccgcttgctgctaccgtcggcccaacccgtcaccgttgcctgctgttgctggcttgctgctgcccaagctacctgcaaacctgaccgccgcagcgcctgcttctgttgagaataacatctccatggtaggacaagacgttgaagcataacagatgttattctccaacccctttggagatgttaccttaaaccatgtactttacttctatctcagaaaaaaaagcctgagagttccaccctttgtaagaagccgccttttgctcttgtatgttccttgggttttttttcctcccatttctggtaattcttacttcatctgaattttgactcttgcactctttttaaggcatagttcggtaggatgggttcccaacccatctcgctcgtgttccgcgcgcacacttttcaaattattaaacagtatgttttttgcaaaagttttctatacgaaagttgcttaaaaaatcatattgatccatttttgaaaaaaaagcatatacttaattaatcacgcgctaatggatcgctctgttttccgtgcgctggagataagttcccaactagtggtagcgaacacaatctactatactactccctccgtcccagaaagaggcgatttctggaggggaggatttgtcccacaaagaagcgattccagcctaaaaaactagatattttatgtatcgcatctatctgtgggccatagtactgagggcggtaacctttctctcctctcacaccacagaaaccttcgccttgtttgaatcctccgatctattaaatagccctccggaatcttgctattaaggagtattaaatatagattactgacaaaacccattccataacccctgggctattttgctagacgaatctaacgaggtatattaatccacgatttgctacagtgatgctacaataatcatatgttaaccatggattaatatacatcgttagattcgtctcgtaaaatagcttaggggttatggaatgggttttgtcagtaatttacgtttaatactcctaaatcgtaagattccggagggctatttaatagcccggaggatccaaacaaggcccttatctcttccccttcccggaattgccacctctctctcgcgtattcctctctctcgcgtattcctctcgtctctctctcgttctccgcacctccagatgtcaaatcgaagccgcaagcttcccttcctcctgatcctccccgcacgcccctccgtgctccacgtcgcttcccctcgctcccgcttctcccttcgatgttctgcgttcaccaggatgcggccgctcggatgtggtggcagacagttgcgagggtttagatccgataaaggagacagttccggtgggaaggattttgctcggtagcaacgttcatgaaagtagggctgggcaatcggttataaccgaaagttcgggtcgggtagttcggtttttttaaaagatcggtctttgaaaatagatgaccgaagttgtccataaaaatccagaaaccgacaattcggttaaccgagctttcgggtcggtcttcggtctcaaccgagtttgaccaaacactacatgtagcgcccggagcctaggtagctggcggagagaacggcaggcggcagccgggaggcacgcgtcgccgcgtcggagccctgaagagcagcggagaagacatcagagggcagaccggaggcacgcggcggcatgggtggaaagaaacccttcaacaggcacgagcagtgcagagcctcggtggggaagaagacaacgattggctcgaggaagagaggacaacgacatcgacgagctggctcccggagggcgggacgtggtcccgtgcgcggcgaagtcggatgctccgattggatcacggccgtatgtcgccgttgtcgtcgccatcagcaacgccgccgcacgccaaccccgccagtcacaacgcctcgacgggatacgggaacagcgcaacatggcatcagcgtggggtcatggagacgagggagttaccgagatggcgagatcgaggggataagatctgactctttcttttctttattttgttgacctggtcgtgtacttctgttctgatgatgatgggattagccaagggattaataggctggaggcgagggatcaatgggctggaggcctggtgcaatgctggtactttcggtcttcggttagctggccctaacgaccgaactcactgaagttagttcggtctttctgatcgtgtgaccgaagaccgggacttcggttttttaggttacggtttcggttttttcggtgtcggttttcggccctcggtttatatgcccacccctacgtggaagcggcggaaaaaaatatagttttgattaaagatacgcgagcttaggcgaagaaggcgtgccggcttgcggttctgattcaagaggctacagtaggaggtggccaggggcggatctaggaacaaaaattttaggggggggtggggggctcacttacacagtttcttcaatctacagccatttagagacctttagttt

SEQ ID NO: 8949 - DNA, 8671 bp, Oryza sativa
gcgcccgtggatctgatgcaggaggggacagcagcgtagaaggtggcttaccaacctccttttctaattccggcgccaatagttggggacattggcggcgatgaggtagacaatccattctgctaccaaaggtatctcccgctccatctccctgccaccaatacgttcttctcatgcaatgaaaactgctttgaatggcattgaaaactgctttcaatggtggatgtagcacatatgcacggcgggtggttgcatacctaattttttgtatgaaaataactgttaggtatagtaagtactagaacattagcgtgccggttggcatgctttctttatagcagttatttcaacattcatgttccatcaaatattgtattatcttgcatataattacgagtatatataatctcctgcaatgttaatatgggattaattatatatgtttaaagcaatctatgtttccggtgtcgattaattatatatgttgagtttctaccaatttattgagataattgatattagaaagtattaagaaagtagaaagtaggtggagttaaatattagaagggtctctgaaaaaatattagaagattgataagtttttttttctaaaaaaaatgactgattgtaggcaaagaattcatgggaagattgtaacttacaaagcttacctcgataatccataatactctctatgtccacaaatattagttaagttgtggcctatgggcggtctttgggttcacttcacccctcatttttgtaggtcactataccatgttgccctctctttttcagttgagctgaaactaatttacaggagtatactggtgtccatgaatgcagcctgtcacacttgttttgttccctcgtgcatgacatgacatgattaatttgggacccctgctggctgcagctaactagctagcggctgttgcttgcttgacctgtttattttaaaactactagtaacagtaagagtagaataatcagtaaggagttctgaaaccttgccctgaacagcttcagcttgctccaacagtccaactgcacccacgaatagttaggagtagctttttcatatattgccattcttaactagataatccccgcaaaaaaaattaactagataatcttgctgttgttatacgagaaatagcatggatgcttaacatttattgagcgcaactctttttcgaaggttataatacaagtccctggctctgatccattaactaggacacacacacacacacacacacatatatatatatatatatatatatatatatatatatatatatatatatatatatatatatatatatatatatatatagagaaaatcccttgtatacccttgaaattttaactaatcccttctatgcctctgaattttgcttactttcttatatacccctaaaatttgattttgatcccttccatacccctcccgtcagttgattgttagttgaccgtctaatttctataaaaatgaccattttaccctttggatgaacatagaaatttatgaattacattattaaaaatgtaaaagcttctcacacgagactattatagctatgagtttgttgtgcgatgcattatttatcccaaaaaatatttttagataatgaaataaaaaattgtgtatttatttttaaaaaaagtaataaaaaaaaggatcattcatacaaagataggacaaccaattttcataataatttttttatgaatgctcccgatcaaaaaaaatcattgtcctattaaaatttcaaataaaaattttaatttattaccttttttatttccaaaatttatgtcaaaattttctgcactaattatttagtctcattagtttcataaaatgcacgtactgtgcactcaaacaaaattttcaatcgcttttaagcttatattcaaacctatagcatcaagggcaaaaaaagacatttgcaaccaaatgtaatagtgaaataatggaaaatgtaacggtaggggcatggaagggatcaagttaaaatttcaggggtatagaagagatcgggtaaatttcaggggtacgaaagggactgagtgagttttcaggggtacacagggaatttactcatatatatatatacacacacactgatgtactctgatttttagctatcattgccatgatcagtccctttggtctttactacattttagacattgattgattcggtgatagattcacctttacatcacaaatcgaaatactttatttatatgttgggggtctgtcgcatctgattttcgttttaggatttataaattatttaataaattatcattagaatttatattaaatgttcattaatttacaagtgaagttaaatgtgggaaataaaattccctaaatataaagcatgactggatttaatttttattaaattctccataattaattatactatctggaattttctcggattttttcagagctcaattactaattttaataatacaaagattttttcagtaattagttaatcaataaactaatcattaaatgatctatatgtaattttgttaaatgttttggttgtttaaaaatccttaaattataaattgagttattataaatgatcttaaaatcctaaaagaaaagctctaagtttagtttaataaatctcaatgtaaaaatggtctagataaaactttggtaaatatttctcttgtttctttagtttctggattttttgggatttatttgagccaaggaagtatttttaataaatggaattgcattccatgaataaatttaaatagaaaaggtttttaaaatctcccttttggctttgggccgaaagtcggcccagccttccctctcttatccccggtcacgtgcgctcggcccaagtcagcccaggccaagccgcccctcctcctctctctcagccgccgacatatggggcccacatgtcggggtcttctccttcctccagccgctcggccgagtccgagccgctgcgcctctctgccaaattcgctggcgaccatgatgtcccaagccgcagccggtgatgatgtcatgctgacgtcataaagccccttttcccttctaaaaataaatcttaattgtgtcataaatcataaatccttttctgtataaggttaaaatcagattaatcttaaaaaatccatttctaattcattgtaaatcagattaatgtgtttcaagttgcaaaagtgtataaaataaagatctatatattaaaattatatataaattgtgttataaatttatttaatcttttttaaataggtttaattgaattaaatcctgtaaaatttatgactaattcatatgaagtcagaatgaggccgttcaagtctttaaattcatctaaaatcatgatctacatgtttgtttactttttatgtactgtttatttggtttttattagtccttttcctcattttgcgtgttagcttgtcgtttccgtcgttgcgaaggttcgtgagtgcgttggaagtgttcaataagactaattgaagaccgattattgcaaggcaagttgatcctatatttaaattctttatttatttcaactgtgcatttaatttcgaatgtcatcgggtggtgtgaacttatacctttgctatggccaattttcattgattatcctatttcttgataccttgggctataatttgactagttggactttatatattggttcgactagatattagtataattgcttagccatgcttagaaacattagcacatgattgggatgattaatgtttcactattacttaatgatggatatttaatggtagctcacgatggtcaatcgtgattggttattaattacttgtcaactaaaacttgattaatggtgagttgtaagcatatggttttgatggttgtgctcatgacaaggaccggttcgcgagctactgttgtgagacattaaccgtgccaaccacaagctagcatgggcaacggctggacactttgtgtagcaaggctcaccgtggtgcaccagactgtgaagcggcgagaagtccgtgggggtcgctggggagttcatgcctctggttattgaggaggtgattatgatccaggaaaggtgcgttgctttgagttgagttatgcgaggggtcttgtcacaatcactcgccatggtgacgtgtctgcgcggacacggtgacatgacaatgggttgtgtcttgtgggtacagtagtacatctctggccagagtaaaactattcgaatagctatgcccgtggtcatgggcaagttgagcaatgtttttcgtgattagtcccacactactcattaatgataataatgtgataattaatttggcttctggtttggaatggcttattcctagtttggaggtttgatctgtacgaccagggttggttgtcaaggtttggttgggcctgtgcagcatgggtgtgctattcagtgttgattaatattgatgattaattactctactgttttacaattcttaaatgtttgctaaatgctgcttttgcaaatgagcctatattatgccatcctttggtatatttttgcacttgcatatttgctgtgtgtcttgcggagtattccatgtactcaccttgcaataattaatcaaaccttagttgaagaaaaaggatctaaaaggagcagacatttagcttatacctcagttgagctgcttatgggagtggagccggagcttcgctagaccgttaatccgctgttgtttttcttttcttttgtaagtatgtaatattattattatgacggatttgtatattaaattgtcagtttgtgtacctcggctgattcctggacaaggattttatgcacaaattagttcagaaattactagtgaattttcaagtgtgacaaggttcatgtctctaacaactgatcccatcttgtattggtactgtgttttatcctttccaggacaatattggaagacgatagcgaccacaagctcctattgagaaggcactcatcgggcaaatcaacattgaggatatgagtggaaaagctaaggatgtgattagtgaggaggggagcaccaaggagatgaaggatagcgacgatgatgttggcatggtcattgggggatatgcacaagatctatacaatcatagcggcctagaagaactcatgcaagaccaagatgcgttggaaaaatcggtaaagaattttccggaatgttttaagagcacaaaatttagatgaatgattaaattatgtgttgcttttatgctggtttggtggttatgaatgatggcctaacatagtatcttgaagtgtttggacttttggtattgtatatggaagcatgtgtaattatggtagtacatgagtggtgatgaatggtatcctgcaaaattattttaaaatatgatcgtttattgtggtaaatgaaattaatatgatgtttctaacattacaaacaatatgacgatgatgcatgcaatgcttatgaaactcaagaatgatacagcttcccacatgacatgatttactcctaatgctgatattacatcgtcatatatacaacctgaaaactgcccaaaatatgaaaccatgataaacttcccatattacatatttcaaaagctgaaaccatcataaaacttctcacattacatggtttgttgcatttacttgcgtaacactgatcttaacttatcatatatacaacctgacatttaaccaaaagttgaaaccaggatagtgctttaccatattgcatgatttactgcacttggttggctaatgctgttcttaccttattatatagctcaaaaccacaactaagggtattagggagaatgtctagacgctctagcctctctttacccatatgagggatctcgtatccatttccaccattagctttcataacctctaacaagcaagattgcaatgttaggaacaccctatttagcttgttctcatcataggcctgatgctcagcattatctattaggtcatccatattcctggatatccttctatatgttaatgattgtagagacgcaaaaaacccaagatctagtgcattcatatatggggaattaggaggctgatgcatgagtcggatgtcaaacccttttgggaaactgcataggcaaatcgaggatcatccactaggacatgagaaggagcattatcctactaaatccatatactgttgtgtgtttcttctcgaggccaacttgctattatagctggtaggagtttagcaattagaaatgaccttacggtatctcgatcaaccttgattgtcttggtgactagagtcccccttggtctattatgacttgtcctttgcggtggttcctaagtagtacaataatcaagttagattaacaattaatttagataaaatcactaagtaaaaatgcatatatgaagaggttatggtacctttctggtgaaaggccacaagcctatcttgccgtcaaaagtgcagataccttcttcattgtatctaggcctagcaactgctgccaagaacatcattttatcaatagaatttttgttttggacaggtctgtatggatcatcctcccaatggaccatgtaaatggttcttgtccttttagttgtattgaaccattttttatctatgtgtacagtgtttcgcatatcaatgaacttgggttcatttggcaaagtatgccaatctaacatggaaagacaccaccgcagccttgatggtttattctcttccttcaacaatggctttagtgtgtttgagtgacatcttagcagcacttctttcaacatcctatgcaacatgctctttggtataccagaggctgatgcaaatgaccgtaaagtgccccttagttgcaagggaacattagcaacatctgtcatgttgatttcattctttttgcaaccacaattcttttttttcctagaccttacatcgattggtattccgtgggcaagacattgcttcactcttcgccaaatagcttgcactctagcccttttcacattaaacattgctgtaacttcagttgtactacctctgtttcaggttataagactttctagcattgtccacattcatatagatgttaatgaatccaggcgcatatatatatatttctagattcattaatatatatatgaatatagacaatgctagaaagtcttataatatgaaacggaggaagtaacatttttttcttagggttccattgttagtttttccagcaaatgcagcatatatatgttgtctttgtattttggtcagatttttgttttgatgttcatcttcctaacctgaatcatccaactcctcttgttcgaaaacaacttccacatcacccgcatacacgccgtactcttgcatgtctacaacaacaattataaggttagtcatctgtatcaattcagaattttaatattttattgtcatgtatcaacattcttgcaaaattatggcacaactttttaggttcaccacgtggttttatttgtaatatgatttaaccatacatattagatctaagtgcgacagagagacattgacacaatttagtttatgtgctttctttcagattgctgtggtagtgaaccaattgacatgacaattgtatgtaaatacaccatatcaatgtatttattggtcaatctcattattatttgtgatttactatgtgctgaaatgtctaatttacaatccttaattgttattgcaactaatacaaccaatgacatggctagacgtactattgtaggtagttggcatgatataatattactaacttctaatttaaaacatggtttcagataaataatattattcttcaatgatcctttgggtaaaaccacattttatcattttttttaagtctaatattcatgtcggttaaatgacttacctggatgtatttgtaggtcttcctcatcggcatcaaagttgagattaaaaggaaaggcattatggttgtgatctccatttacttgcagaacttgatccatggcatcagcatcgtttacaataacaaataccatgtgagtaccatgtccaaaaacaatactttttgccatgcagattattctatatttgtccatggttccatgcagattattctatatttgtccaaggcgaagacgacggccttgtccgggaaggaggagagccacgtcgcgaacctctcctccagctcgcctcgcggtggctccggcaccagtggccccgtggcgagcaccggcttgccatactgcgccgcgatgtagtcgatgtaggggccttccatctcgtggcaggtcctgatgacgagcgcgtcgcaggcgttgtggcaggcgacggagcggtcatgcgtgctcggcatgccgtggaagctggtgaaaatgtgggtgaagtgggcggcctggtaggtcggcaccgtggagagcggcgacgacggcgggaacccctcgggcgccgacgcgagctcctcggcggtcgggcgcgcgccgtagaggccgcgcccgtgggccatgaagtacgcgccggagaccgcggggaagatcgagaaccgcgccgacctgacgccgagacgcctggcagcgtcggcgacccacggcgtgacgaagtcgaagagcacgacgttcgggcggagcctcgcgagcagcgccttcacctgcggccgcgtgccgtcgag

SEQ ID NO: 8950 - DNA, 2291 bp, Oryza sativa
gccacgttggccgccgccgacaggaacgtgacacgcaccccaccgacggcgaggaggctacgggccagctgcgcgaacgggttgatgtggccgaaggcaaggaacgggaacaacactacgtgcaacgtttcgccggcctcgtcgccgccggcggccgtggcatccacaccggccatgcttagttcgggactgcttttcagtgtgaagcatttgtaccccattaccatctatatatacgcggatggcgcatggctaaatcaataattagcacatatcattaacaattttgttgtatttttaaaattaacatgcaagcaatatcaaatcattattttcacattatttaaatatatattatagatattagagaagttatctgtcaattttaggtgaaatgatctttcagaaattaaaccatccataaatatttcttccacttttttgctatccaatgccgtcagcgcatgttagatatacacaattagcatgtagctatcagtttaggtgaaatgacatactctagtacatatactgtatgaacgccttttgttgctaattattacgtgcagtgataacacagcgtacaaaagtaacgcattgggtcctaaatatgatagggccaaagtatttcagaaagaatcctggttgttcttgtaagagtattagtaacttgcgcatgcaaatgtattttgcagacttatccacatgcgtgtttcccgctatatacctttgcttcaagctaacatcttgcagactcaatatatacaaggcaattcattcgcatttgcagaagaataaagaatcaagcttcattaaaatttcgttcaatcttgaaaagtgaatgttatagataagacatcattaatattttttttggctcggcgagacccaccatatacaagtcttacatgaaatcatacctcacctacggacggtgttccgaataaggaaagagaagcaaagtcctacttgagcacgacaagcaccactcttatcgtatccatacttggttatctaattctacatagacaagaggacacctgagggtataaatacaagacccccagtaggagagacgacacacacgggaggcgaagaaaaaaccaatacggatctaggcaagccacacaatacaatttcaatctcgccgtgtgatattcgaggaggcagaatacactagccgccgaccacatgtgagagttctatgttgctaagctgaccgggactagattaagtcctctccaatattgtactcgtgtgatattgatatataaaaggcaacaccggcttcagccgataggagtagggctattacccattagttacgtggtccgaacctgtataaaagtccccatctcctgcctcttttacctcaatctcgcgtataccatgtcactaacaatttccatattctacaaataccgtaggcggctatagcccgtcgaaagtggcgtgccaggtagggggatatggtgcttcaaggtttcgatgagatgggtccaagaggcgaatcgcgtgaacaaaaaatcttcgacgacttcagacctaggagatatgactcgactgaattacacaccacttcaaatcggaatcatcattatcccaatctttatcatgacaccgctgctatggattttccgatgacaaagaatcgacgacttggggtttattacaatatttcgtaaccatcatcgctgtttacggtccttaactaccaaatttgaccatcaattcatgcataaattttaccatagtctaccactaaatctagcggtaggggtttattacaaaccacttccacaagtgttggtgaatatttgtatgcgggtgaatacttgtggaaattaagagaaaacgcaagtaagagaaaacaaattccagccaatgagagaagagtacatgaatcaaagggcccacaccaggaggtgaaccgcctcaacgtcgtccaaacaccccaaaccgtcacgtggacctaccaggcagtgacccagataaaaggcggcgcgagggggcttagccagggttcggtcgaatgaggggtggctcccctctatcacaatttccacatagcatcaattatctctctcctggagacgttggtgcaaggctcacggtgagtaaccgctatagaatgtcggtttgaggacatgctgtggcttgaaaggagttggaggaggaatattctctcaaatcacctccacattataaataggcctccattccttactctcaacacacaccaagatataaatcattgctacattccaaaggtgaagatctacttagctagt

SEQ ID NO: 8951 - DNA, 7455 bp, Oryza sativa
agtaagatattttctcatagttgcggattcattgctctacttaggtagagtactttagtcttaagttggtaccgagattagagtagtaatcaatagcatatacattgtgtctaggctggaggttacatttgtttgttgtgtgctccacgggttgtaggggtaggcggtaggtgatgacaaccctgtccctctttcctaatccttaacattcggatacattatagagttgtaagccagagtcttttaggtaactaaaagattttaagcactaatcatcaaagttaaagggagcatccttagctggcaagctggtgaggggtctagctactaaagaaaaatgattaatgaaccgacaataaaaccccgcatgacccaggaaactacggacccctttaacattataggaggtcggagttgttggattaccacaattctaactttgtactcctgtactgctttttcggagactcgatgttcgagcactattcctagttaagcacaaaatccttttcacgaagtggcacttttactagttctgaaccatgaaatgacacttttcctagttaagcaccaagtcctcttcatgacaccgctgcaagactttgtccaggttctccaagcattgatcaaaactctttctatagatggataagtcatccatgatgatttccatgatttcctcaatcatgtcggagaagatagacatcatacaccgttggaacgacacgggtgcattacacaaccgaacgacatccgctggtatgcgtacattccgtaaggacattgtaacatcctcaaattttaaaactaaaatttgactgcatcatgctggcttttgattaatttagtgtgttttaaaaatctatttgattcctaagtggttcaagtattacttctttagaaccctactaatttaccctaattataccctttattccgaaccttactaaatttgagcaaattctctcaaatttcaatctttagattatttccttaatttaccctaatattagtaaggatttgctatactccaaaccatagtgaaacctttccaaattcatagtttaaattcaaatcttctcaaggaaaatattcaaaattgttgaatttcactgttcatcgcacacaaggagctcgatgaaatgcctagcccagctaactcagcccaatctctacccaatcttttgcaaagtctatgttggatccttggggaccacatcccactcaaaaaccatggtttagttggccttctcctccccttctcgcgcgctgcctggcttcctaccttgccgcgcgccgagccgccgcgcgtcggcctcgggacccgtcgcgcgtgcccgattgccttggcgtgtcgtcgcccgtccgacgccctcaggccgccgccgccgcaccaatcttgacgacgacaaagccgggatgacctccgccgcaagaaatcgccgctcgatgccgtgcgttcccgtccaaagccgccgccgagtccgattttgattctacccagggtgaatcgcgccaattcttgccacacggttgaattgaagatagaaggtggtttcccctctctcaattcaagccattcacccccaagccgaccgttttaaccctcactaccgctgcgcgtcacgcccggattggcgccaacacgtcgccagccgtttctactcgcggtcaagccaatccttcgctggtaagtattcaaacgtggcctcccgccactcatattgaccttggccaccctctcacagcctctgccacctttgacatatccaatccttgagctcatccatggcgatgatggcgtccgaactcatccacttcccctggccctataaataggaccccaaccctttccttgtccatcatcgatcatcaataaccatagccccgcaactccgaagctctgtttcaccaatccattccatcaaccaccctcgtccgtcgatcgaacaccttgtgcgcgatcgactccacacccctccatccatcctccaccttatataccccttagaacacctatatcctaccatgttttagcatactagatcctaaccgaagctctgcgtcgagttttacctcgccgtaccaagccgagcaccgccgcccccgcgctgctctgttcttcgccgccacaaagtttttccggccgcaacccgtcgtttcaaccgatctcggtgagttctttcgttttaaccatctatgtactccctagattctattttagcaattggtttgctctaccatgccaccctctgggctgccgacgtgagcacggccaccgccaatggaggagctcgtcggcaaatatattccacaccttgccgaaggtcggcaagctgcttaaacccttctaggtacctgatagatgctctagaacccctccccgagccatgtctaactcacataaccctgatcaccttcacggcttaactatgccaccgccgccctagccgctagctcaaccacataccaaattaacccctccgccgccgctcaccgtcgccggagtaccctagctccctcccatcctcggccgcaacccctcttctcctccatcaccgccgcaatcgccaatcctagcaccgccagccgtaaatagggatcggctggaggtagaagaagagaagagagagagagagagagagactgacaggtgggacccgcacaccgtgccatttcacatttaattgattttcaaactttagaaacccatatctttgaaaatataggtccaattccattgaaacttggaccaatattcttctaaaatcattctctatcttttgagacccattttgttatttttctattttattttattttccctatttttcttatttttggattgtatctgaattccttttgaatttgaattttatatgtctaaccctaggtcttgaggaatcttttgacacactagataatagcaatcaatctcaggacatcgagcaaggcaagttaccatataccttttgatcatttaagcctatattttacaaattatttatttatagcattcttttcaatattctattttatatgcataattcaaccatagaaacccagataatttagtattgcttactttgcttacaatctgcttaaaattccttaaacttagattgggacagtacgtaaggtttggttgatttctgggtggctagtactgtctcgatcgatatagtttttaccaggtacttatgtcgaacgaacgggtacgaccacagtttctagaatggggatagacctagttattatgttaattaacaatatggcacctctgtatagtggttcttatttttaagtcctcgcgcaggaggcaactatagcagcgaaaggcaacttttaaccattaccatgtacaggtaaatggtttgtgatactcgagtataaattatatggtatatttctaaaccctaatcgagatgacgtggtgtcatacgattagttccccttaaatatctcgggaacgccagaactcctcttgctgctgttaacaatacgttcagagcatatgaggatataagttcatggaataggtgccacaattgttaataacttaatattgggccatgactatagccgatgattatcagcaagttgtggattgcgggtaaagcgtacatctactgcagtagaatatctttgaaactattcgaatagccgtactcatggaattgagtaccaggactcatatgttaccctggttagaaatttaaagtctatatatatatttataaattcttgctataactcttctagattgtttattaatgcttttcacaaagaaccccattatatgccaatgcataacatatttccatgataacttgctgagtattgtcaatactcattcttgctcttatagccctttttcagatttgggtcaagaggaggacccctatgactattactacgatgaccctgataatttagaaaatccctaaaggttatacctctctagtcagaatgtatataaacttccgctgtgtattaattctagttaattaattaggtgagtacctattattgtaaaacccttagtattgtagaactttaatgtatgcaattaagaaccagttatattgtatgtatcaatatttactgatccagggattgatacattaatcatagtcggatccaagtaattagttctgggacccgacggacatgtaaacattgtcttgctttgatcatcggcatagatgggaatttgatgatttcctagctaatccagcatctcatcaatgaaaggtagcgggaaatggtctttctttgtagctttgttgagctttctgtaatcaatgcacatccttcatcccgtaacaatgcgtcatcgaatcaattcattcttcgagttttgaatgaccgccatgcctcccttcttacgcacaacctgcaccaggctaacccactctctatacggcataaaatatattatcccagcgtgtaggagtttcaagacctattttttcacgacttctctgatcgcactatttagcttctgttgcggctcttgtgcatacgtaggggtaacgccccagggcctgaaaacgtatcatcccgttatagtgcgttgtcggatcaagtcgttcttcaagttttcaatgactgtcatgcctccattcttagtcacagccttgtcgcgcccggaaaaataccttttccagaacactagtgtattaatacccgtcccaggaaaagccgggatacaccaaacaaatatgatacaaaaagtacatatttattatattgataatatttacattattacaaaggcacttcaggcctgacaaacaaaaataaacagcagcggactagcgagcctacgactccatgttcacaggcgctcaactggggtataagccatgactccacctaggacttcttctccaaagcttctcttactgaaggggggaaagatagagcaagaatgagtacaaccacagtacttagcaagccacaccaggagatgcatgattaatgcaagggggtacaaggggataataataggggttaagtttggcagtaaacagcatttaaaagtcacttagttgcccaaagctattttgtaaacacgatcctagagctacacaatattattaatcaaggccgtgaacccacatgaacctgccttaacccaaggcctacgatgattcagaccgaactggcaacctgacctggtcccaactcgtcccaagccaacccaggccaaccattccacattttagttgttaagcaagttttaagaattaaacaactaacttgggtacattgctaggcttgcccataaccaagggcgcggctattcgaatagatttactctgatcagaggtgtacatctttacccacaagacatatctttactccacattccatggccttggaactcgtcgtaaacatgtgacataacccttcacccatcctagccgtgaacaaaagtaccgacccaaccctgcctacggccagtatcctagataggcaggccaggattgagcccctagcaacaggatctagaccgggtgcgccacacacataggggtgagaccacccgcgtactagtctagtgccatggcatctcgactaacgggcaccgacccgtgtagcattcatttgtctagacatctcgattaccaagccgcagctcacgtagccttcatttgcctcagagatatccatcgtctcaacgacttcatccatctctatccgtgtccttttgttcaggactagactgagcaccgagttaagccttacccattagacatatggttagtacggtagtgctttgcaacagaggcccgaagaccggtccttatggtggccgaggtgctcctagcaaaaccatgcacctcgagcccagcctacaaccatttaggagtttgaatagagggggaggtgtgtgttcaattccatcacaagccaaccattccataatgtccaaatgatatgagaactaattaatcagttataaaaccatctagtgtggcataattaatcagcgaagcatctacctaaattcatactagtggaaccattaatacagtacccactagttggggttttgttttcctagggtaagcgaggtgataataaacaatagtaatgataaggctataacaaggattaataggtattactaaaaacagtgataacgcgggaatttaaataaagcgataatgcaataatttaaatcaaaataattttataaactgggattcaatatgctcaaggatgatgcgacttgccttgctcagagagaacggccttctgaaccttcggcgacgaccacgagccacgcttcgggaacctccggaacgaaagaagctacacgaagcacacaagcaaagctacaagcctataaagaagcaataacagtatataaaaagaaagcatagggttctttaggttataacaaacattaaaagacttgaacgggtcgattcggggttcgtatgaccaagatatggtcattcgaagtttaatgttgttatatggagatttgcggattattataattaggctttgcaactataaaacatgtgtaagcgctatcctggaaaagacaggaaggctgtgctgttgacatgcggaccccacatgtcaacctaagggaccacggtagaccgggtacacagagacggtccacgggtcaacagaagcggaccccgtgtgtcaaccgaggtgagtggccgacaaacgtactccactagacaccacgcgggctgcacacgtggaaaccacgcggctaccgagcgggcacactaacacggtcaccacacgcacatacgaacgactaccgacaccgatacatgggtaccggggtcgacaaccgcacaacgggcacggggcaacaccgaaaggacgaggacggggcagtgggaggacggacccttaccaccacgcgacgaggcgtgggaacgacgacgacgaatggctcggcggagacggacggaaacgatggagacgaatggacaacactttggcggcgatccttggacgaaggcgagacgcagccggcgcaacgcttgacgacgcggagccaaggacgaagacggcgacagggctgcgacgcactcttgacgaaacgcgggcgacgaacgagcacggcttgacgaagggagggccgacgacgagcgggaacgacgagaggacgacaagggcagccggcagcagctgcacggagacgagaacggcgtggaacgcgccactgcattgccgacgacggaggcggcgccatgggacgacgagccgacggagaggaacggccgaccggaggagacgttggcgaggacgaccggcgcggtaggggaggagggggaggcgacgccgaggataaccttgccactgcaatgccgaaggtggagacggcgacgtcggccggcgcactggctaggcggaaggggctgccggagtgggtgccgacgagaacgagggaggggcggcgcggacgacggc

SEQ ID NO: 8952 - DNA, 17688 bp, Oryza sativa
catttttggtggaacaaaaaataaccaaaattccattaatagagggtttccaaaatatgtgggtttttttgttgtaaaaaatattttaattcactgcaacattagatatataaatagtgaaacattgtaaatacactaggtgaaacatctttttggaaaaaggagagggacaagtgggtgggtccaacagatgagcacgtgggggagggggagggaccgattttcccacctcccccggtcaaccgatgctgggcattctcctatattaagggcacggctaaatcaataattagcacacatttaatgggccgggtcaatgtttgcttggcaaatccaatattactataaagttgatgctcgctacttgagacacccacaatcagggacggaggtagagtataggagtgggtgcacagtagagtataggagtgggtgccgggttgcacaggaaccagtcaagaaaattttttagctatacctcaccaattttaaccatgtgtgcacccctaatataaacttagacacccgtatcaacttaaacttgatctaaagcagagtaaattaagcaagaggcacccttctccatttccgtcgaaacaagatttcggcaatactaaaaggggtgccaatcaagcttgaaaagtggatgggttagaagataaatgtttatacaagttcaggccttctcaatgaaaagtaataccctactcctgtctgaggatttattccactgagtgtattattgatctgacaatctgggagaaaagtcatgtccctaggagccccggacccctccttatatagggggaggagcagagattacaatggacaacccatataccttacggactacgggatacttccttatattcaagttaacataatacacgagtccttttctaaacatattctatctatataagctatctactataaccaatcggatatacatgccatatgggtatgcggtacccataatctttccaatttcattctagctctgcccctgtctacaatgtgggtcttaaaagacccatagagttccttatgatgaaccttatacattgtgagacttaaccatgaggcattgaatattaagattgaccttaagcttgggctcacctttaggaataaaataattggataaataaactgcacacgtagcgagtgagagaataataacaaggctctgtcataaaaaacgtgccatttcttaaaaatggttggagaaaacaacggaagaaaaaataacttagtttataaaaaccagccgcttcgaaaaaaccataaggaaaaaaaaccgtttataaaaataccggatcaaagaaacaatcggactcaacgcgagaaaaaacccgcaacggtttgagaaaccgtccgacttagcgcgaaaaataaaaccgactgtttctttaaaaaaaaagttagagaaaaccatatgactcaacgcgagaaataaaaaaccgctcaaaaaaagcagtctgactcaacgtgagaaaaaccactttttataaaaaaaatggttcggcatcgtgcaatgccaataaaatgtctgatttgaaaagaaaaacgttcgattccagaaaaaaaaaagattcctaacgttgtgtaatccatcgtctatcatgtcgatttggttttttcgaagcgtcgttggttgaatgttctgacgtccgaatcttagtcttgcttgtcttttttttttacaacgagataaaattaaaattgatggagtggtttttgtttcctcatctattcttctgtattggaggccctacacattacgattatcagactattttggtaagtatagctacttttcctgattacctattatattaaaattatattgaaaaaattcacatatttttaattgttatttggagagtacaccgtggctttattttgtgtagacttgaccatgcgaggcagtgtaagatttgattgatcttattactggttgcaagctgagattgaaagagtattttagactatatgctaccacatgaataatccaattcttttgggtaaagcaagcatccacaattacattaaagatgttctaatttttcttatgatatgtcttaactgtaacgatctatacagacattatcattgacatggttatgcataaaaagtgtatattgatattggattgtttttcgcccgttgcaacgcacgggtatttttgctagttactataaagttgatgctcactactctcctaaaactcaacatgtaagtatgtcatatcatcacccacaagcaatatattattatctagagtattttaaatcatatacaagtatgtcacatcatcgtattttaaatattatgtcaatatgacatatcatttctaatgtatttttaaaattaacatgcaagcaatagctaaacaatattttcacatcattatcacattattgcttgcataatgtttaggtgaagttatatgtcaatatgtttaaatatgacattaaaccatccataaaattgacatatagagattagagaagttatatatgtcaattttaggtgaaatgatctttcagaaattaaaccatccataaatatttactccatttttttgctatccaatgccgttagcgcatgttagatagacaattagcatgtagctatcagtttaggtgaaatgacatattctagtacatatacgtagtaatgtatgaacacctttggtcatgctaattattacgtgcaggtgagaacacatcacgcaaaagtaacgcattggatcctaaatgtgatagggccgaagtatttcagaaagaaccctggtttgtcccttgtaagagtattagtaacttgcccatgcaaatgtattttgcagactcatccaaatgcgtgtttcccgctatatatctttgcttcaagctaacgtcttgcagactcaatatacacaaggcaattcattctcatttgcagaagaataaagaatcaagcttcaatgaaattgccaatcgatcttgaaaagtgtcggtgttataaataagacatcactaatattttttgttaggctcgacaggacccaccatataccaaattttatatgcaatcatgcatcatatacgaaaggtgttccgaataaagaaagagaaaaaaagtcctacttaagcacgacaaggactactcttatcgtatccatacttgttttcctaatacaagacctcctagtaggagaggggacacacatgggaggcgaacaaaagcaaatacggatctagacaagccaatacaatacaatttcaatctcgccgaatgatattcgagaaggcagaatacactagccgccgaccacatgtgagagttctatgccgctaggctgatcgggactagattaaggcatccccaatgttatacttatgtgatattgatatataaacggcaacaccaacttcagccaataggagtagggaaattactcatcagttaagggatctgaacctatataaaagtcactatctcccgtctcttttacctcgatctcgcgtataccctgtcacttacaatccccatactctacaaatactgtagggggatttggtgcttcaaggtttcgacgagatgggtccaaaaggcgaatcttctgaacaaaaaatcttcgacgtcttcagacctaggagatatgacctgaccgaattatgctccacttcaaatcagaatcgtcatcgtcccaatctacatcaagacactgctgctacgaattttccgatgaggaagacatcgacgaattggggtctgggagaaatgacccgaccaaaatatgttactcctatatatcgtaaccatcgtcgctgttgacggtcctcaactaccaaatttgaccatcaattcctgcataaattttaccaaagtctaccaccaaatctagcggtatggatttattacgtactaaccaattccataattattggtgagtatttgtatgcaagtgattacttgtgcaaattaagagaaaacacaaataagagaacataattccaaccaatgaggagaagagtacatggatcaaagagcacacaccaggaggtgaaccgcctcaacttcgtccaaacaccccaaaacgacatgaggacccaccaggcagtgacccatatgaaaggtgctgtcagggggcttagccagggtttggccgaaccaggggtgttagcgccgtcaacgccggagagcttgttcagggacatgcgaggctcgtccgtggcgtagactcatcaggctggtcgagctcgacatcgatcgccagttcatcatgtaaacccgccgtgaatagctagatttactgctggtcggagagggcttcagacatttagcatgcgagcgtcaagaacatggtctggtaggcagccaccgtggatgtctgcatcagccgcttcagttcaccgagcgagttgcagtggatcggtggaccgaattggccatggcagaggtctttgaactcatcccacgtcggaggccccttgtgaatttcatagtgaaagtaccattcctgtgcgttgtcggcgaggtggtacgttgccaacccaacacgatcactgtcatgcgtcttctggccacagaagaattgctcacagtggttgaacctgttgagcggatcgtccttgtcatcatacttggggaactccaatttgtagaaacgaggaacgctggtagcgctgcccgtatcctgtggtcctgtcaccaatggcggcgattggcccgtcacggcaggcgtacccaggatgccactgccgcccaaacaaggtgcgatctgtggcgacgatgatgacatcgtgccctggagttgttccagggatgtgatgcgtgatgtggccaccgcaacggtccgactgagatcagctagatcgtgcttggaagccaacaatgatcacatccctggaaccttctgacatttggtcttggagcttggtgggcgagtcggtgggtttgagaatgggttgtttgtggatggagagatcttctgacaccatggtcttggagcttggttgttacgagctccggtgtatgatctaatggggtaggagtgagtaatcggtggctgaggtttcggcaacttaattagaagatcggcgacccgtggtagtggcacagaagaagagatgagaaaacagagaaagagatgggaaacaaagtggaatcttgcaagctgatttcaatcccaaatgccctgtaaataggcttacaaatctaacttaatgcctaacaaataatgaggaaaatgtggagataacaatccaatctcaattaaacttatcattggctaggagtgtagctgtccgacacggccgctgttaggcgcccgtgctcgcgtcgcctgctcctgtgcgcgctacaccttccgcgtcgcgtgtcttcctccttcggttgcagacgatgtgtcacgcccagaaattgctaacctgaattttaagcagaatgtgtattaaatatctgtccagggccagccacgtcttacaaaagtaataaaataaatctaaaaaatgcaacggaaaaagcaaataaacaagacttaatcttcacgaccaaaagtatagcttcctccataaactacaggcaatccttgacgtccggaacaagctcaatcctcagagaactcatcatctgaaccaatttctgcctctgggtgggtgggggtgggggggataaaacaagactgagtaccaaccactgtactcaacaagtcataccaacgggaaggtatgatgcaaggtattctcaaaggagtggctcattggatatttgcaataaaagcaacatttataaatcattattttgaatgagtaaaaacagtgtataattaagtagtattaaatcatcattgtccaacgctaaatccacgttgcaacaggtccaaccaaaccacctgaactacaccagttctataagtcatattattatagtgggactaatcacggtgaactggttgaccacccaataaccgcaagcacggctattcgaatagttttacctctgatcagaggtgtacaactttacccacaagacatgattccacacatgttaccatgctgatgttgactagggttcccgatcttccgaaaggttctaataggtagtcgatttggacggagtcacgacacagttcgatccggcttctaaacaaacacgctcttgagccccgcaatcgcagcaccacgtctcctctggttatcacccgtgttgaaacacggatgacctcgccgagaaggcaaatccctgtttgcgaatcgaagaacacaaacaagaacaaagaagaatacaaccaaaattgcaaataaatgataaagctcacgagttggggtcttacaaaccgatctagcggcgaaactgttcttgacagaataatctaagcaaaacccaaaccctaaatatgacgacgggtattgatatatagaatttagggtcgtgtaaacaacccttgacgcaaccctaatgggttccaacacgatacacggcctaaacgcccaaatacgatgacgcagcaccggaatagattatggacgttaaattgttcggtcgattcccgttgacttggaaagaatttgaacgtgggaccagaaccattggaaaggttatgttctaagttttccatccatataaggaacgccccaatccgtgcacatatgcgacttgggcgcctgttttagtgcagactggtcctggactctgaatcgtactcgaagtcgacctggtttgggcctccatattgacttggacgtccttgatgatcctccatgcctctaagtccctctctaagtccttgtcctctcctttattcctaatcacaatatattcattaggtagcaatctattctcaaaatcatataaagaagaatataggaacgagctcacctctaaattcaattgtcgcgcacgagctcttgttattggtccttgaatgaccggtggaggattgttgtatgtatctgaaggagtgatgtcctcatcacatgccctgaagtaccgccacgatactgcaaagggggaaatcgtgacaaaacccatcatataactctccctaaccaaacatacccatctcaggtttcaccccctccttatgccaagtcgggcaatcccctctcgtgcctaggtaaatccggaaacaacagagacaattatctaggtctgaaccgcacaatcgcctctacccttgccatggtatgttagctaggttaagttatactctagattaagcctggagcccatgctggcatgtgataagaacgagtatatcttccatggattcccgagaaccggtccttaattgtcatgggtacgacttccaaaatcatgcatgtacccacaacccaccattaaagcatattttagtttaattaaaccgtaaccatggtggtacatcatcatacaattaaggactaaattataatgaatcccattgtgagctaattgatctaagtatggctaagcattcctaaaccaatcacctagtcaattataactcaagttatcaatggcataagatattcaacatgctgagtacgataggcatccatcccacatgacattctaaaacaatgcaatttaatagaaagtaggggattttgtaaaatagactcaacatgatcaatgatgtatgtatgacttgccttgctcttgagctgactgaatctcggcaaccacttggaaataaattggatctccggaactgacggaatctaaacgacaacaaagcatacaagaaatacaagcaataaggctactgaaacagcaaaataaaccaaatttttttatcttgttctggacgtcgaagattgcatgtggtttatggtggaagctatgcttttggtcgtgaagattaagtcttgtttattcattttttccgttgcatttgtgagatttattttgttatttttgtaaaacgtggatctagatagagatttaatacacattctgcttgaaattcgagtaagcgaatttctgtccgtgacacgatgccaaccatgacacttcggtatcatctcgtatgcaacgtatgcccgcatacatgttcatatatatgtatagttgtattggtcggctctgataccatttgtaacgctcaaggcccgaaaacgatgtggctcttaattttggatatacttttgagtatgtggaaggaaaatggagggagtggaatatttagagaattaattatgggctaaatgaggttttggatttgggatgggaggataaaatatattttcttgcaattattctaaaaatattattcttctgccaaggttggagtcaagctatagaaattaaattacagactagataggaattgactattggaatatttatataaaaaaattggatagaggagaattagagataactctagatccaaggttttggttaaggattaattcgaatgaaatcagaattacggtggttgaagttcaagggcaatatcagaggatttcttagaccataattcatacaagtaaaaagtttttcaattaaattaaataaaggaattttagtctaaaaaagttttgaaattcgaaaataaaattcaatcacaaaattcatcaatttagccaaatatatttttaaataaaaaacacaatagaaattaaatgttggttagtttgaggaggttactctaattattctcctaggtttagaaggttattaaggtgctgaattagaaaataattatttttaggatgttacaacagcacaggcgtggttcgagttttcacgccacgtgccgtcgaggcggtcgaagaatgcgttgcggctcagcaggagctcgcgcggagtcaacacatcagcgtaaatccaaattggcgcgctagggctagtcgacatgtactcgcactgtgaaaggcgggcgtaattaaatagaaggaaaactatgcaggtaggaaattaatcaccgcaagacaaagaataaagtagtactcactccgggttgataataattatcgttttggacatgagcatggtcttaaaaaaaattaaccattattttttattttaatatgtgtaaaatttttaacaaatatgtgattttattaaagtatttttttaaaactaatttatatatgtagtcactgtatttgaaagataaatattataaaaatgatttataatcaaagatactaaagtttgacctaactcctatgtaaaataataagtattatcaacccggagagagtaggttttaggtttcaaatcatcatcgatacaagttccaggttgcagctgcgagaagcacttatatgcgaatgggccatgcctgggccggcactgcccggcacgaagtgccgaccgtaccgtgccggcccgatcactggtgggccgtacctagcgcgtgcttgggccgggctgtgccgtgccggacgggtcctgtggccatctatatatgcgatatgcggcggacagtttgagaaaatgacaaaagtatgatgtagcacagtattacacagtgatatgtactaatcataaaaataatttttataaataagacgttaagtcagacgttggatataaccagtgcaaaactgcacttattttattttatgacggatgtagtactccctagagcgagaaccgcgatgcagtatcaagcaatcacagccgttgattccttctcttcacagtcttcagaacagagtccgattttcttcagagttgtgacagctgtcgatctgattaacgacgcgtgacgttccgttttcagcccttgagccttctcagctccgccacgaactcccgcacgaacctcctctgcacggcgtcgtccatcaagaactcccgccatttcttctcctcgccgccgccgtcttctcctccggcgaacgccgccgccagcgcgtcgcgcacgtcctcacgcccgaaccacccgtcgcgggcgcggcgcgcgacctcggtgcccacgcggagctcgcgcgcgaacagcgcggcgttgaggtactggtcgcccttcatcggcagcagcacgaggcggcagccggcgacgagcccctccacgacggagctgagcccggagtggttgacgaagcagcccacgctgcggtggcgcaggatgtgctgctgctgcacccacccggtgtgcaggatccctctccccttcaccctcttctccaaccccggcggcgtgagcttcctcagctccgcctcggcgtccgtgcccttggggaagttgagcactgcaaggaacggcagggcggtggcctctagtccgagaaggagctccgtcgcggcggcgtgcagcagaaaggtctcgctgccgaagaaggcgaacacgacggagttgtccgggaaggagaagagccacgtcgcccaccgctccttcagctcgcctcgcgggggctccggcacgatgggccccgtcacgagcaccggcttgccgtgctccgccgcgatgtagtcgatgtaggggccttccatctcggcgcaggtcttgatgaccagggcgtcgcaggcgttgtggcatgcggcgacgcggtcgtacacgcacggcatgccgtggaagctctcgaacacgtagctgaagtcggcggcctggtaggccggcacggtggcgagcggcgacgacggcgggaacccctccggcgccgacgcgaggtcgtcgacggtcgggcgccccggcccggggaggcggcggcgcgcgggggccatgacgtacgcgccggagaccgcggcgaacacggagaagagcgctgccttgacgccgagcggcctggcgacgtcgacgacccacggcgtggcgaagtcgaacagcacgacgtccgggtggagcctcgccagcagcgcctccacctgcggccgcgtgccgtcgacggcgagcttgagcagctcggcaccgtccgccgacacctccgccgtgctctccgcgccctcggggagccccggcacgcgcggcagctcgagcgccgccacggtggacgtgccgccggtgccgcccagcatggcctcgacgcggggcacgttggccgccgccgacaggaacgtgacgcgcaccccggcgccgacgccggccatcttccgcgccagctgcgcgaacgggctgatgtggccgaacgccaggaacgggaacatcaccacgtgcaggtctccgtctccaccgccgccgccggccgccgtcgccaccggcgccgcaccggcgcttcccatcgtcactcacgacgaacgtggattgcaatcgagggcagtgaacggagacggttggcgaggactttggcattggttctcgcgactttaaaagggagatggagctgttcggacacagtactgcggcttctgttcggacacaggactgactcgtgctcgctgctcctacctaaccgctcggacatttttgctgttcttttttttttacttactagcaaaaatgcccgtacatttgcaacgggtgaaacaattctaattacaatatacgtttttcatgcataaccatatcaatgataatatttatatagattgtttatagctaaaacaatcagaaaattagaacatcttcaatgtaatggcccaaccttgatgatgacaactttaccgatgctttgctttacctaaaataattggattatttatatgacaccatgcatataatttaaaatactcttccaatgtcattcttgcaaccaataataagatcaatcaaatcctacagtgcctcgcatggtcaattctagacaaaatagagttattttgtacttttctctaaataacaattaaaatatgtttattttttaatattattttcatataatatgttatccaaaatagtagctatacttaaaaaatagtctaataattgcctacagaatatgtagggttttcaatacaggagaatagataaagaaacaaaagctaggtaggtaggagatgaaaaaaaaatgatggatcatatccgaccccaagcgtccatcaatttagcattttctttacagttttttcaagagcaacttgttttttttatgaccgatgtttttttttcttgtgcggtattttcaaaccattttttagaaatggcgcgttttttcccttttttctatcagttttttcctcgcatgttttttttgcttttttttacaggcaatggaaatatttttttcccgcgctttttttatggacaacggaaaattttttctatcgtgttttcttttgctcttttttctaactttttctcacgcgtttttattttctcgcacattttttctgacttcctttttaaatagttagattatattagattagagatagagaagagatgataatgactattaaaacgaatagaaatcggatttttttttgccgcgccttttttccgccctttttactttttttttctcacctttttttttgccactttcttagggagtccgaccttttctattttttttattttttacgatttttttcttttctccttttataggaatcggatttttttattgctttctccaatttatggaaaatcagacctatgtttttcttttcctttttcaccacttctgttccccttttataggaatatgattttttttttatattttgccgttttaggaggaattggatctatagcgtgttttttttttggctttttcgccactttgggaatcggatatttttttcgctgtttttttattttgacggacgacggaaacactttttattttttaagtagtagaagagactagcgtaatgcctcccgttgcaacatgtcctaaataacattcatcaacataaataaaaatcctaaaccatatattacaactgagcataaataataaaggaaatataatcatagaaataacaacatgacactacaaataattttgaccggaattattaatataatgctaaagtccccttttattcatatagctataaataattcaatgcgaaggaaaaatataagtttcaataatttttattggatcaaatagtaaaacaaatactgtaaatagaaaaacaactgaaaactaaatttagctagaaattgaaaaaacttattttagcccatagatgaaatattaattttgaacgggtactcgtttctttgacatatattaaaattttccaattcaccaaacggtagcgaggaaagtgtccggatgtgttccacgatgtgactcgtccatagatagcggtggttggcaacaaagaaaaccaaaacaacagaaacgcgaccaacaacgatgtggtcctaacaggattagaaacgccaacaacgagctctagtggtgaacacggccgggtgagtgcgttaaaacacgttcgtgaatgaggtgattcctttttccttggacgtgctattgttggcatcgaagaaaactgaattaccaaaacaatgggaatgcgggagccaacgacatggtcccggtagagaaacagcaacttgacgagctctggtggtgaacacggacaggtgagtgtgtcaaaacgcgttccgagatgaggggattccgttttccttgaacacgctgcggttgacaacgatagcaagaacacgagtggcaatgaagtggtccccggaaaacaacaacaacgatctctgatagtgaacacggccagatgaatgtgtcaaaatgtgtttccgagtgaggggggttccgttttagttaacacgagggaggaacgaaagacaaacagaaatcaactaacaatattcatcatcttccctagcgctgaagccagtgtgcttcgggaggacgcactggcgagaagggatggagggtcgggagaagagtggcgcactgggaggagatagctgctagaagggagggggcgcacgggaggataggagtgctgggacaatggggcaacagggaggggaggcgccagcagaaagccgcgggagaggaagggagcatggggccggattggacacgtatgcacgatgtatggaaaattttggacggacgaactaatttttggttggaagcagattttaatcttttagattgcttacggtcgttagcgatcagtttcgcccgtcaatattaccaaaataaaggagaactaagtcatgcttgcaatgcatattgtgtcaaaataagatatattccactagaactaggatttctaacctcttgcagagaataaacataaatagaggagattcgatagcaaaaccatacaatagatcaatcctacgctgtcgagaatcagacttgaagacaaatgggctgagaacaccaaatttacaagacccaggaagaccaaaattcacaagtctgcggagaggagcggaagaggaggccgcctgccaaagtttgggccgattgggccagcccagggttcggccgaaccagccgtaacgccatccgatgcagggtttggctggatggtctggattgcttccctatggtggttggagggtactaccgacctttccaaccgccataaatgtcattaccagcctataaaaggccctcactccctctatttcaagacacatctcaagcaagaagcttcatacattctctcaagtttagtatagtctctagagcatagtggaatagaaataggatagaatcttcagtccccggagtcttcggaagagttcgggtatggctctagtagcttttctttcttttgtaagacttgtactatttatagaatattcttctcaatatatttacagtactttacttcactgtgattatttgagtaccgactttataagatattattcgagatataattgtctagctagcttactcgggagatgcaatggtgtgggtataatgttcatttatatgaatactcttgagtcacgacggtgattgtagagtagtatttggtagataagcgaggtgcataggctattgaatatcattatttgcggttatatgctgtggatacgtcaagatgggccgttgatggtgacaactcagtacgggtattccaccgcgtgtgtatataatcctaagttactttcctggggagggtacttctccgtatttagccctggttggatgaccatgacgggttgtcgcaaggaactcggcaaccaggggtggtatctcgaaataccaggatggcatcgtaaggggtattggctatataatcatatagtactacctccgtcccaaatacttgtcgctttgattttgtttgtaacttttgatcattcgtcttattcaaaaaattatagaattattatttattttatttatgactttctttattatcaaaagtactttaagtatgacttatcattttttatatttgcactaatttttcaaataagacgaatggtcaaacgttgcataaaaaagtcaaagtgaccactaatttgggacggaggtagtagataatatcgactaaagtgtgtatgtatattagaagtataggaaatgattttttttcatattttttccacttggcctagaattagtatgtatgagaatagtgaatgcttctgattcgtgtcaccctaccctttgaattaaactgacccatgcctagactttgattattacaagtaacatataaatattagctcggttctctctattataattttctctcgggattaaacacatacgatacccttggaatacttttaggtgaaatgatataattgtatatccgcacgcttgcagatgaaattgtaaccataatataccacgagtgtttctgcgccattgctggtaattatatttctagtaatgtcgttaagaaataccaacataggtaaagataaagacaaataaaaccctgtcacctgtcaacttatagaaggaaacccaaataacaatagatatataaacttaacgaacaagagaagataaaataaaagacgagagtcgtataataagataggagaaggcacctacgccgatggataaacaagcaaacacaacaacacccccaaccacttgtggagagagaagtaaggggttgaagaccatcaaatcgatcaaccattggcggaatggcctcattcgattgttcaccctgcttttgcttgatgaggacgagtttgcactcccagcacttctgaaaaccagtttacgtgagactccagagttatatattcacccctttgaccttgccaatcttcctctcaaacggttctaggggagaacaccgtagcgcagctgagaatgagaaaaggaagatccatatcacttcaattgtttttaactcttagatgattaatatatggtccaaactatcttcctaattttcttctctcataaagtcatattatcttacttttgcatttgaatcatcattctatataccacttactactattgtgcaactagtctatatagaaaaaataacaaaaaaaatacttacatacatatggactatccatatgaaaataaataatattatctatctcgactcatctctttttttctactaatgataccttgtgtctatatatattgtaaggattgctataggtaaagtatacttagatagaacccatctatatggattattttgccatatacattagtgatgttctaaagaaaaaccatcaccaatactaccggtctggtttttaaaccgatatctctaatttattatagacgcatatttttaatttattattaaatccagtgcacggagacgttggcaaggactttggcatagttctcctgactttataaagatggagctgttctgacacagtagtgcggcttctgtacgagaggactgccgcgtgtgctcaccgctgctacctaaccgctcggacgtttttttttttctgtttcttctctctttctggtctatgctataaaataaaatattcttacctcaccgtgggatcgcttgaccatataaggccattagcaaggtggtcgatttttatgactgacaatatatttaatggggtgcgcaaaattaaacagagatggtgacgtaggtgtttatgatggttcaggtccttggaaagagataataccctatatccagtgtcctatatccagtgtgtttttctctgtacctatgtggaaaaatgaactgagaagccaagaagaggagatatgtcgggttgtggagatgatccgacctcctctctcgggacccctgccccctcttatataggatgagggggagggttacaagaaaagtatctacaaatctctctattctatatctataaaagatatgcaggatccctaagatttatatcttatctagggaatctctctttctttatttacaagtacgtcgcatgggcctaggacactcgacccaccccatgaggtgcggcccaaagcttatcgttggatacccgggtaccgtgtacctcacaaaggtgttcagggaagttgtgataaaaaaattatttgattacaaacttcactactatgtaaaagattcttccttgcataaaaacaaatttttacatgcgggagggtgacccgtatgtatctgtgaaaataaaaattttgcatgcgtgtagaacaagtgcatgcgaaaatcggttttttaatgctaacgcgtaagcggtctgattgcttaaaggaaaaatcgcaaaaagaaattccaaaaatcaaaaccctaaccctggaatccaaatgacaacgttgccgctgccgtcatcctcatcatcatcgtccttgcatgaaaccgccagcaaatccttgcgcggggggagggggaaggggagggggaggggtcggaggggcggcaggatctatgtgtaagggggagagggcaatgtgcccgcaatccccaacccta

SEQ ID NO: 8953 - DNA, 17728 bp, Oryza sativa
  unsure (1)..(17728): unsure at all n locations
cagtattagttattattaataattctatctattatataaagtacattaaactttcattaaacttttcagaaacgctcctaaaccaccacgtggcgtcctaaaaaactcttaagccgtcaagtggcactctaaaatataacgaataatttttctttaaattggtggggtcaatatttccaacattaggtctaataaacacctgtccccacctcccctcccagtacgttacctaatttcctccggtaggtttgtacgtactccctttcccaatctctaatttcagtgttaaatttaagtcacatgttttactttttattgttgttatatttataattaaacaatgtccatattgttgattcatattgttctatatatgggccatattctttgcatcgcaacaaaatataaccaggaaatattttaattataaaaagttgacaacatatattatgtcaccttaaataattctacaaacacgtcccaaattatattgatgatatccaatctatctattatatactaaaaatctattatacttcctataaacgctcctaaaccgccacatgccacccatataaacgctctatagcgtcacgtgcggctctaataaattagaataaaatttaggaattctaagaaaaaagaaacaaatagcctttgattttcactaaatataatagactcaccactccaatccattggattacatttttttctctttcttaataataaaaggtgtccctcttcccgtggatgcagggtgtgtgcggtttgcacattggtatgtacctcctctccgtttttctctttacgaatgtttctttaatttctaacagaccaaatttggctattctttataagaaatattttggatactttaaataatcataacatcttttaacttttaattatacgttctatttgtatcattacgttatttatgcatgattaaaatcacaaattaaaatttgatacacctgttgactataattgcacttgtaaaaattgcattcattttattttgaccctttgcaagtcgttcaaacatagtaccacataaagagttgaaataccctagcccgtttaatccatttattctttacaaacactctcaagccaccacatggcactctaaaaaatagagaaattccaagaaattctaagaacaaacaaaatatttatcccatgattttaacttaagtcggtggacccactattttcatccgccagatcaatttaaacaaatccttccacctacaccattgtcccgtaagtagccatggcaaccgatactcctataccgccacgtggcatcctacagacgctcataaaccgccacgtggtactataataaattatataaatttataaaatttctaagaaaaaacaaaatatctatccactgattttcattaagttaggtggacccttattttccaacaataggtttatctaaagaaaaatcctacctaaccccaaaccggggtataccatgggcctgtacgttacatacgtttcttttataggatagtacgtacttccacccatacttccctcgatttcttcatattttttacatatttattatcctattattagagtttgaaaaaaaaatttttttattaaataattcagcaattataacacctaaatcaaacaactaatatttatccgcttatatctttaaaattatttatgattaaatcttcagctaaagaccaaatttccacaataatttaactttgaggaaaagatgtcattttggattataattttagacttttgcatgccattcaataaattgtaaaaatatgaaataataacaatattatacacttcataataattaaatgatatctacaatcataaacgtaaaataaaaataactatgagtaatgttcccaaaatatttagttagaaagcaagagttatgctaaaaaataagcagctataccataaatcatgggatcccctaaatcatacaagtaatatttttcttatgtcttttgattattttacatttaaagacccatatttggggttatattttctgacttttgcatgtcattcaaacaattataaaattatgaaaaataatgatatatgttttatcattgtatataagttcacaataaagtaatgacaaaagtaaagtaaacctaataacactgactattgttccaaaaaaattacttctcccattcggatagtataataaatcaataataaaattagtagatttgtagtgttcatattttgtcccatttgactttctcttcatctcctctctcactcaactcatctgtcttataatttttaactaattaacaacataatataaaaatgatcaataattggaaagctaaataattatgattcttatgttatatttgatttttagtttatttgaattgttattttatttataattaaataaataattcaagatccatatcactcatatttcactttacaaaaataaagaaatacacaatttgagcatacacacctatcctttgcatgctaaccaaatataaaaaaacagagctttgtaaaaaatgacaataagtattgttgactaaatctcgacaggacccaccacataccatgtcctatacggaaataacctgcgaatataggaggagttccggataaggaaagacaaccagagttctacatggaaacgacaagaactactcggattgtatccatattggtttccctagttatacttggacaagaggacacctatgggtataaatataaggccccctctaggaggaggggagacaatcaacagagacaatcaacaccctccacaatctacggaacaacagaagccaacatacgccaagacaagacgccggatatcgacttcagggataggcacggctagtcccctacggtgtctctggatattgataggaaagacattgcgctgtctctgatctcgccgggcacgaactcgaggaggaaggctaccctgttgttgactacgagtcagaccttcagaccgtcatgtcgacaacagttagataggctaccccaaatattgtactggtgtgattatggtgaataagagcaatatcggcttcggccaacaggatgtagggttattatctgacaattcaggggcccgaacctgtataaaaatcatcgtctccgtctcttttacctcagtctcgcgtataccctagcaccaacgatccccatactatgcaaatactggaatcgcgacatcaaacgtcgacagtggcgcaccaggtagggggattttggtgcttcaggatttcgacgagatgggtttaagagatggactctccgacaacaagctactcgacgactttagctgtggggagatccaacctgtctaagtacatctcccgacgagatcggaaccatcgtcatcaacaattcgatctctcgagatcgaccaagcctcaagatacgcgacgtaccaaaagatgtcagatcgcatgatatcgaacgagtacgtgacaaggtaattgatagattggttttttaaattgatctactaatttcatagatacatccggcatgtatctacaaaggtacacaatattttatctgcaatttatcatacctattcagatcatacagcattgtcagatctataatttattatgtttaattacctaaagcatgttttttatacaatatatattgtgcaagtgtccccgatgttaaatcgacaacggtttaatgctgggggctcgctctattttcctatgtatatatcatgcttatttacggtttacataatgccctgatatttaatctgctcgttatatcctgataatgctagaagatccatgcagttttttgagtacatactcgatattatctgctatatatcttgtcttctagaaaatattttgcaggaacaattgagcactcgagtaggttgtggtcaagtacaccgcattatcgaggacgatctcgacaaatgcagagtcgtcgtgcccaacctaccaacgaagaccgatgacctatctcatagcaccggccatggctggactatttgagaaaaagttgttaacggataattccttgtgaacgttgtcggtttgatcacccgacatgattgcgaacggacatccggatatgctactagttgggtgtgtgagtcatgctggccacatgagatgcacatgtaataaaccaactctaacgcttccattggtgcaacctcagatggtcgaggtatgactacagcaataacgcagcggtcctcgtactacgacttcaaatgatcgagagatacctactcactggttctcaactagtcaatcgtagcgatctctcgtacatttacttctagtggttgagttacgactactacctggttcttgaccagaggtgtagcgattctcccattacctctacttcaacaaagttgatatcaggtgcacagtatcgccaagtgttttacccagagatcccttaccacaaagacacctagcgttgaaacctatcctaatgtccctttacgtcgtcctgacaaggcctccgaggaacctaagggaactttggttggggacgcccagagcggataaggccttgtcggattcttcagagacgaaagaccatgtaagatctagtcgtgtaagagttctcgccgtgcgtattaaccaagccgtgtaatcggaaatagattttccaacttcatggctgggggctaggatcagtgcttgttcaaccgaggcaggtcaaaggtccaagagcctcattatccgagaacgattctccgatgacaaggctgggggctagggagagtgtataacttaacaaactgactgatcgaagtcggtagacgctcatatacaaaacattggaaaattctattcgacattatcgaagactccatgtctctatggttctacaccaagattgactaaggcgagtacgacaaatgttgacaaggctccgtcgcagactctacgcctactcgattactcgagaacggttggtggatctcgacaaggagtacggaatgaagagatggtgtacccgccgagataaaatttcttgacttcaatccaaattctcgattacagcaagacgggagacttagtcgtatgctctctactttcttagttgacatcagagattgactcagacaaaccctttaggtgcccgcacgaggttgataaaggaagtctaacgttatctctgaactcatcgagaacggtcacatgagctcgataacagttactccaaagtctgcgcgtggttgagaatatgaattcgttcatttgcattgaagtcgggggctactgtcaggattatggataccacatacctaatagtagttgactaaatctcggcaggacccaccacataccatgtcctatacggaaataacctgcgaatataggaggagttccggataaggaaagacaaccagagttctacatgtaaactacaaggactactcggattgtatccatattggtttccctaattttacttagacaaggggacacctatgggtataaatataaggccccctaggagggggagacgatcaacatagacaatcaacacccaccacaatctacagaacaacagaagccaacatacgtcaagacaagacgccggatatcgacttcagggataggcacggctagtcccctacggtgtctccggatactgataggagagacattgcgctgtctctgatctcgccgggcacgaactcgaggaggaaggctaccctgttgtcgactacgagtcagaccttcagaccgctatgtcgacaacagttagataggctaccccaaatattgtactggtgtgattatggtgaataagagcaataccggcttcggccaacaggatatagggttattacctgacaattcaggggcccgaacctgtataaaaatcatcgtctccgtctcttttacctcagtctcgcgtataccctagcaccaacgatccccatactatgcaaataccggaatcgcgacatcaaacgtcgacaagtattatatcacctcaaatcaatgtacatcttctgtagcacacttaaggcatcacgtgttatgtcttaattaaaaataaaaccttacaaattgtaagaaaagacatgtgaccatcaatttgtacttaataggtggatccattatttttaaccaatatatataattttagagaaaatcttaagctgtcatgtgctacatcttaaaatttagaaaaaaaggatattagaaattttgataaaagaaacaggatcatcgattttcacttaaatcattttgaacaaaacaccccctccacttcgccctcctctcacatgggcacaacagaacactagccgtcccctcccctctcagcttgtatgaatctgaaccaacaaaaaagagaactaacttgatggtacaaataaggaaagcatgtttactaataataatagttatttaggatttgttaaaaaaggctaccaaacattcaattaaacaagacaaaacattttactttttagtttacgtttaattatttgtccgacaagtttccaaacaatctaaatatttacttttgaaacatggttggtatttatacagatgatagataactatttatacgaatgaattaaatatatattttttaaaagctaacaaatagtttagaaaaattatgtagaaatagtacttttgaaacatggcagttatcatcctgttgatatttcgcccatctaaatttttcaaacgcatcctgaaatacatgcccgcgcaatacgcgggttcccttactagttaatgaaaaattagaaaattgccgttgatttatagactaatataaaaagcacgagttgttaggtgcaattaataccgcgattacaattagcgccggattaaccctgcaattagcgcttctcaatccctctcctcgccaaaaaaaaaaaaaagtcacccagaaccgccgctgcgcctcctcctccttccgccgccgctgagccgctcttgctcctctatcgctgcgccgctcctgctggcccgcatcaccgacgcgcccatccacacccacaccttgccagtgctgacacccctgcgacattgccgccgccccccgcgatttgccgttattcccctagatcgggtgttgccacatcgccgtccacgcctgcggttcctcccctctccccttccgtgatctccctctccacacccacggttcctccgctctccccttccgcaatctccctctccacgcccgcggttcttctgctctccccttcagacgccatagccgatctcctcacggccgttgccatcgcgaccaccatcgattcctgaccgccaattcggggtcacggtgaccgagcccccgccgatcgtcccatcacgccaccccttcgccactcactgccaggtcgtcatccatcgttcctcctctactcacgatccccaacatggtccatcagaatcgtttgtgctctccgctctctccaaggtgagtcatggaaatcttctcttgtatcaatttcataccgttatgtatctcatctctcaaacgatgaacttttgttcatctcacgatgatgaacagtatggtcacgaacagttatgtacctcatatctcaatggatgaaattttaatgccaataaaatatacagatcgataaaaaaaatgccaattagtaaatagaatgctgcatactgaaattttgcactcgatatataattgaagaatcacatgattttaacaaaatacactggagttgagggatagttcaaagcatgtcatttgagagatgaggtaattgactgaaagccggtagcaaatatcatatacttgttttagtggataggtagatggataattgttgggtgcgggtttattctccactgtatttgtttttctgaatttggcatcgtcttctatatgaattttatatccttggacagcaatgtttctaaatttttttaaaggggaccatgtgtctgaaattgaacatctggagaaaggttctgtcattgcttatttgccagccttctagcaagagttttgctgcgagttattgcatgacataacggcagcttgcagtatgaattggaacacacaaagtcagaataaaacaatcaaactttatgctcatgattatattcccatttgtagatactatattcccattggatgtgggtaagatgggattcattttttggtccattttttaccattgaatggtgagcagtacttccttgttgattcctgactcccatctgaacacagaggacttggagctgctacattacgttgacagcgactatgctttcacctcccgccttcgtcacggctacttagcaggaaggtcttcccatggtgctcgatcacatcgccgcctccgcgcacttgctctttccccgacggtcgatgctggcaccgtgccgctccacctcaggcagagaagattagatcgcctccacggctccgccattccgaatccggccagttctgcaaatgaggctgctgacatcatcgatccgccatctcgcacagcttgatgggcatcatcgctcgcctttgcctcatgacctttccgttgccaactatcgaagctgcctaaatttactagcaggttaataaattcatctgggtttctttgctaatcatctttacctaatatatattggatctaattctttgttgctttggttatattattgtattttcaggtcatcggttgaaaccatccatgtgctgaataggtctcaagataggagcaagttccgcaagacgtgcattggacacagccgtcgcatcgctcctctgcagcagatccacgcaccggccaccgccttcacaacatgatttggaggtggagaagcttggtgtgccctcgacgagttcttccacaaatttactaccctcgatgatggcccaggccgcggcggctttgtcggcttcttcgacaacactaatgtctaccttgccaacaatatgtgagttaatttcttcctctctgctttctgaaatacttttcaatgtgaacactagcaatgtgaatcatctgatattaagaaggtcattactttcagaaatacttctataaaagtttgtgtgcatggattgttctaaatgttttgttttgtagatatatacaattttcatcaatacaaattgttagttagctcatatgctccttgttgatgcaaattttgtcatgtaagtactgtattcatggttgttggatgtaggtatcaattaaaccatattctttattatcaacgtataaccaatttaagctcaattttatggtttgctgccgttggtatagaatatgcactgtttaattaaatatataagtcaaagctgttatctatcagtttgtatgtttctattaatgatattttgatgcaatggataggatggctgttacggaatgtagcgaattcttgatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaggtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcagaatcagattcaagaaatgcagatgtagaactatccaatcatatcgatcgagcacaatcttgtcatgccattgccagacatccattcttgcacaaagcaaactccactcaagattgttagataatgcatgtacatcaaaataaagatatatgcttttctctgctgaactgcatattctggatcaatcatccatggtcatccatactcaaaaattttgttggtatatcagtcatggaaattacattttattttttcttccttttcacctaaactcacagtctgcatatattttatacggtcccttcttaatgtttggggcttagctattagtatttacaaattcatacatgtgagtgttacctcaatatgtattatctgatctatacaagttcatactgaactggtattatacaatgtacacaaactatttgattctataatggacttagtagatatgtacttacaaaatccaagttattgtctgaacatgcacttgaaatatatttaaattcagtgtggaaacatgctctagaaatatttctaacttaagtgtgtgaacagacttttgcaagtgttgttttctcccaaggtgccttgcacgtgcacgattactagtttattaaaaggactgggctcgtatagccaatcttacaggacaaccccttttgggtggaagcagatcctctgacatgcagttgagtcactgatatgtgggtcctactttgctatggcccacacgtcagtgactcaactgcacagcagttaagtcacagaatctctttcccttttgggtacagagaacatacataaaagtcctgaatttagcaaacgactatagaaaatctgtacacttaacatcaccgctcctaccactaacatgtgggtcccacaatctatagtgttacaccacattttagcgagtacttccctatttccctattgactcactccaaatttcaaaatcacctacttgttcaataagaaaaatcatattattacttagactaaataagtgttttattaattgatttaataagctagaaactcaatttattttccattgcaacgtacgggctctaggctagtacaagaaaagcaatcaagtcctccatgcatgccttgctggatctgtcgtcaaagatgacttgattgcccatagcaaagctgcaccagattttgccttggctcaatccctcaacgaggttttggctttggcaaacctgatggaactcagccttaccacagaaatacactgtcagagtctcagagataaaaagagaaagcaacacacctggatcagcctaggagctgagccatagctggggcctccaaacattggaggtagaagcttcattactgcagttttttcaacgtagaagcgtgctatggttgccacctttaattcttgcatgccggagagggacaatatggtcggcgttaccaacccttgatccgatctgactatgacccaattgacgatagcagcaagaaaggtagagacatggtgagcaaactccggcaaaaccaccggaggcagtcgcgatggcgctatgatgaggacgactagcgtcgactacaacctcgagcaccaaaggaaactctcaactacaagaaaatttgacacacaggacaagtccgacgacggatctacaaagaaaaggagcccccaacctctcttcccccatcgccggcggcgaaccaccggagacgaggagggatcggagagggttctgagaggagaaggagaaaggagttatcgttgggatcaacatatcacttcctcgagaagatttttgtttaaaaaattatgtacatggctactggctacctttgctgtcttgcagatcgaattgtcacataaacgccacgtcaatgccacgtcaaatgaagaccgagtcaaattagcaacgtaggcgtcacgtcagtaaaaaccgccgagggacctcatttacactggttttaacaattgagagacgcgttgtatctggttttctggttgaaggacgaaaatcggattcgtcgacaagtttacagatctcagatgaacttattccattcacgaacggacgaacctcctagcagatcggccgagtcatgaaatggtaccaaagggcccagtggcgacgctgggctgggctatcaatcttttctgtcctctacctgcaaagcgtttgttaaatgcttaatatctttttacagacgcatatgcttccatatacagaaaaacacacactaattaatatacctatgcacgctctacctgtggaaactcaatatacacatgtacgctctacctatagaaactcctccaagagattaatccgggatattttgagattaataaagtcatcggagatgtttcattatcgatggctacgtcggcaaacacggaaagaatgaaaaatgattagttgtacatgaaagcatcagtgttaaatctagtacttaaatttaagcacataagtttcaatataagaaatctaaccggtttagtttaatatgcatgtttgcacagtccggcttacgaacactaaataattaattaattacaattgaaaaataatcgaatacatagattgccccaaatctgacagcgcttaaatgtgttaatagtaaccatccttttttaagcctctacttaggataaaaattcctctgtttagaccctccttaaaacactagcacaatcacaaaactaattaatggtagagtccgttttaactcattgaacgtcgcttaaattccatttttcaccataaactacaaagccgttttttatacaagagtaaaaaaaatggactttgcttaaattacataaagaaatggactttgacataacggcattagagggttattatgctacacgcatcgcacatacgtgcacgctagagggtctcaaaaaatatgttatgccaccatctttgcttttattcctgggagaaacatcatgcaggtgtggttattttgtatgagacattacatgaattgcatcgtacaaatatgagtggagtaatttttaacattgattttgagaaagcatatgataagataaaatggtcatttgttcaacagactttgaggatgaagggtttctctcccaaatggtgtgagtggatatcctcttttatccaagggggacatgctggtattaaagctaaggatcaaattggtgacaactttcaaacacataaaggtcttagacaaggggatcctttatcaccaattctctttaacatagtagctgatatgttagctttgctaattaaaagggctaaagatagtgattttcttaatggggtaatccctcatttagtatatgatggtttgtctatgttgcaatatgcagatgatactatcattttcttggagcaagatttacaacaagcaaagaatctaaaattgatcttatttgtgtttgagaatttatctggcttgaaaattaactttcataaaattgagttattttgttttggccaggcaaatgagtgttatgatcgatattctagtatttttcgttgtaagctggggttttttctttttaaatatcttgggatttcaatgcattttaggaagttgagtaacaaagattggaaagttattgagcaaagaattgagaaaaaaaacttagtagttggaaaggtaaacttttgtctgtcgggggtagattggttttgatcaattcagtcctttcaagtttagctatgtttataatatcattcttttagataccgaaaggggttcttcaaaagattaattattttagatcacgtttcttttggcaaggggatgatcataagaaaaaagtaaagattaactagatgagatataatttgtcaacccaaagaccagggcgatttgggtgttcataatttagagattcaaaagaaatgtctcttgagtaaatggttatacaagttaattaatgagaatggtgtttggcaagatttattgaagagaaagtatctttataataagtctataacacaagttgacagaaaacaaggtgattctcatttttggtagggactcatgaatgtcaaaaatacttttttaagtatgggttcttggattgtgaataatagggaacaaacaagattttgggaggataaatggctagggaatagggccttcagagataaatatccatctttataggctattgtcagaaggaaaactgcttctattgcaagtgttatgggctctgttccgcttaatgttttctttaggagagctttagttggacataatctaacatgttggtatgaattgtgtgcttctattgctcatatccagttggatgattcttctgattgttttagatggaattatcatcagaatggtcagttctcggttagatcaatgtacttacatttaataaataacggttacattgatagaaataagttcatttggaagcttaagatgccgttaaagattaagatctttatgtggtacttgctaaagggagttgtgttaactaaacataatctagcaagaaggaattttaatgggagtttaagatgcagtttctgtatgaaaaatgagactattcatcatttgttcatagattgtcattatgcgaagtttatttggagagctgttcagttttcttttggattataccttcctagaagcatatctgatattttttatggttggctttgggggtggacaagaaaaagagtaaactgatacttgttggtgcctctgctttatgttgggctctgtgtttgagtaggaatgatagagtttttgataaatcatcatctgtttcctatatgcaggtaattttcagagcaacatattggcttcggctgtgggctcaactgcaaaagtgtgaggaagatggagagttcttgaatgttgcatgtcgtaatcttgagacgacggttatgcaacttttcgccaaccatggctagagattcaccaacagactcgagtagttctctttgtcttgtttgcttttcttttattcgtggttggtatatttgctttattttggactaagctcttttagtgtgctactcttgtaataatgggatgtagctcttttgagcaaaggccgggatgtttcattccattatcttaaaaaaaaaatctttgccagatttttttgagcaactttcactatcaaacatgaattctaaatgaaaaggggcacttttccattctcagatatacttatcaccatttctttttacaaaaaaagatacttaccagctaccaccacactatatatttgcatccaaactttatagataatttttatttaatgaggttacgaatattttaaatataattgttgaagtctgttgcacgatatagcggtatagctatatacacaaaccttacttaggccccgttcggtagtgctccaaactccaactccagtgggagctggtgttgacggtccttaaatcataatatatgaccgtcagtacttgcatataatgaaataaaacatggtatccaacttagtggtaggtattattactaatcatttccactagtgttggtgaaatatgtgtatgcaggtaatttgaggtgaaaacacatccgtgatatgacaaaatgcacctctgcatatccaggacacgtttacacggattagaggctccataagccaataaaaaccatttagaattgggccaaaacatagtgcaggttattgggggcccattaagcaacctaccggccaaaggagaggccgggaggacactttttgggttcggccaaacccgttatgcggccgttcaccgtctgcttccacgtggatggcttggattcctcctctatggcggttgcagggtgttttggtcatttcccatacccctaaccatcatttggagcttatataaggaggtcttcactcttattccaagacacacaactttgagttgaattacaagaggctctattgtatcttttgtacattagaataaggtagagagtggggagaagcaccggaggagtgcccggaagtttggcgctcatccgacttctacctcaacgagtgtagcttcctaggaggaattctggaggagtaccggagctgtcggtacactctgctccgggttcggagaacttcttctataaagtaagcattcgtgttcctttcttatgttatttaattatttagtctgagtaagatatatttccatctttgcgggttcattgtttagtattcatactaagtgctctagtactaggactctggatagagaaggaagttcttgtgcaagtattagagtagtaattaataacttagacgtgttgtctaggttagagattacctttgtttgttgtgtatcccatggatttgtcagatgtaggcggcaggtggtgacagccttgaatcccgtccaagtaattctccacgttcggatacatcatagagctatagccgaaacaatgctagcagactagcaggggtcggcgcccgaagcaacagataggaaattacctttgcttagcttagataattaggtagattacacacgttccctgagttcgatatccttttggggtcacccgaaggtgaagtgctacagcggtattccgtgcgcttgcggatttatctatgatcgtaagaaataccaacaagcatttctggcgccgttgccggggaacggttgctaatttatccgagtctaggtcatactcgtatctttatttttatttcttcttctcttattcctttccttgatggagcaacccgcaattcaaaacctttctgctcctcgggctgatctttgtgagccgtcctgttcttcaaaaccaatcctttctgatggctacgaaatcagtcctggccttatagccatcattcgagatcaaaccttctctggtagtgttggtgaaaacccgtacctccatcttcgggactttgagctagtgtgttcatgtctatccatcgtaggcatgacacatgaaactctaaagtggaagttgtttcctttttctcttagagatgaagcgaaacaatggtacactttgtctgtcaagaaattccacggtaaatgggaggagcttaagtgtagattctgccttgctttctttccattaacccgtgtaatcaatcttcgattagacatcctttcgttctgacagaacgagaaggaatctctcggtgcagcttgggccaggttttcactgttaactcagtctggcccagacttgtctctacccgatcatgtgttgttacaacattttcgatacgggttagataaggagtctgccgcaaatctcgatatttcccccggaggatcgttcgcacacaagacaactgccgaaggaagagaactcttagatttgatcttagagaacgattctttcggccaaagcgaagccatcccggagatcgagattatccatgaggatcctctgcacatggagtcgaaacccgactcaactgtcgaatcctcattccagtcgctggagccggaggaagaagaaattcattccccggaaattccattccaattcaggggtgatctttatgaaaattatgagaataccctgaattattccagcgaaaagaaggctcatcccaagaatgagccgttcgaggaggtgatgtttgtatcttcgttcgtttcttctggacctatttcccatcttcatgaaactgaacgactctcatcaccctcgatcaagcctaagccttgtccctctggccctcagaacgtttttcttgtttatcaccaagaaacaacccgattcttgcacgatgcatcagttgtgaaggagaaccttcaggccacggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8954 - DNA, 19702 bp, Oryza sativa
  unsure (1)..(19702): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagatagagaaaaatacaggttgggatttttgagatgaagatcttcttggaccgatgttagcgcttcggaacatgctgttaagacgagctctgaagaaattagagtccattgatgagtcctatttagtgtgagttacctttcgtaacttccctcttttaaacactgaggtgatgcctgtggtcaggctcttattttgagctgttttctgggcaattagaaagcccaagcattgatgataagattgatacatgaggctatttgatattaaatgccatctgagcacttgagcagtagctgaacaagatgtgattttgtcgagggaatatgtagtgaatccaactgaccattagaccagaactctgaagtacttttgggtacttaaaatttaagaaaaataaacaaaagctggaaatcatctggtagtaatactcctgaagcatgttctgcatttttccgagctttgtcatagctgctaagagttatatcctctcgataacttatcttgcatgaggcacaaaatgtgcttgaaatgattcgcgtatccatcgttctttccctttcatagctttagtcatatcagatttggtattgcaacaattaaaccttctcaaggattggatgatgatggagagtgtggtcgatgaccaagataaggagcaaagaaaacaagccaggtctggagagaaaaaatgtagggtagagaaatgttgtaatttatatattagacctgaatttttcacctgtcgacatttttcatgttcattcaagctactgtcatagtttgtttggattctgcatcaacaaatatctctacagctttttgatgcatccataaatatcgccagtctcctcttaagtgatgctttcactttgatatggccacataggatagctctatatgagaaatattggggatttaaaacttttaatatacagaagtgattagttcatgctaatccttctatttcagttcaatcgtggactgttgtcagtagagaaaataaccaggattgccccttctgtttacgacttcacagcattctaaataggttcaggcgacagacaggtgcaatagacagcgacaactaaacagaagcctaccagtcttctcttatccttacgaccttacaagtcatggccggtaattatgatttatggaggtgattattcatgattactcataagggaatagaaaaataaaatcacatgggtcatagcatttatctggtggaaaattgactgcattcttgttagtacaagtagagacttgaccaactattcatcatgtattttggctgtttcagtggatcgctgcacttcctgagagttcttttaaagatattaccgtctctctcaacgcttaccggaattgcagattcgatctatttgcttcgactgcaaaagcaggtatgtgaaccttatccccaagatatagaagttagcaatggcataagttcctctctctttgttatcaaaaacatgtcattcttttggagtacatgcatatcaagatattgaaacctaaatcatttatcaggctagagctgcggctgggtgcatcccatccactcatttttcagtggccatgctagcctgctagggatcacattgggaagggaaacaatcaaataatccgcggtggtctcagctcagctgcatgtgtggaggacaagcaaatcgccaataacacaccacatggggcaacatcgcgcagacatggcatggaccctgcttgccatctacccctcaccgtttcaatgcaccagagttacagcggcagcaaggaggcccccccattgcaattgaaatggccacatgtggagactgccatatgtttccatcagagatgatctctcagttacagtaagacacatccaatttcgacttgttaccctgatgaaggaacaagaagaagagaaagaagtgagtgtggcagacagagacagcagcaacccgggcagacagctccacgcacatttcacacaaaagtccacactccaaacagctccgtgtgcagcagcagcaagcagcaggccagcagcttccttggtcagatttttccatctcgtccaattccatcgcgttcagtttactgaactttcgactgctacttcggttcaggctttgtttcgacgccctatcggacctttgactgacgtgcttgcttgttaggtcgttcagaacactgcaactactgtatcgtcacgtcgggttttcgcttcgcttgcacctcagctaagaatgatcatagcttcatctgtagttacctaaattaccgaactgtaaatttcatgagattgcaggttcttcgacagtaaaattatcaaatttgtacggttggaaggattttcagttaattaacttataatgttacgcacgaaattttcactgagcattgacggtgctggctcacatgctatctgacaaggtggtcctgctatcaatttgctataaagttacaactaatgtcatgtcgtcatgtgttagcattgttattcttttcgcattttgcttgtatgttcatcctcgattggtgctcaaagccaatcaagcagttcaaagttacaataagggctcctctgaatgcaaggataggagaaacataggattgacagaaatataagtgtaaaataaaaggctacaaatcacaaaaaaggaaaaacaaagatagcgcttggttagatggcatgaaaatgcaggattttgaggagagatcaaaatgaaactacccatgaggttggacctcaatattaaatttcctcaaaacctgcgtggattgaatcatttcatatatatttcataattctatattgtccagcctttgtttctaaggatcatttagaaaaaaaaatatagaacaaaaatcctacaaaatttctatgttcatagttcaaatgaaaggggtttacgggtattttctcaagggtactaggcaaggactaggtattttctctactaagctttttttctcatgtctatttgagatctcctattatatgtgttcaataagggattttttttttactcttagccatcctccctaacaacgtgttctcaaatgccatccttccaaacaactttaattatttaccatccgggcccactaggctattgctattttgccacttttgattggtagctcagcaaaccgggtgacaaaagacttcctagccccttatctcctttttcataccttcttccttggcagtccttcccctttcctcatgtcagcgagttggcctaattctagcaaggtcctgcaagctggcgatggaggtgagctcggagacatagtcggtcgggcttcgcggacccaccgggatagggaggatgttgttgttgctggtggttcaccacccaccccgtcccaacaagctccttgtcgatggaggcgacgataaccgacgagcttagatacacggctggtagggcttcacggtgccgccgggatggggaggtggatgttgctgtcagtccactaatgagctctctctatctctctctctctctctctctctctcgctcgtccgagcatgacaatgaaggaggcgtggatgtcgggaagtctctagcaatccaaacctccatccgtcgcctctaaggtcttccacccagtcatccatcgccgctgtctctgtcgatggttgccacccgtaggatccaacatggtggccggccttgcatcccagctccacaaaggggaatggtggcgacgacgatatgacgggggaggagtggagggagaagaacgggtacagttcgtaggcgggaagctcgccggtgtgtaagaccttgccggagccaaggcagctcgcgaaccaaaggaagtgagttggaagaaagataggagagatgagataatgggtgaggtcttttgttacccagtttgctaagttagcaattaaaagtgacaaaatagcaatagtctagtgggcccagatggcaaataatcaaggttatttggaaagatggtatttgagaatactccattgggaaggatggcaaagagtcagaagccctgtttaacgagcacaatatcgactattagtagcaaatacttcctccgtatcattttaagtgtagctgtggttgccgtgtccaatgtatgagtgctcgtcttatttgaaaattttatgaaaaattaaaacaaataatttgcgcataaagtattgatcatgttttattatctaataccaataagaatactaatcataaaaaataaaataagatggacagtcaaacattatatacgaaaatccataactgcacttaaaatgggacggaggaagtagtgaggtcgtcagtttccaattacgtgcaaaccataaatatggtgtgcagtggcaactgagccagttcatatctgttcatggttctttctattaggagggaagaggtacatatacacatttttttttagcacgcccatttttctaacctaccatagagttgtaaacctcatctcatctagaacatcacaaaaaattttaaagcattgctctagaggtacaaaatgaagctacttcttcacattcccaatcctcacaatcaaccgtaatcattctccatttaactttttcatctacttttccttctcaatcaatcataatatttctccaatcgtttttacttgctttcttaatactcattcctacttaaaaatgcttaaataggatgaaggtactcctagcctcctagatattgtaaacttaaataggatagaggtattcctagcctcctactagtagatattgtaccttgttaacttcgttcgacactcgtttaattgctaaacaatgcttactgaaaacattaaaactccacacatcagtttactaagaaacgtcgccaccaagctcgatcaatgacggcgaccggacaggctgaaaaattgaaaatacggttaactggtaccgatacatccatgtgcatgtggtctcattctttgctctagcaacccaaaaagaattcatggataaggatttgtattcatatttttgtgatccaaaaactgatacggataaataactgtgataagaaaaagcttaaaatttattcaaatgtttaaatcctagataatatggataagccaaaaagttaaatagggtaggcatgtcttcaaatacttctaccagtacataggagtagcaggagtaggagtaggagtacattctagactgcgaggaatacaaaacgtcacgtgtggttaatccctcctaaccatgtcaacgcgaggagagccgggtcagcccaaccaaccaacccaacccaccaccgccttcaccctcacccacaccacccacacgccccccgccgctacgcaaccttacgcctatggcagctggggcccacgtatccgcgggaccaccatgtcagtgaccgggggtcatgggtactccagcttcgtgcggcagcgcgcacgaaggcgtggggtgtggtggtgggcccggctcctggtaggtgagctggatccagcgcggcggggcgggggcggaggcggcatcgggatcggcgatgattacacagatgaatgcgacgctattggatttgctagtttcgaaatgtttgattttttcttatttaaaaaatttaggtaattattaattattttcatatcatttgatttattgttaaatatatttttatgtaggcatacaattttacatatttcataaaagtttttgaataagacgaacggttaaacatgtgctaaaaagtcaacggtgtcgaacatttcgaaacggagggagaacgttttttttttgagagagattttgggcgcggggcatatgtggtattgctcgtggcaagaacagaggggggtttgggttccgagggataggggggcacagagcttgtgagcgcaggggatgggggatgagaaatgggagtatcgtgcacgagcactactactgccgccgcggccgttgtgatgatccgatgacgtcgtcggccactgttcatgtatttcctctatctatatattttaaatatattttaatgtatgatgccgttgactttttatccaacgtgtaaccattcgtcttattaaaaaattgatgtaactatcatttattttattgtgacttaattcatcatcagatattttttaagcatgacataaatattcccatatttacacaaaaattttgaataaaatgaatggtcaaacgttgataaaaagttaacagcgtcatacattaaaatacagagggagtacttagtacctccgccctaaaataaggctgtgtttagataaaagggttgtaaaattttatagtgttgtatcggatatttggaaatatatttaaagtattaaacgtaatctgataataaaacaaattatataatccacctgtaaaccgtgagatgaatttattaagcctaattaattcatcattagcaaatatttactgtagcactacattatcaaatcatgacgcaactaggcttaaaaaattcatctcggaatttacacacaatctgtgtaacatatatatatatatatatatatatatacacccctccctcctgtcgcccctctctccctcctccctcccccagcgccccctccctccgattccccctccttttttctctccctccttcttctctcttttttagaaaaattaaaaataaattggtgaattcaagacttgaaccaatgatctcatggtttatgacaagcacttctaaccaaatcaccatatgatgatttgtgaacaaatcagttatgtacctataacaatcataccttgttactatgattcggcagtaacattatcccagaaatatagtaacatcatatgttactggaaaaatgtataggttgttactgcacttttggcagtaacaatatgacgaaatttatagtaaacagagaacatgcatagtaacagtggccctatagtagtaatgtttttttagatctagagtattttaaatctcaatatttagagagtactaacatacacgttatgtcttatttttctaacccatttgcatcatggcattcgtcaaaaaaagtgcttaacgaaactagaaccatcataactattttttaacattgttacagcgaaaagcagaggtgttactgcatattggccatcatgttactacgctgtttcagtgagatgaggactaaaaaaaggtaaatctcaatctttagagagcaatatctctcacatcatatcttgtattttcaatccgtttgcaccatgaagttcataaaaaaacgcttaacgaaacaagatccatcatagctactttttgacgttgttactgcgataatgtggtcttgttactgcacgatgaccatcctattactgcacgattcctgcaagacgagagcagcaaagtggtgggcgggggagggagtggtgggcgggtttgaccggtgggaggacgctttgaccgacgtgggaggggggctttgggccctaggaagggtggggggaggtgggtttgacccatgggaggggggtgtagaatagattttatatatatatatatatatatataatacttcgtgcatgtatccaaacattcgatgggatatggtgtaaaattttgctaggggatctaaacaggccttaaagcaacttactccctccattaaaaaacaacttataagtagatgatgatttgacaccacctaaaataatgaatccaagtttattatcctaggttgatttttcttaatgcagagattaaaaggtagtacctcatccacccgaaaatgtaaacattttttaggttggcacgggtattaactaaggaagtatgtgagaatgattgaagggaatatgtgattagttaaaaagaaaaagtaggtaaaggataatggttgtgattggttgagagtaggagatagatgaagaaatagcttcattttgggacaaagtactatgctagaaataactacatattaggatgaagatagtactacgaatttgaacctcttattccctccgtactcgtaaaggaaatcgttcgatatggtctccaaaatataactttgactacttgtttctataaaaatatttattaaaaagtaatatatgtatacttttatgaaaatatttttcaagacaaatctattcatataattacatcttcaaactcaacaacttgatagttattcataatttatattcccaaagtttgacttaaacattgtcctaaacgacttccttcctgtacgagtacggagggagtactgttaaactcattgttagcaccgtacctctaatactccttgttaacagttctatgcatgtgttacacattcaggtgttaaaaacaacaacagtcctaagacacataccatggacgattcttttgagatcaagctagtaaagctttcgcctgcagattaacgtggaacaagggtaaatatatgaggcaaataatatgactggcatccatgcaaacgcttccttatcattaaaaaaacaattaattggctctaaaaaagttactacaagcttcaaaaagaaatagtataaaataaaacatagtactccagagatgttttatctaaaagaaagatctttgcattatcagagatgttttatctaaaacaacatcagatatgtcgctgtggctcgatggttatacagagaaattcgttgactaaattagcagttctttttctaagtctgacggcgcttaagcggatagaattgatagttccttcgttaccaactgatgtactttgacacatttgatttcactattcgtattttttctacctcctccatttaaaaattactttacacgtcttaaaatactgtaatctatatcttatgtccggttttataatattaaaacggaggtattttagataactccctctatttcaatttcgtatattattttattcgttgcaaggctaatttgttttggaggaataaatttgtattttgtcatataagattaatgatgaaaaatagtactccctcatttttcaaattataattcgtttgactttcttcctagttaaacttctttaagttttatttttttatagaaaaatatagtagtattttcaacacaaaactaatttgagatttaatgaaactaatttgatattttagatgttgctaatttttttataaactttcaaatttaacaaagtttaattaggaaaaaagttaaacaacttataatataatatgaaacggaggaactactagccaagtttgcatggttgaatcaacattttgattattttacagggcatcttgaactgctaacaacgatacgaaaactttaaacatacactattatttttagttgcattttttatttttccatgccttattagccgtagctcaaatgacatgtgtgtcgacgtttaatgtctcgactacggtatttgcatggcatgggaatcgttggtactagggtatacgtgagactgaggtaaaagagatggagacaatgatttttatacaggttcgggcccctgaattgtcaggtaataaccctacatcctgttggccgaagccgatattgctcttattcatgataatcacaccagtataatatttggggtagcctatctaactgttgtcgacttggcggtctgaagttctgactcgtagtcgacaacagggtagccttcctcctcgaatccgtgcccggcgagatcagagatagcgctttcgtctctcctgacagtatccggagacaccgtagggtactagccgtgcttatccctgaagtcgatatccggtggcgtgtcttggcgtatgtaggcttctatattgtggcttctatgtcgattgtgttgggtgttgatcctgtcccctctcttcctaggggggcttgtatttatacccataggtgtccccttgtccaagtagaactagggaaaccaatatagatacaatccgagtagtcattgtcgtttccatgtagaactctggttgtctttccttatccggaactcctcctatatccgaacgttgcttccgtataggacatggtacgtagtgggtcctaccgagatttagtcaactactattaggtatgtggtatccataaccctgacagtagcctccgacttcaatgcaaatgaacgagttcatattctcaaccgcagaccttggaggaactgttatcgagcgcacatgaccattctcggtgagtgtagagataacattagacttcctttatcagcctcgtgtgggtacctaaagggttagtctgagtcaatctccgacgtcaaccaagaaagaacagagcatgcgactaagtctcccgtcttgctgtaatcgagaatttggattgaagtcaagaaattttatctcggtgggtacaccatctcttcatttcgtattccttgttgagatacatcaaccgttctcgagtgatcgagaaagcgcagaatctgcgacggagctttgtcgacatttgtcgtactcgccttagtcgatcttggtgtagaaccatagagacatggagccttcgtcaatgtcgaatagaattttcctgaaatcaatactctgaaaagaatattagatagaaatagccctcgagcgaacgctcaaagggtaacatgttataatataacagactagtgaattgaatgtacagaccagtgttttgtatatgagcgtcttctctcttaccgactccgaccagtcagtttgtagagtcatacactctccctagcccccagccttgtcgtcggagaatcgttctcggatgatgaggctcttggacctttgacctgcctcggttgaacaagcactgatcctagcccccagccgtgaagttgaaaaatccaatttccgattacacggcttggttaatacgcacggcgagaactcttacacgaccagatcttacatggtcttttgtctttaaaggatccgataaggccttatcggctctgggcgtccccagccgaagttcccttaggttcctcggaggccttgtcaagacggcgtaaagggacattaggataggtttcaacgctaggtgtcttctgtggtaagggatctctgggtaaaacacttggcaatattgtgtacatgatatcaactttgttgaagtagaggtaatgggagaatcgctacacctctggtcaagaaccaggtagtagtcgtaactcaaccactagaagtaaatgtacgagagatcgctacgattgactggttgagaaccagtgagtaggtgtctctcgatcatttgaagtcgtggaagtttgcggtgcgggagattgctatgtactggttcgagaaccagcgagcgagtagaatcatctctcgaacaccaatggaagttgcggtgcgggagattgctacgtactggttcgagaaccagcgaacgagtagaattatctctcgaacatcgatggaagttgcggtgcgagagattgctacatactggttcgagaaccagcgagcaagtagaattatctctcgaacaccaatggaagttgcggtgcgagagagtgctacgtactggttcgaggaccagcgaacgagtagaattatctctcgaataccaatggaagttgcggtgcgagagattgctacgtattggttcgagaaccagcaagcgagtagaattatctctcgaacaccaatggaggtgctagagttggtttattgcatgtgcgtctcatatggctagcatgactcacgcacccaacttgtagcatatccggatgtccgttcgcaatcatgtcgggtgatcaagccgacgatgttcgcgaggaattatccgttaacaaccttttctcaagtagtccagcgattgctgtgttaacaaccaaatttggtaatatcagcatcggaagtgaagatgggatcgaagtggagtcggagataaggattgttgtgggaacatagtaaggatcggctggagtccagatcggctacgactataatcggctaagtctgaatcagactgggttaggtgatacagccgattccgacgatacgacttgtatccgatattgggtttgagttgacgtgcttcaagatgattgtcatatatggatggagtcctgagaaggcaattgtatctattaattaggatgttttgtgtaatttccttagagatatgtttagggcaaaagtctgccgcaaagacttatggtatcttagagtttgttagagataatagtcgtgtctggtatggacatatcttgtaattctcgggtataaatagaccccaagccctatgtaaattttaacacacacgttcaatacaatttcggcgcatcgccacctttttgctttagttttatttcgacgagttcttgctttcgggttgagctgcatcggtttcgatcttcaacaagaggtaaaacttgttatgatggattgtgttctcgggattagtgcttccatctttacgacactctagtcttgtatatgtaattcgtcaagttatcatatatcttacataatcttcgacaatatcgtcatctaacctacaatcggctaacatatgtcgacagaaggcagccgactaggttaaatagcgacgttgacctagattatataagatatctagcactttatgaaacatccagcggcttgattgtctagatattgttcttctttcttcttttcatacttaatgctgcatcagttaggtttgatctattaagtcatgcttagaatttcaatctctagcctgccttctggttgccgattagggtagtatcggagtttcagccgatcttatctgatttaactacttttatcttatatgctcgattgatatgttagatcttccctttatattaagatcttgctgcgtttaagtatattaagctcctgtttaatgtattctacttgctttaatatcttaatatagagtggtatcggagtattagccgatacatgctagatctatctgatcggctatgctatgaacatatataatcctattattaatatatatttccatctaagtgatttatactatctcggcaaggtgaccgatctatcccaaccacttgatttaagtatatatcgatataaggattacatatgattaatatctacagccgatcgagtagatttagttctgatttgtttactaatacttgccgatcgatgtacatatgacatcggcataagataaatggtatgtcatcggcatctagccgatcggctatcatttatagatttaaccacgaattctttgtctctatttcttgttgattacaggatcaaatcaactggcacgctcatacatccgaaggcgagctttggacctgcacaggagttaagcagatctcctaggcctcgtgttttctgtcaacaggccggcgctatgagatagttcgtcggtcttcgttggtgggttgggcgcgacgattctgcatttgtcgagatcgttctcgataatatggtgtacttgaccacagcctactcgagtgctcaattgttcctgaaaaatattttctagaagacaagacatatatcagataatatcgagtatgtactcaaaaactacatggatcttctagcattatcaggatatgacgagcagatataaatatcaggcattatgtaaaccgtaagcaagcatgatttatacgaaagaaaatagagcgagcccccagcattaaactgtagtcgatttaacattggggacactcgcgcaataggtattgtataaaaaacatgtaataggtaaacataataaattatagatctgacaatattgtatgatctgagtaggtacgataaattgtatataaaatattgcgtacctgtgaagatacatgccggatgtatctacggaattagtagatcaattaaaaattaatcttactaaataccttgtttagccttggtagccgatcttaactgtactctgaacgcacaataattagcatatatcggtggcctgcatgggccccacggtatgcatgctaatatttttgtagatggcgatgcgatcggtcggctggttggttctaatacggcaaattgtctggcttcgacatcctttgctgcggtggggttagtcgaaccatggtgaagcaccacgactgacaaccctaaaatcgacgtgatccgcggtggtgacgtcttgaagcttggtcgatctcgagagatcgaattgttgatgacgatggttccgatattgtcggaagacatactccggtcgtgttagatctccacagccgaagtcgtcgagtagcttgttgtcggagaatccatctcttaaacccatctcgtcgaaaccttgaagcaccaaaatgcccctacgtggcgcgttactgtcgacgtttgatgtctcgactacggtatttgcatggcatggggatcgttggtactagggtatacgcgagactgaggtaaaagagatggagacagggatttttatacaggttcgggcccctgaattatcaggtaataaccctacattctgttggccgaagccggtattgctcttattcatgataatcacatcagtataatatttggggtagcctatctaactgtcgtcgacttggcggtctgaagttctgactcgtagtcgacaacagggtagccttcctcctcgaatccgtgcccggcgaaatcagagatagcgcttttgtctctcctaacagtatccggagacaccgtagggtactagccatgcttatccctgaagtcgatatccggcggcgtgtcttggcgtatgtagacttctatgttgtggcttctatgtcgattgtgttgggtgttgatcctatcccctctcctcctagggggcttgtatttatacccataggtgtccccttgtccaagtagaactagtgaaactaatatggatacaatccgagtagtcattgtcatttccatgtagaactctggttgtctatccttatccggaactcctcctatatccgaaggttgcttccgtataggacatggtatgtagtgggtcctgtcgagatttaatcaactactattaggtatgtggtatccataaccctgacaatgtgtaatactcaagtgtgtctactgaggaagcggaacatatcggattttctttcagcagtggaatacattctgatagtactctctccagtcataaggtttttgacatttagtcatttacaatagcttttactcaaacttttacaatcaataacttcgtatagttttaaactaactagaaaaaatatccatacgttgcaacgggtaaaaacgtattttcactgatatattaagagctaagcaataaattgaaatattaggatcgctatatacattataattgaaaaagttaatgagaatcctaacattgggatcactaacattgggatcactatagattataattaaaaaagttaatgaaaatatttcctgggtttagggtcaatagccttcctttatttttagccctaggcaagtccgctacctcattctgtttgtttggcctgcttcccttcgacccaaccataagtggagtcgaagcgcagctcaaagtctactaccatattcggccagtacgctacctccctccgtttggcctgtttcccttcgacccagccacaagtggagccgtaaactcaactcgcacagtctactactatctttggccagtccgttacttccctccgtttggcctacttcccttcgacccagccacaagtggagccgtaagcgcagctcgcacagtctactaccattgtcaatctcccgaagatagtcccgtggccgtacggttgccggagcaaatctctccccatcaaatctggtcgaatctttcccgatcacattttggttgagggtttttaattcactcgatcttctctttccgttttttccaaaatcagtgtaaaactctcccccatcaaatctgaccgattctttctcgatcaaccaaaattagttcagggtttttgatccactcgatctcctctttccgttttttttccaaaattagagtgtaaaacttggcataaaaacgtccggggaagatcaccgtcatcatcggcaattgttaaatggagattaaatccgatgaattaagaccgaatcgaaagggaaaataatggagaaaatgatggcggaggagtggggaatcgatttttgcaatcaaattggaggagaaatgtacaatcgatatggcggcggcgcagcacggcgctagggttcaaactcgggaggcgtgcggtgaacagatcgtgttaaaaaaccagatgaaaaaaaaccaaaaacacacgggagaaaaaaccggcgtccgaaaaaccaagcgccgggaggcgccaatagattaaaaaacggacgaaaaaaccaagcgcatgtgaaaaaaactccttcgcgtgcaaaaaaaaaaaagggaaaaaatgcctgtgccaaataaccaaatggacttttttttttccaaacggacttattaaaaaaaggttttttttcgatcagatgttttttctttatattttaccgagacagaagctctttttatcgcttttgaatcggactttttttttacctcattgagttcgacttttttttcctcttttaacagacaattgaaatttaagtagtatagataacataaaattaaaaaatcaactcaaacacgaatgacgtatcaaagtaccggcaaaaaaacatctttaatttttataatagtagagatataaatcgtacgcatgtatcttttgtcttgaaaagtataattattattatgtcattaacttactgaatttatataatacaaaattaaccaaagtttcaaaacatggatatattataatatgtggaatacatttttttctattttacgtaaataaaagaaaataaaaataatatgtgccctattttccgttcatcatcttttccccttgttccctccgttttctacggaagtgaaacgtggcgccatatcctgcggtgccttctccgctgttgcgtgtggaacggctcggacgggatccccattcctacacgaatggcgttatcgtcattacgataaaaacggaggggtgatcgggaaaccctctgggcctctccacgtcgtcgccgttacttcgaggcggtttcccttttttgtcagcgtccaaaaaatgagaagcccgcgctcttcgccttttgcagtaacgccccccgtcttatacaagattttcactatgaaccgtgagaaaagtcaaaaccccagtcccccgttcggagaaaagactcaatgaatccgttacttttttaaaaaatacgacaagtgtcagtcatttgtgtatcagactttttgtgaaataaaattatgccgcaccatgttttctatgtgtttattagttacttaaaaaaatgctcgtgtgttgcaactggtgaaatttattttaatcttattattattatatggtttaattaaaatgaaatttaccgtcggagtttgcttggatatatatatttttagaaaatcatgagctacagttaggagcccgatcgtttcaagttagtatgcgagtttttttaaacagatttcttatatgattccttctgtattatcaaaagtgaacaatattaaaaaccaattcaaatgcgaatatgtatttccaaaagcaaacgaacttaaaaaccgactcatacatggatgacgtaccaaaataccggtaaaaatatattcaatttttataataatagagatagagataggttgctcttaatgaattttactgattcggtaagtgttttttacataaaacatggttataaatttaatagactttaacttttttttttttgaaaagagactttttaacatttagtttactttagattcttttattgggtctctttctcttttaactctagtaactccttcagtatagaggacatggtagcgtctagaattgttcatagattgggccaaaaaatgcttaatttgtatagtataaacaaattagcccaaaccattcttttcactttcgttgttttgggctcaacaaaacccgtttaacatgtcttgttattcacaacatcccatgacgcggttgcattccctcaacgtcatgcctcaatgagtcccaacgttattatcccatagcaactatttccccgcgcttgacgagacctcaacgtttgcggcatcgcgctcgatgagtccaatcgatgattctattcctgcgctgatgagggctatacctctaagagtgatgtccctatacattcaggctgtgtttagatccaaagtttggatccaaacttcagtccttttctatcacatcaacctgtcatacacataacttttcagtcacatcatctctaatttcaaccaaaatccaaactttgcgcttaactaaacacaaactttacgcttaactaaacacagcctcaacaacctgcatgcctatgttcacgtggctcgatctgatggaacttcccacacatatagtgatccccgaatgcatgacgactattcctatcccctgccatggccttttgctacttctatgctctattcctttctcgtgtacaaatgaaggagcatgtacatgatttaactgatgcggtatatatacatgacagaactggttattcatgaggcggaagtattatgtgttatggttaggttcagttgagggtggttcttgcattaaagcaataaatggacacaacatgttagatacaaatctgatgaccgttcaaaattctacagactcgtagatataaacatgtcacctataccgtgtaaatggttcctaaaaatttatcttatccgtttcataatataagactttctagcattacccacaatcatctatcatctataatgttacgtcatagatgaatatggataatactaaaaagtcatatattatagaacggagggagtacttgttttcatccatatcgacaacatattctggtagcttccattccatgttatcgaaattttccgggcaaaacatattcccctatttttagcctccaagaacaaaatggtcacaacttgtaaataaacaaaagagcaagccccactccgcaaaacacacctctcctctccttccctcatattttaaccattccacccctcacaaatctcactatttacttacctttactccgccgaataaaaccaaccaacccaccctcctcctccctcgcccgcctcttattttttcttttctctcccccaaatctgatcccctcccacacgcaacacgcgaggccgcgtctagggttagggttcccctccccttcggccatggacgagctcgcggcggcgtcggcggcggcgaggaggaggtgggtgcagtgggaggaggtcgtggtgtcgaacgaccgggggaggcgcctcgtgcactactacctccggggagcggccgcgggcggcggaggagggggagaggtgagggagcttgcggtggtggggcgggagcggagcccgcggcacatgtcgtacgtggtgcaggggcggttcctgcggtcgctggcggcggcgggggtgggggtgggggtgggggtg

SEQ ID NO: 8955 - DNA, 16731 bp, Oryza sativa
  unsure (1)..(16731): unsure at all n locations
gtgggggcggtggtggcagtgccgtcgccgtcacggtcgccgctgccggcttccgcggagggcggggcgccgaggaaatggaggtcgaggcgggaggtcgtggactggctgtcctccctcgtttccggtaagatttgtgtggttttttttttttacgcctgggcggtcgattcgggtggtgttgtgcaggattttgtgttgttttgtgtgcgtttgcggctgttttgttctttcgcgtgttgtggtttgttttttctgtgttatatggtggctgatttgggaatcgtttttctgaatgttacggggtcctattccagactgcgcgcagatgcggtttgggcatatgtttttccctgtttctgtttggttcaatttgttcagggaatagcgtttttttggatttctataccaaaagaggctgtggtttctgattttctgacgattcgacccgaattcgcaaatagcgttttggatttctctaccaaaagcggtttgtggtttctgattttccgacgattcgacatgaacttgcaagattgtttggcctttagataggcggattgatttgttcccgtgaatcttttgtataacccatgcgtgttaatggagcggatctgatttctaccgtattaggtctatcagggcaggaattcaactttgcatccttttgttctctctgttgcgaggagttcatttctggattcgttgggttcaatctgctgcggcgcccttctcacctgattcgtgaggaggtagacagcttgttcgtatctcgtggttataggagaagagtacaaacgtttgcgataacccatccgcttatggtcgattgttgtatattagaaacttgttgctttgaacccggatttagctattgttcctttctattggaggggtttgattctgtttctatttggagggggaaatatgttctatttagagggcaaagattgacaatttttttcctccaaaggcaccttttttacgatataaccctcttatgacctgcctatgatttgattcggttagacatatcttatgtcagtattggaacacttatgctagttctagagttctttttttgtcaaaataactaatttatatgagttgccttgcggtttattctagaaagctaacaggattttatcataataagatgtataattcagtcttatattggtaacctgtaaatctcatgccttctccttttccataggattatggagaatacatgtgtgacccagtggaagccgctgcaggtttccctttttgggtcgattgtgtaagcatgcgttcggaaatatagagaaaatgaagcggcagcgtgagttgaaaggcaatcaggtgccattttgttcttcccttcttgtggcctcccacgagacacccatggaattaatccgtgtaaattgaatgcttccgtaatctgcccaacaatggtcaggaaatcctccaattagttctgtcgatgagcttttgtaggaactcttacggtgtgctgacgcatcaacttgtcaatgcttctgtttaaatatgaaacggccttacaaattagaagtcacctccaactctgtttgcttccaactgctcttggttttaaccttggtggtgtgcggctgtgcgtttcatcttcgatttttttttgtgttgttttcttcttgtgttgcctttattttttctgaatcacaagtgtgctactatgttttaaaccaatgttttgatgatactcctgttgcactgtcttgtatggtaaatttcttatgtctagtgcttcttttgcaggatgtaattacggatcttcttcaatgtctaataggttcaatgaaaatccatatgatgacattgagttcactgatgttgctgcttcaaaggtatagagctatttcaagataacttgcccttcatccttctagtatgtccaggatatatttctgaatttccccccattgctaattcattccatttttgtgtgcttaggatgtttcacatacatcatcagtaaggaataactcaaaagagttcacatggttaggtcctgcatggctttgcgaaaagcgatggaagcactacagatctttctgccgtaaggggattactatttcggtatgttacccactgatcattttcctgtattttgtgttgtcaccatgtgtaccactgagattttatcaaagaaatgaggacaacatgctgagatgaagtattgcagaacaataaactatgtagggttctaaatgaaactgcattatgaaaacctggaggagttttaggggaaaaagctatgacattctgttattgccctcctgtttggttttatacgttgtatttattagtactactgcacagtgatatgggagtatttcaaactattcaaaatagaagtttaaatgctaatacttgttattactctgaacctttgaaagggaaaccttggttgacacatgtttatgctatctttgtaggtgcataattttgtctacatcctgagtgaggaaaagaagaggctcatcgcccaagtggaggatctgtatgaagatactaattcaaccaacgttgtcatggtacgatggttcgacaaagttgatgaggttggtgtcgaattgccacctgatgttggtgacagagagattttcttttcccctggtctgcaagatctcagtgttgaatgcattgatggattggctgcagtcctgagtgctcaacacttcgagaagttccagagtagtccaaaacatagctattggcagccttatatttgtcgccgacagattgatgaagatggcgtcaaaccttttgatgtaacccaattgcaaggttattggagtcaagaagtgcttaggacaatgttcaatgcagcttcttctcttaaggtacgtttcaaggtcactaaaggtgcttctagttcagatggggcacaaaagaggaagcgtgatgcattcagtgaaaccgatccacagcagtgtgttccttccgctgcattcggttctgatagtctcaagaatgatttggaacataaaactcaaaagcagctatatcctggtagccgtgctgaagtcctatcacaggacagcggtataaggggctgctggtttagatgctttgtattaaagaggcgcggagacaaaatcaaggtgcgatatgaagatcttcaggatgctgatgagacaggaaatctggaggtgagcttagtgtaattctatataatctttttttccccactaaattggatctcagatcttacttgttacttaacctttgtttgcaggagtgggttttgctaacaaggattgctaaacctgatcagttgggtatacgcatccctgaaagaccaatggtgcggccatatcatgtacatagcaaggatccatgctctttcgatgctggttccattgttgatgcatggtggaatagtgggtggtgggaggggattgtattgcagcagggaaatgacagacgccttcaagtttattttcctggtaattacattcttaattaccatcaacatttcaatttgcctctgcatgacattttaataatgtagtttggagctactgaacttacatttgctttgttatttatcacaggagaaaagcagattgctgatttttgtgaagatgatttgaggcattcacgtgagtgggctggtggcaaatggaattccttgggggaaagaaaagatatcacacacctgttgccccccacttcagttcatgaagagggaggtttgcttagcaaacctgtttcacaagaaggcaatccctcttcaaaattagaatctgacaagaggtgtgatgacaaatcattgggcaccaagatttcacatgatcagaagcatcagaagcgtgttctggctgatctcacaaatgctctgaaattcgataacctgaaatggaggccaagaaagcggagcagaagatctggttccaaaaggcagtcagacactagcagtggcagtggcagcagcagccagggcgacatggaggagtccagcccctgcggaagttttgcagtgcttaattcagcgcccgatgaagaagtatgcaagagcagtggagaacctcttttcatgagggtttccaacctggtgatgtccagatgaagtcactccacgactgacatgttttagccttttctttccggatttcaacagccttggcgagatgtgagtttgatgcatccccaggttatttagtcacaactcacaactggtatcctgatcatcttgagagctctgaatgcttattcgctcggatgtccaggatgcaagcatggaggagcacactgttgtatttatgactgatctagatgagttttaccattttgtctcactttagggtcttgtagggtgttttaaccgtcttgttgtttagttggtgttacaaagatagctggctcattccacctcggcagtttccagagtcccttttttgtctttgtttcagcagtccaatatccaatttaatttgttcatcagctgttatagatgttcttatagtatactctctgaaatgataatatttacatcgtcatacgagttttttgttcttctgcctatgtggtgttatttgtgtgaatttattggtctataattgaaattgagtgtattgtcttcaatttctgctgcgtttttgagcctttgaatactagatgtggcggtaattgttggaagtcatgttggttggtgattatgtttgttgtcatgtttaaagtgtaccgatcttaccattttccaaccagctgtaccgacttcaccgggtcaaaattggcgccttagcgagctactgcttacattgcacttccgaaattctagttccattcgtgccttttctgtctgttttttcagacaactttgctctatggttttgccaggtccatggaacgcacaaactttttctagacgacattacgaagatagtagtatttgggacctgattccatccccgcgagggcatctcggcgaaggcaaantgtccataggaaaaggttttatcatcacaaggaagaaaaggccaacgagaagcagctaaggaaaggaccaccattcgtgcaagccagccactgaatcccagccagcgtcgttgtgaggaccagaatccgattcgattccgacctccagcagcgtccaccatgacaccaacaccccccttccctcaaagcggccagaaaaatacaacggcgagccaccggcatcagcttagccccagctgccggccaccaccaccatttccccttttgcagattcttctaccgttctctcttctccggcgagccggaagccgacgaccggtcgtcgcgcgccgccgccaagtggacagacggtgttcatgagtggcaaggtgattatggtgaattggaagtgcagagggggaatggtgtggtgttttgttgtggagtaactgaagctgtgttcagttttctctgcagttctactgcatgaccgtcaggatgagcatcgactgcaatgggtgctaccagaggatcaggagggcactcctccagatgcaaggtgaaaaaccggaaaatccaccagagattaccaccataaatattccttttggtctttgatgatttgataatgctcagtacagaacgatagcaggggaacaaaaaaatgggcatcaggaacagcatattaagcagcaaaaaacatctatcaagattctcttgttgattgtatttatttactaaaacaagcagaactgcttacctacacattcaacattggttacctgattggctacaattgatgtcctttcgcatcaacaattttccgtgcaaaaaatgtggatttcatctcacatttttaccccctgtgtatgtatgtatgtatgcaagaagatctggatagccacctgatcgaccggaagcagcagcgggtgagcgtctgcggcgccttcgtgccgcaggacgtcgccatcaagctccgcaagaagaccaaccgccgcgtcgagatactggagatcaaggagatcgacgccggcgacggccaccggctgtgaagtcgccggcgtcgcacgagatgggacggcggcggcggccgtaggaaaattctttgtaaataaatcctgtatattatagcgtatatcatttgttttaatcagagccgataaacttattcagctaacccttttaacacaaagcgagaatggtacgattgcgaatcatgaggaaagtagagaatggccagctgcatgcctgcatcagtatctaagctttgagatgaagcattcatcctcccaaagcatccaggtgaggaaggcaagctctgcaagcgtaggaacatggccaattctgcttggagtgcagcttcaggaagggcctaagtagccccaaccatatgcacagaggtggtccaaagatatgcactctcccataccctaacaacataacagaaactgaactagctctacagattcggtaccgacgatgatctcgtcgcaattgcgatcacatgactgacgatactgcgaaaatgacacaaaacaatagcagaaagcgattgcgaaatcgcctcgagaactatcatatcgccataacacggtctttcactacaacagattggtaacatcgagtaccagacagattgattgctggtgagtgagataaatgtgcaaagaagagctttgcatggtggtgtagatcatcaagaacttgagtagcttctacctccatccaatccaccaacaattgtcagaattgctggtcagtcagggtttccttggagtgccattaaagtccgcagaggtggatggagaggagagaaactaaacctgctgatggcttacggccaagacagcaaatgtggccgcacaacacccccaccatttttatgagcttgaacaaccgtcctggctcctccttttgtcacacccagtgagggttctgcaagtgcttcttctccttttggctgagattgagcaaacatgggcatggcgatgaggtgcgtcttggtcctcttctccgtctcccccgtgctgctcctgttcaacttcgagatgctggaggttgctctccatctagcgagccgcgaaaaggagctcgacaccgctgcggtaaccccttctgccagtttgagcttcctctcgaggtttaggataatgctggggatgaaccatcatcggtcgcggggccgaaggcataagagatattcagaagctccagctccagctccagcaccagtcccagcccatcaagcaagatcagaagctcctgcccctcttgttcatgtgcctcgaaaaggaatgccgtcgactcatcgcagccacattgccccagctagaagcccggtgcacaaagtgaaagatggtggtcacaccaagatcccgagatccgccattgttgctctgggtgtggttggattatgcctagttgttcttggagttgtcatagcagcattctcagtcagaagatcaaggaagttcaagaaggtgtgtacaaaggcattcaaaccatttcgtcatggatcaagagatcaaaggtcacctgctgctaccaggaaggtcagttcccaccctagcccagatccacttacactaagttccatagtacagtaccaacagaaccttccaaaccttaaacaatcatctgaatcaaagagtctatccattcagagcactattccgatgggtacagaactaatagtaagtgatcatgctgtgataaacaactcacaatctgatgaggttgaatctttccattccataccttgctctgatttatcagctggctccattacagagttacctcagcaaatttgtgatagaagagctattatgaaccgatctgagtatttcctacaaacacatgattcaccatctgattcatcatatcaatccctttcaccagattgtacatctcgtttgtctccaaaggatcaaactttcactgcttccagtcacctcagtttgcgtagcaaaacttgtccagaaaaatcagatggtgaaaatgctgaaataaactgtcatgatggattggaaataacttgcatttctgggtccatggaacatcaagaagcccctatcgaagagcgggccagaatcaatttcaggaacccaccatcacaacacatcttccctccctcctatcgtacagatacctcacaatccaaaatcaacatagcatttactatgactaactcaaaggttgaatcaagttctaaggaatcatcaaggattgagacctccagttcaatgggtataccaaaaccggcaccgcctcctccaccgcaaaagaaccctcctccaaatctgaaagggcaatgctatggccagcctccaccaccacctccattgccacttcagatacaggttggtaaagatgggtctcccctaccaaggttgaaaccattgcactgggacaaagtaagggctgctccaaaccgctctatggtgtggaatgatataagatcaagttcatttgagttcgagtaaggctatcccccctcataattgtgttcatcacatttcctattcttattatgttttacaataaagctatgctatgcagatttgatgagcagatgatcaagtctttgttcgcatacaaccttcaagggtcaatgaaagatgaggaggctatgaacaaaaccgcatctaccaccaaacacgtcattgagcaccataggcttcaaaatactactatcttgttgaagacattaaatgcaaacaccagtcaagtttgcaattctgtaatacaaggtaggtttcatgatgttttaagtaattataagttatgattatcaagttaacaataataacaatcaacttatcctcatgtctcggctgactcaggtaatggattatctgtgcaacaacttgaagcgcttgtcaagatgaaaccgaccaaagaagaggaggaaaagttactaaattatgatggcgatattaacatgctagatccagcagaaaactttgtgaaggtgctactaacaataccaatggcattcccaaggatggaggtcatgctctacaaggaaaattttgatgacgaggtagctcacatcaaaatgtcctttgcaatgatcgaagtaagtggagtcattttgcatgacttgtttaggacatattctgttgtgcttatatatattgttttatttaatagggagcttgcactgaattgaagtcaagcaaactattcttaagattacttgaagcagtactcaagacaggaaacaggatgaatgtcggaacattaagaggaggtgcaagtgctttcaaactggatgcgcttctgaaattggcagatatacgtgggacagatgggaagacaaccctactgcactttgttgtaaaagagatggctcgttcaaaaggattaaaggctttagaaaagctcaatgaaacacccagctcttgtcatgacacaccaactgaacgagaggagtattcatcaatgggtacagaatttgtctctgagctaagtaatgaactaggcaacgtcaagaaggtagcaagcatagatctggataccttgcgaaactcaatatcaaatctatcctgtgggctggctcaactgagaaatcttgttgagaaggacctagccagtgatgacaagaacaataacttcttgcaatgcatgaaatccttcctaaatcatgcagagaatactatgcaggggctcaaagctgatgaagctcaagtcctactcaatgtcagggaactaacggagtactatcatggagaggtcagcaaggatgagtccaatctgctccaaatattcatcatcgtgaaagattttcttggtttgctggataaggtgtgccgagaaatgaggggcacaaagcataaccaaactctcaatttagtccttccactcaagtgaataggtatagattaaccaactggccactaacaaattgattgttttgcatgtgaatgtttgtataacgatgttagcattaagtgtttgacaagttgactgcttgtgtatgagagtgtttctttgggagtgttagaatggagatcagttagcattaattataaacagattgtttatgtggagtggtattggcatcacggattcaaaatggatttgtgtggcatgatttttcaggcagcttttcattttggttagaatattagtgaaataatgcagaaaatgttgctcttggtaccatatatgcaaatacaattatagtaaaataatgcagaaaatgtttgcaaatattacaaatcaccaatatgacaaaccaattccaaagccagtatgcaaacacaatttgagatggctcagatacacctagatttacatactagcttaatttgtgatctttagagttatttccaagattgtaccaatgctaccaagagtgttaatggaggttaggaaccttatgcaataaagtagttttctccacaaattcaggaatacatttggcttttagcatcatatagaacagaatctgaaggaacaacaactcatgaggggcgaaaaatataccgaattacgaaaaattataattaccaaactattctacagttatagcttattgctttccataacttaatagtatcatctctccaacagtacccaacattcagaaggaaaaatagtacaaacaaccgaaaagtaatacccgatgagtgattaaagatacaaaaatggtattcgacaatagacctccataggaatcaaactaatgattagcgaagatagttgaaacttccaaggaaatcttacaaagttaagctctcaggatcctcaataatctttgcaaaagtttgcaggaatgctgccagatcagcaccgtatacaattctgtgatcagcagtgacattaacctaaaaaaatgtagatccaccttagttgtttctatatacagaaatgtcattcaaataaatcgcagataagcattaacagttcaagacgtaagatatatctgtggtgcttcaaccctacttcctaccaatgaattgatattttttatgagaacaatgctcttaatatcaggtgggtaaataaaaagactggatggatcatgtatacatataaaggaatgatcatatcatatatgaaaatcatgatgtcaaccacctaccacacccaaccaccccaaattatacacatggggtaattcgtttatcactaagcagagctcctgcctttgccactggctatcagtaatacatggggtctgggagtaaatgataatgagaactcagcattaaaaccaaaactcatgctaaattagtagcttaagagagatggttcatccacttggtagacaaatatttcggttcaatgtgtgaatttgtgaatgatcttatatgactaagcaaacagacacaaaacatactagagacgtgcttctatgctcctcggaaaaaaatactgcacgaaaattaaagcacatcaatggttcggattaaaagatgattactagggtaaaccgtcattaacgagggccaatttcgtccaggaagtaaaatcccacatcagaccaggccaatcgcaccatcgatctgggaggttgacacggcaacagggctgggtggtgaagatcggccgggcatgtgcgaggaatgggagggcgacgagctgtgcggggcgttgtttggtgcccgccgtcggcgttgagacggattatatataggacgacgagagaggaccagttctcgatcgaagggcaacgccgcagtggggaggctgcaggggcggcagaccagatggagcatggccggttcatgccacgcgcatccactacggccgcttttcatgatcatgattacgcaaactcccggccaaaaaaaagcttcttttgattcagtgttctcctgttctttgtactggcgaaaccttgatagaaatcccaactgttctcctgttttttgattcaatgtttttcgtccttgatagaggcggctgggtatggatatggaattttacttcctggacgaaattgcccctcgctaatgaggtttaccctgttaatcactttttaatccagaccattgatgcgctttaatttgtgtgcagctttttttattgaggagcacagaagcacttcccaacatactaatataacaatcactaatttccagtattggctgaaaaattgcatgtgtgaagggcaactaaccagcattttgctcttgacactaaagaaaccatctttatcagccaccactgtaggttttgaggctccgacagccattatgcctccctgtattcatacacactcaaatacttaggccatataccagtaaaggaaccacatcaatatttagcatcaagcagattaggagaaagagaacctcacctggccaggtggaagaattgcatcaaatctatcaacaccaaacatacccaagtttgacagtgtaaatgtccctgcagaccaccaattcttcaggtaagtacaattttcacatgtttttcaacaacgatctacaagactgaaacatcaggttccataccagagctgtactcatttggttggagctgttttgcacgagctttcttgactagttccttccatttttgtgagagcaaatatatatccaactgcatcatgccattgctcaagctattcagtgaactcatatgattcaattcctaaatgaaacgacattaaacacacagatatcctgtaccttatcagcatcctccagaacaggtgtaatgagcccaccatcgattgcgacagccaccgcgatgttgatgttggtgttgtaagtgaagctcttcccatccctgcagctagcattcaccaccgggtgctgcgcaagtgccatagctgcggccttcgccagcagaactgtcatggtcaccccctttgacttgacctaaccaaaccaaatcaaccccaacaatcaacaaaatgaccaaaatgtaataaaccatcacaggaggttaagcactgccacccccaaagtctccaaaggtatagcaccttctcatatagctcatcgagcttatcggtcacaattgggtatcccacacggaatgcgggcaccgcgaggctctccaccatgttcttgctcactgcagcctgcatgccagtgaatggaaccaccgtggcaccgggcaccggaggaagctccgcggcctgtggcacggcgccaattgccggagcagacagcggcacgggagcagcagaagcagcaggcacaaccttcggcttcggctcgatgccggcggcagcctcaacatcggccggcgtaattcgcccgaacggcccagtgccagccaccttagctaggtccaccctatgctgcttggccagcttcttagcttgcggggtggcaatgcccttcgtgccggctgccaccggcgccggagccgccggagcggccgcgggtggaggaggcggcggtggcggcgcggcggcatcggagggtggaggcgcctgctgcgggtgggccttggagagctcctgggccttggcgagggcggcctggaggtcgtcctcggactctgcgagcaacgcgatgggggcgccgacgggggcggactcaccggcggggacgaggacggcggcgacgatgccctcgtggaacgtctcgacgtccatgtcggccttgtcggactcgacgaccaccacggcgtcccccttggcgacgcggtccccctcggcggccgaccacgacacgatcttcccttccgtcatggtggagctcagcgccggcatgaagatctcccggatcttggcccgcaccaccaccatcctcgcccgccgcctcgccaccggcgccgccgcggcgccccgccccacgaggaggcgcgccggcacggtggaggccgcggccgagagcgagacgggcgctggagtcgtcgccattggagaggtggaggtggaggaggaggaggtggaggcggcggaggcgaggtgggggaggtcgggtgtataaggagaaggtcggcgagggcggagaaagcgaggcggatgagagctttggaaactccgacgaatgctgaaatgggctggggagggccgggccgagcctgacgtcaaccccctcacctggcctctatcagggccgggctcaactttctgttttggatcgggctcgttttagtatattgggccggcccattaacccgcagacgcaagccatctgtcgcgacttgggaaaagtctatatcacctccctcgtctattactccgctctccatctctcctcgcaggcagcagggaataagttcaccagaggtccctcaacttaacagcgagattttctgagggccctaaactacaaaactagaaatcttcatccctaaactcatataaaccgtgcactcaaggtcctatagcagtatgtatgggtggtttcgacgtggcatcctagtcagcaaaaataaataaaaaaagtaggtggggcccacatgtcagtttcgttaccgcacgtagccgcgtgctgatgtcgtcgccgccgctcccacctcgagccgacgcctctgctgctcccgccgccgccccttttccccgccgtcgcagcggcggccgccattcccaatgttgccactcctgccacgtatcgccacagccaccgctgctcccgccgcacgccaacgccgacaccgccgctcctgccgtcacccatgttccccgtcgtcgccgaggccaccgctgctaaccaccacatgttgccacgtccgccgttcccctccccctgggaggcctccgcggccgccacgaccgccgctgctcccaccgcatgccgatgtcgtcgccgccgctcccacttttgcccattctccccactgatacagaggcaaaatgaccagaaaaagggtaggagtacagtacagtacagaggcaacaaccacgttggattagaactccgacgctcgcccgctgtcgccgccgcgctcgatagttgacgccgccgtccgcctgctccggccgcacgttgacatcgccgctccgcctgctccggccacgtgccgcccgcgcccggagccggtgctcacccgccgccacggctgcgctcgcccgctgacgccgccgctccgccttttccggctgcgcgccgcccgcgcccggagccggtgcagttccggatgaggagaggtgggcgccggccgccgctcccgccgtcgcggcctcacgggcggtcgcgccggccacctctctccccttctctggcgccggccgcctcttctcccctctcccgcttcttcccagcgcgccgcagtgcccgctccgccgtcggccgccatctgcctgcctgcgcgtgacggcgtgagaactgagaagttgagaagagaagagaaaaaagagatgtgggacccacatcaatttatctcactgacatgtgagtccccacatatttattttactatttttgctgactaggatgccacgtcatcaaaaccagtcatctatactgcctcgggatccaaattagatggttttgtatagtttaggagtgaagatttctggttctgtggtaaggggacatcaaaaaatctcgttgttaagttaagggacctccggtgaacttattcccaggcagcagtggaggcgagacagaccagaccgctgaagaacagtcatatctcactgacaatctgacatgtgggtcaatttacacttgtttttaaaggtcaagaggtgtaagtgattcgatcaagaataagatagaggaggcaaattagacttactccgcggaggcgtcacgaattttttgtcatttttagatttttttttaatatttacagaaataatctatcggtcaaaaaaattgcaaaaatagaccctgccgccccagtggtgggcggcaagctgatgtggcagacggcgggtcgaccgtgccgtctgccgctgtcggccaaaattgcaattaccgccttgccgcccatacagagagcggcaaggggctaattgcaatttttgccgcccataatgatgcagcaacgggggttcccgatctttcgatgagaggaggataaacttcgatttggggaaggatacgacgttggcggtccgactataactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccatgcatagctgatagtagacgacgagatctttccaacaagtactcatttgccccgtttgacctccggagtgaagagcattgacttcatcaaatcagcgctgctagtgctgcttgcgatttggttcctctcccatattcctaacaacaagtagatcacaacaaccatttagtagcacctaattctgagaagaacttgtatgattagctaggaatgactttacctgataattaagttcacgagctcgagctctagtcattggtccttgctgtgcaataggcgtggttgtatcgttggaagggatgtcctcatcagataaagaggttgcgctcgtactttttg

SEQ ID NO: 8956 - DNA, 21457 bp, Oryza sativa
tccagatgcaaaaagtacggccaaacgatttttctatgttatgttaatattaaataaagaagtatttattggtaaaacttgttaatattgttataaaaatgtattgaagttggttgtttcgcaatttcatatgttaagtaaggtagtattttgtaaattattcgacgtattagtactcggataattaatataggcctatcgcagtctcggtcgtagaaacattatatggacttaaacaacgagaattatgtaacatgaagaaatagtagtacaatttgaacatgatacaactattttcattgcggttacatagatgatattagattcgaactaggagggaggtaatgcaatagttgaacacaacgacgatgtagtaatgggacaaggaagcatgacagtagaaatttcaatatgccaagttgtccgacaatagctaacccctacgtgaggatccctctcctctctcaaaacgcgttttagtaactctgtattgctctggtagttcaagctacacaacacggctaggtggagttagaacccttatggtgtctatccattctctgtattgacatctccttggtggttcctgggaggaaagaatagatgtaaagcgaacaaagttagtaaatgttgtgagaaaataaggattcatgtaatcaaaatattcttaccatgaaatcgccatcaagaatatttggacaaacgttgtaggctttatggaacgaagaacctgacaatgatcaccacacctgcatcttggacgggtttcccatggagggagtgccgtagttagcacccgccagtcgctctgttgttcacgacattgtcattcataagccgcttttctctgtaagtattgctcagtactttcggatacgaaataccagcgaccttcttgtaaacaagtggttaggtcgagaacgggattttctgtatcgacccacttgatgtatgcgcaagccgtagtgcgggtctgccgaatagagtagtgttacgaagaataaagcgattgcccatacggaatgaataagcatatgcagataataaaatacctcacgatcatagttagggcacctacaaaagcgccttcctcgaatattaggattcctcaaagccattagttggcatcgatcaccgcataggcagagaggacgctggcaccaaggtggtagtaggtatacacaaggatcgctacgccagttcggatcctcaacaccccggcgtctagccattgacgaaagccggtaggatttgtaatgaagcaagtgggaagagagtactgaatgtgactgagttctgaaagattgtgaggcctcactcgttaaggcgacttatataggtgcaaaaaatcgagtgatatccctgacatgtgaacgtggcggggcatggtgggtacgcctgattggcgccgaaagttacatgcctgatcggcgccgaaagttacattggtcgtatgcggcaaatggcgggcaaatactcgtatcgcatgcgaataaaggaggatgcatcggtgcgacagaaagtagtcgtgcatgcgccgaaaggtatcgtgcacatataacaataacatagtcattacacaagcatacagtactagaaagtgaagcaaataaacaaagagaagactgctctactggccctgccccacgccgcgaccacgcttagtcctccgggcctgtgctcgcacgtggtcctgggagtaggtgaaacgatccggtggcatagcacaggtagcacgagtgtctggcggcggagtggcctgcgcctggtcctgcgtctgcttcggcggtgcgcctcccagctgtaaggggccgatgacgtcctctgttgagcctgaagcgaagtcgaagtcagtgatgtcgaagagcaaggtggaaggcaccaagcggtccgacgaggtcccagcatggtccagtggtggaccctgactcgacgtgccggctgcctgtgacgaagtcccggtgtactgcagaactgcgctgagtgcaaggtcgatgcagctgcctgagacgctgaccctgcagcctgggagaagtgggcggcctgcatcatagcgaactgggcgaaacctacacatcgacaacgggacccttgtaagctaagacataaaatgcatgtaaattgattgtcgaagtaatgttgtttttttaagtacctgtggggggcacaacagaaggcctagccgaggaaggcggggtgctgaacggtgcacgaaaccctgaagcgatcggcaagtgaaacggctcacatatatgtgcgaggcatgtacagaaaaatccttaaaaatacagctgcggagggggagtcggcctaggaacgtgcgcagctggacggggaccagtcggtacaggtggccgctgtacagctgcgtctgcccgagcaacgttgtctgcacgacaggtgagcactcagagaatcgagcgcatcgactccaccatccgcgtgtacgtcatcaggtgctcctctacgggtaccggaatccccgcgcctaaacgttggatcatcgttgaaccgtcaacgacgacccggttgatgtcgtcgacctggatggttaatttgttcgtacatattcgtaaaatttgacgaagagaaagacatgaaaacataaaggaatggtgcgatgcagggtactcacagcacgagcgaagtcctggtcacggtgcctggtgtagaggtctctagtgctcgcaacgtggggctgctgctccaagggagcgaaggtgaccctagtacgggtgcatggttggtacccgcgtaggtaggcctggtacgcctcctcagtgtgtggctctctctcgtggtccacgacctcctcggttgcgaacaaccagtcctcaataaaagtcgtcaacttggcgggccagtcgccagctgactgctgacccttgcgcgagtacctgcaaattaatgtgtcatattagtgtgaatcgacagatgttgcaaattattgtggacaggtagattttaatgcaacaactcaaagcgcagtgaaagatcttaccggtgaacagcagctgggacggtcgtcggaaacagtactggaaagggctgacggaagccgaactgctgcatcacgcggaaaggggcgtgaggctcaacgcagatgtcgaagaccatcagaaccgtagtcatccagtatgcctggtccctagtgcagagtgtggacagacccaacggcgcacgagcctgggtagccgcggcactgtagggctcccacacgacgtcagtcggcagaaggcggtcaaactccataacaaactcaagatacgaccgcctaacctggacgtgagcccatcggcgctgcaatacgagacgatcgatgtgatgtacaatgaacttagcaattaacttaacaatacgagaagatcgatgtgacgtacctgacgacggcaccacagagtacccatcatatggtagtcgacctctggtcgctccgcgtacagtgactcctcgtacgcgtgctggtccacctcagggcggccgatcgcaatcctctcagctgcccagatagaaagaaagagagggcacccaccaaaggtcgcgctgggatccgtcttcgtgcaaacctcacaaaggccacggtacagagccgccaacaacgcggaaccccagctccactgaggcacctcgcctaccacggcgtcggcgatgctcctggcgtagtgcacgagtcccttgtcgaccgcgtgcccgtgaccgccacagaacatcacccagccaaaaagccagagcaagtatgcctccaaacagcggctgtaggagtactcgtcggcctccgcctgtagctgctcgacctgcaagcgttcgataaaatgttaggcaccttaactgtggactaaatatgtagtacgcttgtcatttcggtacgaaaacactcatggtgaactgaagcagccacctcttcgtaggtccggtgttgcggtggtgtgccaacggctcgagagggagatgcggtgcacgctgtactagtgcgaaacgtgttgtcagatcgtcctgccagtccacacccgtggtcactggcccaacagcgtctcccgcgagcggtagccccaacaagtacgatacgtcctgtagggtaggggctacctcaccgcacggcaagtgaaaagtgtgcgtctctggcctccatcggtcgaccaaagctgctaggagggaccggtccacagtccatcgtctggccgggtccgcgtcgccggcggtagcctccaccagccgacacatcggtaggaggccggcctcacgcagcctgcaataacaaattaatatgtcattataaaaattattacatcacaactaatttatagtaatacactgttcgtacctctcgacaaaggagtcgtgaaccgtaagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtagtaatgtaaaacaaaagataacttgtaaaattatgaaatcgtaataaaatcatgagaataattatgtacaacaagagtacaggctatttaaatatagcaaacgttactaagggtacataacgatgacgtgcaatttaacatatatgtagagttcgataatataacataacataacataacattatgtatcgaagtccgacattacatcagcatacctaaagacactaggtgccttagtctgacgttacatcacgagacctaaagacatgacatgccgaagtctgacattacatgacgaaacataaacacatcgataagttcgaaacaaattacaagcaaagccacatgccaacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatatcgttgcggatgcgacgagtcttcctccttccagccttgtctcggagcttcgatgggtcaggaatattgagtacttcatcgttagtctctgtgaactccccagctatgccgaacccataaatctcgccgctccatgtatgatatattgcttgcttactgaactactgtgacacatatactgcatctggtatgccacactccgctgcggcagcaatgatatgggtgcatggcctgtggagcagcttctgctttgcacaagagcaatgacatgtgctgtcggctttgagaatacactcctgcttcactctcttgcggtagatacccctgcatgccttatcttgacatagtatctcaaacctgtgctgttgggtaccttgcactagagctcgatgtttcatggcctttttacgcaactcctctagctttttttgcatgaaagttccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatctagttcttctaaccaatgttggactatccgttgggagaggtccaagagcttgaggagggtcagcatcggcagtcgatggagccgctgcacgctgatcactgcatttggctgtcaactcatctaatctcttccaaagctcattgatttttttctcctggttttgattgcatagcctcttaaacatgttcatgagctccttgttcttgaattgcttgaagaaattagctcccatatgatgcatgcaccacctactctgtacatcttcccactcaccagggtatcctcattccatactcccaaactgtaactcttctatcgctcgcagaatgccagcgtgcctatcatgtatcaggcacacatttggcctcataccaacaacttttgttttaaccaatttcagaaaccagtaccagctatcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcctagggtttctttcctcgataataccaagcaggcgtggcaaattgtcatactaggcttcgtaagttccaaatctcatctctattattttctgtttggccctccaggccttggcatagctaatagtatacttgtatgtctcttcgatgtgtcggattattgaccttggtttatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccaaggacaaccatctttttccttaacacaccgaacttcatattgcgaccgattggacttggcaacccaaaactctctatgaagtgacactgcaaaatgttttaccgcctccttcatatcttctgctctactataaatcgctccttgaataacctcattttctttgtactcccatctcacactatccttttcagagacgaccagcccagaaaaatcctcactagcccattctgctggattaatatccgtctcatcatctgacgaatcaccttcctctacacgctcgttgtcagaatcctccctctccatttcatccacaatggcaccacagtctccccctcgtcggccactctacctggttgaatgcccactggagctactacgcccctgtcctctcgtgcgttgacctcctccacagaagtctcatttacttcagcacttggtccctcgccatcatccatgttcatctgcacacctggatccttcgggtgaacaaacagaaccatagctagaggccacccgcgttgcaatgcatttttcacataccatctccacactcgagagttttgaactggtattagttcccaataaaaacccttagttgcccaacttactataacattgattgttatgtcacttgtctgtggatcaactctcaagcccctcattaaccatccttttatagaaggtacactcctctcagccggtctatcaattccccttttctgatacaataaaatctgacagatctaccccagttgacccgtaacggatgtttcctgggccatggtaaacttggaatatttgtttgttcgacatatctgtcaacgaaataactagattatattactctttcatgcaataaacatctacaacgtaatatcttcttgtgtatgccaatgcaacggtaaagtattgattccaaactagcagatctacgtagttaccgatatctgcaatacgcacttctagattagtacaactaaaaccctaaaaatataatgcatttattcaaacaaagttttaaaaaatacacactatttaactcaatagtcacatataggatctatgaatattacctgaaatcggcgtctgaatccggtagggcttcgccccttcttctcttctcctcccctttcttcttttttttcactggatttgagaggggaggaatgagggctgggagctgggcggcaggccttttataggcagcgaggcctgccgcccggccagagggcggcaaggggccgcctgcaaaatgccggccccgactggttttttttgcattcaggccccttgccgccccaacagagggcggcaagggctttcctgcaaaaaaaccctccctccgtcaccgcccgtcccttccccgtttgccacgtcagcttgccgctccaaaggtgggcggcagggtctatttttgcaatttttttggccgatagattacttctgtaaatattttttaaaaaaaatctaaaaatgaaaaaaattcggggcgtcactccaagtcgcttcttttatttgggccgggcagtttctgggctagacccattttactgttttggcccggcccatttagccgccgctactttccagcttccaaggaggccacaccacgcaccgcagctgcagctcatccccacgaccaaatctcgccgtctccgcctcgccgccgccgccgccgccgccaccgccaagagggggggaagcaacccgcagccgccgcgcggcgagatgaacaccgacatcaccgcgtcggtgaagccggagtacccggtggtggaccggaacccgcccttcaccaaggtcgtcggcaatttctccgcgctcgactacctccgcctctccaccatctccgccgtctccgtcaccgtcggctacctctccggtacgtcctccccccacccctctctacgttccacccctgggaggaggaggcctcaattccgcgcgtcctttgcagggatcaagccggggatccgcgggccatcgatggtgacgggagggctcatcggggtcatgggagggttcatgtacgcctaccagaactccgccggccgcctcatgggcttcttccccaacgactccgaggtcgcccgctacaagtacaagctgtagtgagaaactttatcgattcgctgcgttctctctctctctctctgctgctgcaagcgtttacatcttttttttctttttcctgatgatctcgttttagcgtcacttgttgatgtgcgagatgtgtggccttggctgaataaatgttgtacgctgcacgcttgtgaggaattcgtgctacaatttagctccctttgccatggtttagtggcaatttggttgccgatctggtaaaaatttatggaactgaatgtgaccccctgcctgtgaaatttggggattttgttcttaagtgactctggaagtcgtttcaggaactcaggatttgggaggttgatttctttacatgtagtggtagtcttgtggtactggccagatgcggggcaaagtctgcctgccaaatagttcgtagatagttgttgtgagaggggaattataacttgcatcttggagaatcgtaaggaagtaagatgttacgatgagggagcacagtgatagttcttgctaacctaagaatacataaattgctatgccacatttagctaagcggtctctagtggttttgctcttagtttattctctcagatgttatatacactgaaaatattatttgaggcaaggaacactcagcggtgaacagtactgcctcaaattttgccgcaaaaggactaatattagtttttatatatgtaaatctgaaggcatgatacgataattatttgattctgagtaccatgatggcatggttgaactagtttaagacgccatattagactagcaatgccatgctgcatagttgtcttattcattctcttatgtaggttagcaagatatatgagataacatatcagtaatcaggacgcataacttgattcagttgtttgtttttcatactcatctcatcccaatgcttttgataccaaatcacgtgcagtgtttagttcagagaatcggatattggctcctcctatgtctcaaactgcttggctgcctactagaaatgagttgataattgtagcatttaaaaaaaaaatcgaccgctgtcctagctttggtgatattcagtcgtggatttagaattttttttagcctaagcaagcctaatgatagataagaagtacacataaacccatataactacatagaccatttatcataggcataagcaaaaaattacagttgttgagttctaatttacaaggaaaaccgatgtacaaaattatattgatgaaatgatggccgtgtattatcttaaatagaaattatatagggcttgtattatcttaaaaaggaaaaaaaaagatgatgaatgctggacagttaggtcaccttgccttcatattgcagacatatgatgatgtaagtatttgctttgctaatttacgttgctgatccactgatctgacattctgatctccattagaactagttgattaaacatgtcaaattacttgttgttccaaggtttgtcctaagtcaaacatttgtatctttgaccaacaatttctagaaattcatatagttcaacatcataaaattaatgtttttaagatgcaccatgagaaatgtttttataatatacaattcacatgttgttaaactacacgaatttctagaaactgatgatcaaagataaaagtgcttgatttaggacaaagctagaactacaagtaatttgaaatggagggagtacctattattagtacttaactgcacgcggctcaacgcctgaacctatgatgataactaagtactgctcactgcgctgcatgtggcaaagtgacgctaattaagtattactggtcacttgatgcatgcggcggagcccgggcacctgtggcggcctgtccagggtagtcaattcctggctccgcaactggtgatattcctgagctgatgacttgttcagccaccctgcattgtacaagaacatgcagtccagagatgttgattggagagtgtgagttactttttgcttccccatgcttgatcacattaagtagttctttaggaaaagaggacaaacctatgtatggtgccagcttccatcaaaatgttttgttttagaaatgatgtgtgtgttgtaatgttattcttgcttatcatccatatctaaatcgttatgttcttgaaaaatggaaatcagaaacatagtttccaatctgaatcttttgggaaggttctagggactacatattctggttactttaagttggtataatttaataatatagctctttggcgtcctagaaagtatcataatttcatatttagtatggtaaatgaaaaatattggtggaatgaacaaagaattggtcaaacagaggacctcacactgattgtttttggatttgcatgttgcttgacaaatagaagtataatttacccagaatgcctccatctatcttggaagatttggtaaagtacggtgtcacttctatctatgctgaatgcctgtatgtgtgcaacctgagtatatagttgtatgctgtatgcctgtatatgcgcaacctctatgttgttgcagtagaacgtttgagaagtttatctgaaaccaattgttttccttttgctacataattacatgagcttgtgactccgttcttagttaaatgttgcaccattgttagtaattaatctgcaggtaaaaatatgaccaggaagtcttctgaataacaggtgttatgagactaggacgatgacattgaactctggaatttactgcagtaaaccaacgcgtctattagtggatcatcggattcgttccctgtccctcccacagcagtagaggcgtgagatgacatagaacatccgcgctcatccctttgccctcaagaacattgcagaagtagacagtgaacacagatatagggtggggctctctctttattatagatttcatttggagtacaagccagccaatcttagatgtctcgccctgcccttatatatataggggtcttaggaaggaggagatagatcttacctctactccgtttggattagtccaaaaaaaaaagatcttatctccccgggagataatattccgtaacatttgcatctaccaaagttagctgcatagtttttctgtatttgctgatttgcattttgcagtaatttcctcttggcacaaggttttggcttctacattagctttttaattagaggttagctatgcgtttatttcacaagtcagtgcggggggcataatttcaaaacttattgttcagtgtttgagaaatcagcttaatatcaaacaaattgtgttataaaaaattctgcatatgaaatagagccctgttttttttacaaacattaacctctctaagctgcgtaggattgctgaaatccttattatcaacctggtcagggaagaacgcaacgacccacgaaattcgtgggctagtttaggttcacttctggccccgcagagatctttgcggcccataaatattaatggaccgaaagttccggttggaccaaaatacagatggtccaccatgaagacgggctagattaggtccatatatataggtgggccgagaataccgtatgggccaccagttgacctagctagtggacataaaaggatggtttgtaaatttgacttcccgttcaagttcagggctacaatttgggagttttttttcatttttattttttaatattcacagaaatattataccggtgaaaatatttacaaaaatagaaatattaaggtgacgtggcatatggtgccatgtgtgtattttgcgctgaggtcatatgcaattttcgccgcatgcaaaattcgcatgcccgctcagcagcctccaatacctggtcacacaagtcaccctgccaccctccccgagagcggcagggtttatttctgtaaatattttcaccggtataatttttctataaatattaaaaaataaaaatttaaaaatgaaaaaaatctacaatttggcgcatgatatccccgtggattgggctaaaagtagtaaggccgaggaaaaagctaataactggataaataaacaagatgggtaccacgcgcgttgctgcgggagaattgtgtgataatataatatatatatgagttctaaaattttctttcttacctactatacaattttttttcatgttttatatatttttatacctttatcaattatccaaaagttataaatgattgggttgtatggtgtgccttttaggagaaagagatgcaatttgcaagaaccgcatcaatttgcgtcaaaggtcctagatacataactgcccaagatattatcttaccgccttgatgaatcatccaaatactaaaataaattgaggtgatgtgaaaagaagcaatttacacccttgatgaataatccaaaggctaaaaataattaaggtgatgtggtttcatgagagaagagagaattagcattaactatacttagtggggataaactttatagatatataggataattccacttcgattttcttaactagcagccgaatctgactcatttacaatagcagatctctcaacccccaattattaaaaccagtgcaatttgattccctcgactgttttggaatttggaggatagtttcgttgacgtggcggtgttaacatggtattcatccaacatgacattgacatagcgcttatgtgacattagaattaaaaaaatatgagacccatttgtcatgtaaaaaaaagttatgggacccactaacatgtggggcccgcataatcatcttctccttccttcttcctcctccctctctcttccttctctctccttctcacatagctggggctgagcggcggcggcggcaagagatggagcggcagcggcgggtggaaaaggagctaggtggcaaaatcaaacagtgcggcgacgaggaatggttgcgtgccctgagcacaattccgaagggagacggcgcgcggtggaaggcatcggtcatcgaggaagatgggaagcgtgctccacaccgcctctcctcgtcgccgctgctccacgctgccgctcctcttccctgctccccatcgtcggtggaaggtgtcggcggaaaccggtccacaccgctgctcctcgccccctctgctccgtggagccatcctcgtcccagttccgcgctgccgctcctcgtcgttggtggaaggcgtcaacggaggcgccgcgagttaggatgagatggaaggaaacctctgctagaacggccacgtcgtcaacgcgtggaccgagcgcctgatctactcctaactcattccaacaccatagtttggtatgccactactactttgctctctagtgccgccatggcgccattgccaagaatgccaccttactacgtgcttgtgaccagggtttcccttatcgtttggaggggggttatcgcacccctgctataaggcggttactgtggtaaccgctgaaaaccgtgttaatttcggcggcaaacatttgaattaaaaaaaattgatggtttcgcggtttggttgcggttatcacacggtttgacacggtaaccacgatatttgcgcggtaaccgtgagttgtgtagccgaatagaataatgctaaaaaaattgaaaaaccacctaaaagtagaaattagggataattagaagaatatataggatacttgtaaacctaacttttggatgtaaaatacagaaaacgggcatgactttttctatattatggagatattttctcctctattgagccggttgcatggtacaacttaaggcccaatacctttttttattttttttcattttctaaactattattcattttgccctcaaatatgattttattttactctttttcaaaaaaaatcttcaccatctacctttttttttaaaaaaaaacaagaactacattcatgctttttttttggaaatgttgaatttggtcaaaattccataaaaccctattgacggtaaccatcatcgtacccctgcggtaagcacggttatcgtgctaacagcacagttttcgacggtaagggaaaccttgacgacaacctacggccccccaccccccacagccttggctctactcaactcttcatcatggatggcgcttgcatgatccatgaccttcttgcttccatcaatgtcaacgaactaggtcgggcagggagggggggggggttagcggaggctaggggccggaggcggttgctacccgtggcctgtcgacaggaggttcccaagctgtcactgtagacgtacaccatcatcacctccacgtggttgcaactcttcgccctgctggcactggcgagctataaaagttattgcggaggatgattcatgggagaagaaggggagcccgccgcggattaccggagctccttgtcgctgacctcacactgccactgcctcctcccgttgacgggcttaccggccaccaccccagcggtgaactcctggggaagagtaggagatgagaggaagagaagaaatgaagggagggaaagtagaggaggccatttacatgtgaccctcatatggtttttctattttattcttactgactaggatatcatgccggcaaaaccacatacccatagtgttataggagtatgacctaatttgacccggttttaagatttccggtattgacgttacataaagtttgagggacgtgaactagacttatttcttatgtgaatgggctatatcgtttcgtttgtaagccttccggcccatcttctgaccagtcggcacaaaaatgggctggaagcctctttcaaagacgttccctgtcttcgtcggcgacggcggcggacgacgccggcggcgagtaggcttccagcaaataccgcggcctaaaccctagcccactccggcgatgaccaggtctcgccccaccccacccgctcgatgggggcgcccgctggatagaggagcagcggccgaccagccgccagtggcgaagctgtcgccgccaccgattcgcgcgccgcggcactgttcccacctagagaatcgcgctgttcgacctcgtcaaccacgacggcgctgccccggcctcccggtacaccctctccgtggctttcggtgacgagggattaaggtattcgttttcgtagttcttatctgttctacttttttgatagtttgatgcacatttggggttaggatgctgcccaccgcgagtgctgattcaaagctaacttactgaatttaaaatgctttgccgacaccggacggcgcagctgagcaactgcggcgccggttttgagagactgggaatactaaattggagtaaatatcccactacgtgagctgaatgcatagggacgatgggagacttgttgtttattatgtgctaaatcgccgacttaatgacagttcattagctgttggccacattagctttaaaactaggaggcttagctatgattttttgttcacttgttaattttttcaagttatgcgcctttttgtgcatcatataatttagagtaattgaaaagaaatgtggtctggttcgttccttcaattcatcccaagaaaaggtctcgcaaagataaatcgtaatgcgtgtatcttttgcagttgggagtgttctgtccaaaagatttctaatcatcataactagcccaactaatttcccaaatcgcgaaaaatctttcagcacttcataaccatcaactacttgatacaaatgtgcaataatatatgtcctctaaagttaagtcctattgttaacatatgtcgaaaagctttccttctttgcttaaagaaaggtgaaggcatggaatgttttgggagtatcaaacactctctcacatcaccaataatgcaccattaaaaattcgtaccatcaactgttgcccctgtattaggacacccttagacatttgcatcaggaacctgacgtgggtgcagaaaattatattaattgtttagcctgctgttgttgctgtctcagttcaaaatgctaattatcagcaatttgtctacctatatttctactaacaacttgtcaaaagttaaaagtaaagcattactcacaacaattgcattggatcatgcattcaactatggtatcaagttgatgaaggacaaaattatatatgattcaactttctggagctgagtctgacagattgaaaagccataggaaacggctgccagttcgcctgtttgtttgtccagtgattccattttggtgatgtttcatataacccaatcaagcaacattcacgaaaaccacatatgttttgatcttgggaacttgttgaagcaatgatctggttatctgaatctatgtaaagcaaatgcactgagataatgatgcacaccagtagactgatatcctcttacttcttttttccttgacagtataacaatgtacaattgttttctttcagaaaaagatgggagcatgcttttaggttcctgtgatctgctttcttcataaattcagtttatggttcatgttgaagacatcctgatgatgtaaatgagatattagttcactggtgggagggacatcatcgcaagtatttaattgggttttgaaggctgatagaatggaactaagatctggagctcatgcaatgctacaactgtggtaatagatgctctttctggattaatgtaattactatggtgaattggcagatgcacattaatcttgtgagtttatattctactgctgattcagatttattcgcttgtcatttggattgcttggttttctgtgattcgatcttgcaactattaccatccattctgtcaggtgcatgatttgaataactctcctgctagattgaaattaaatttaagagtacgaaatttgccgtttcaacttttgatcggcatggcaagctctcatgcattaggaagggacaacctaataaaaaaaatcaatgtagtgcctcatcagcagcattaatgaagtatgcacattagctgtagctgcaccattggactttgacgagtcaaattgtcatttgtgaactactgtaatcactgttttccttttctaatgaagctgattgagatccaaatgctcgtgatgaaaagcacagcatgggatggtgcgccctgtttaagggcagcatgatgagcagaatccaataggtgaaaagattcggcaccatggtgtccctcgcacgcagcttcagcgaagctgcagccagcccaaatagcaagagtaaacaaatgcagccaagtacacagtataggtacatgtcttatgcatgtgaatttgttattatcaatttaccatgttccaacacctgttactactattaaccatgactggtgattgttggctttataatgatatttatatgacctcaccctgtccagttagaaatatgtctgatttagtcagccccaataagccacagccaaacaatatagtttggtattacccagtatcacagtataagtctatcctcctggcacacgatacaagtccatcgacaaaaccaagaggttatttaaccacttgatttttcttcaggtttttgcacgcacaagatcatacctaacgtacaggtacaaaaatatttttataagagccatctatctgtctgtcagtacctgtttctgctaattattagttcttgcttattttttttctctgtacacaaagccagtgcaaattaaaaagattgtactaattttaaactgggcagcatccaagcagagtgaagctactccacgcaagtgggagtttttcctgtcagcaaactcaaacacattggaattaataattgcatcctattgttccctgttcccttccttgtttttccccccgctgcctcctctcctcatatctgcccattcggttataaaagtagacctggtctcgtcccctctttgcaccaacacagcattcttcctgctccagttctagtcttctagggttagaagtgatgagaggtcaagataagctgtgggtaaacaagctcaatcactatggtgtgggtgtagagatctgatctatatatccaggtaattaattaaactaattacgttaagtttactttcgagccatctgtgatcttggcatgactgctggtttgcagctatggctttcaaaagcttgctgtgtcaatctcctagatctaatggttggcacagcaagtatataacacatattttggtttgttcacctagatctgctttcctttactgttccatgtcaatattgatccttgtggaacatagaatataaggggcagcacagatcttgttaaattacatagtgtgcttgatctgtggtaccagtttgattttttctgatacatgggaatctcatactaaatgccaacgttacttttcctttccaaaaatcttgctggttcaggtattatttacatatcaggtgcacttaacatgcatgtacgcttgatctaccaaagatgtcttcagcaagtttattaccatctatcataaaaaataagtatattacaagatgcaacaaagcaaaggtgccactatactgcatatggaaccttaagtgaagtcacctcactgggggttttagagttggagatgcctccattgtgtgtgatgcatattttccacttcggatggctaataaagtaataataacatagcaaaactatatttgttattgacaatacttgacacttgattgtgctaacatttactagttcttcttgtaggttttgtaaccaggggcaataagctagaggcagcaactgcataacttgcgagaaacttgtaagatttctttacaacctatggaaaagataggtttacttgtcttaattttttgctgttcttgttaactaggaaaccagaagaattattaacaagagagaatttataacaaacaaatttgatgccaattctatccttgactctttttttttctattttttttatctcttgagtcatctagtcatttcactgtttgaaagttgggaacatctgcatcacctaagatatgatcctacctatccctgtggaatgtgttatctgtgtgttcagtttacaggctgtgttactaaaataatgcatgtatttgtgagtagtagtgttctgatgtgatgaccttcaagctagacctccacatttgcgagaactttcaccatcaagacaaaaaaacatgatgaaacaacctatccaatacatataaagcgccataggatgaactcactcataccaaactggcactctcatggtatggtatgacatgtggaaatgggtatacgcatgagatctcccggaactgaattcactttgatataataacaccttggcatgtaatagcattagtaaatgacgtccaaggaatattagagtaatcatagcgttaatactgtaaaaggaacatattacttgtactagtccttgattgacattcagggtctgtttagttcccacaccacaccctgtcacatcgaacgtttgaacacctgcatgaagtattaaatataggctaaaaaaataactaattgcacagattgcgactaattttgagatgaatcttttaagcctaagtgctccatgatttgacaatgcgggattaattaggcttaataaattcgtctcgcggtttactaacggattttgtaattagtttttttattagtgcccaaacaccccatgcgacaccctatataatatccgatatgacacgctaaaactttacacctctagatctaaacaccccctcaatacgtactgaaacagctaccggaatccagaagtaaaactttttcacctgagtatcacataagctcagccatttcgctatggtactctaaggtctaaacatggcaaatagtctaagtctgtaacaattattatagatatcagtacaaacaacttaatggtgaggagacagttatatcatgattttcatgctgattattattcctatatatgatgtgcttccttcaggttggatgatgatcttgccaatgattttgccccaagttatgcagttgctgcctcaagcttactgcctttgtttgctaaaccatgaaaccagcacaacaataagagactccaattgcaagagaccttccaggaaatctttagtaggcatcatatgttcaatacaaatatacctgaggttgttagagcaaattatctgctcatgtacgattacactatctctattatcagaaaatcacaagaacttttgttgctgggttttgcattagtacaagtatctggctcctgatttttcttgacgtttatcattttccattctgagctatacgagcaataggctccggattgtagtgatctcctgtgcaagttttacctcttcggcaaaaaataattgtcggcctacggggcaaactattctgtcccctctaactaataatgtctttgaacattttgatcatataccctcccattttatcaaaaattgaggatttattcttctgtcactgacatgtagggtttatctgagggcattgacatgcggaccatgagggtaaatcctcaattttaatctaatgggagggcatatgatcaagatccacattaaggaccagctatttaaaatacggaaattaaattcttaaaaaaatagtaa

SEQ ID NO: 8957 - DNA, 7950 bp, Oryza sativa
ccaacgcatcattcgttggccattttcttgtgcatttgcctatacacagtttggttttaatctagccttattcagatttatgtgaatggaagtcctctacgttatagtgttcatggctgtgtggttaacacttaacagtctataggattgtttaattcatggtaaaacctggttcgatggaaaaatagccaaattattttcccggtccttgaaagaggtaccgagagtgttgtgctgaatggatgaataactgtatagtttgtgataataattcgaatgtacaaacgaactaagggtgcgttcgttggattgggtgagaaagccccatcgtattccgcgcgcacgcttcccaaactattaaacggtgtattttttataaaaattttctataagaaagttgctttaaaaaattatattaatctatttttaaaatttaaaatagttaatactcaattaatcatgcgctaatggctcacctcgttttgcgtatcttcccaatcttctcaaactccttctcctcaaactcaccctaactatatattataaagttgaaatataaatttgaaatgtttttttaagaaatttatatatataaagtttttatgaaaattatgaaccatggcagtttgaccaaaccatcgtcaacccgacaaataagccttcctagatttttattgagaatctcactatcgcattagccactgataaatctataaaggaaagggaaaaaaaagactttgttagagcatccattgcttgaactcctctctctcaaatatggagtagttacttaggactattttttagtaactatagtaatatgagtgagttgtaacttgggtcaatttttattaccaaagtttaggaaaatatataatataaaccatatatgtagtgtaaatctgaaaactaccatgggatcgagaaatagacgtatgatatttgtccatgtcacctggagtaaaatttttactcttataattaaccagattactgagagtaaaaaaaatatcaggcttctacttctcaatcttacagtagttttacactagatatgtaatttgcaccatatattttctcccaaagttttattttggatcatcatttacattttttttaccttttttaggttgaatgctacaaggcatttgccccgtactgtttttttttccctttagcctaggttttttttttttcaatttggaacactccgatcactctcctttagcacaccaacgacatcaagcacatcgccaccacgcatcagcgaactctcctacgaccaagccatactttcctggagaagacgatatggatggttaaggaatagagtcagggtagtaaaataaatatagagttggccaaaagttactttaacagtgaaagatgccccaaaaatgcaattcactctagtaatattttgacaactacaacaaaaagtgtctttgaataattatccaatccaaaaaatgtgttttgagctaaactaggcacgaacttaaaatatcaacaagtccgaatcaaccatataatcttagaagaaaaagaggtccaaaccttaacccacttgtcaaggaggaaatcaactgctgccacatgagcttagttgtaagtatgaagtagccaaactagatgccgacttcaacttttcactagtcaaattatactggcatttatttatatactccaaaaaaggttcaaagaatcaaagtagagcaaattatctatctatatgtctggtcagtgctgaatgttcaaaccagtatcaacttgttaaatttaataatctaaacgagcagagagtgcaaagaatataagatatttttaaaaaactatgaaaattatgaaagaaagccatggtataaactatcggtggctaaaagcatgtgaactttggcggcgagctgcatctgtgctggcacaaactgttttattctgcactagtaacgtagtttttaacacccatctgattaaaaatcgacaaaatgagtagctacctactttgtttaaaggtgtgtaattgaatattagcacataatttagatgggggaatatgtcttgggatgtgtgaagagaggcagtgtcttaacattgccaatatgttattagcaataatgcatcattaagaattggctacattagaagattccggtagtaaagcgtatccagcagacacacatccgcatgtagagtatcagacaccatacctcacgtggctgctgaggaaaaggctaattattggcctaaatgccgcgattggggtgcgtttacactagcataattttattacctcgacggttagtaagatcttattacctcgacggttattgaattggaaagaagtccatttcacccttggcttttccttgtcgactgacgatggcaacacatcaaattatccgtctaccagagcatcctaaaatttaactcataaaattcttggattgggaccatcccaaaagaaattgggcccaaaaatcactttctactacaagagtgcccataaatttggttttcaataactttaaaatatgccacatcatctcaagtagatcctgcttcaaccgtttatgtctttccatttttccggtaagagggagattggcgctgggaattgccaaccaatcacgcactagcggctcagctatgctgtgcagtagggtgatctttcgcgtgcctagcagctacggcagcccacggcgagggcgtcggcaagtctgcaaggcacatcgaggaggcaggtagggccactccagggttcatccatctcgtcataacgcgtgacaagggaagaaaaggcgtgagcggcaaaaacctcccgtgatttcatcaattgggagtgcgtggaggtgtccaaaattggttcagattgattctagttttaggtgtaggtaaatagtgggaccatctttgggcatctcttggagagatggttttagactggattcctaaaatttatcttttagactagattcctaaaagagtatctccattttttaggcgtgtcacatcaggtattatatagggtgtcgcatggggtgttcggcattaataaaataataattacagaatccgttagtaaaccgcgagacgaatttattcagcctaattaatccgtaattagcaaatgtttactgtaacgccacattgtcgaatcatggagcaattaggcttaaaagatttgtcttgcaaagtagtcgcaatatgtgcaattagttattttttagcctatatttaatacttcatgcatgtgttcaaacgttagatgtgacagggtgaaaaatttttgggtgggatctaaacagggccttaaacacaatcctaagtccccaaacaattctgaggggttaaagctaaaaacaagttatagcaaacacctacaatgagagcaaaattaaaaagtcctccgtcggtatccctgcaccaccggtccttctctagctagctatttctacaccatccaccctccccaccctctcaaacctctaccacaccttgcaaactccaataccactgtttgtgcagaccttagcggatgaagagtgcaacaatgccatcttcggctgcctcccgagctaagcacctccaccattctctctgtcctccttcatgtcccttgcaccgattaggctgtgttgcgccgtaggccctagtttaaggcagggttgaaatagaatagaacaaaatagttctaataaatgagagtagtgctgaagtttgaggcattattccttaggaaattggataacccctatttagtttttaggagctctaaactatgggctattgctagggatgttctaatatggttggaaatctttataagggttggaagtgttccaaatactttttcctcatggcatgcttttgggtcgcaatctcttgttacgaaccttcggcactcggtgctcgagctattgcttagctgcagtaagcaaacacaactgctctttactttgtagatacatgtgcttgcctgtagcgatgacgtggcgagaattacagacaccagtgaggaagaacaacgactatgtttgcttgaggggttgaagttgacctaatagtttaaactcaatatcgatccaaagtgtaacagaatacaaagatttatgatattgagtgaaaatattgagcttgatctaatgtacttttaaactttgagcaaagtgatagtgggcatgttcgacttagattgctctagtagcagtggttgctgtaaaacacgtatgctgctatcgtgcagctgtaatcaagtggtaccgaacaatagtctaatgtaaagttttactccataatataataatgtatttattgataccgtcatttttttctatttagactaaattgtactcacgatacaccaacttaacatgtggatgcaaatttagttattttgagcatctttttatatacatttagtttgtaagtgtttattttgtcaatgtacttgtacaaatatgtaaaagtatatatttttttcaatctaatcactaaaagtcaattaaattttactatgtaaaaaatgtatatctcagataagatttgagaaggtttttaaaaaaatcctgaccgctggtgtaaattgaatgaggaacgcaattcttatatgttaaatccaagattttaaagtaatattcgcacgattgctatatgatatcatattggcatcgtaagaaaaactcatctagcacccgtggactaaaatagcacatattgagctaagttattgtatcaaaatactagtttgataagttcttatactagaacgcatccacattaccaggttgtttcccttcgacgttcaattctcaagttcttaactaaattgttgcatcattttttaaagagtaaattatatgttgggttcttacctaagtttcaccatgaaccaggtgtcagcacacattttcatttaggactagtcattattaccaaaactttcaatttgaactagaggaccacctgccatcaagacaagttgtctcgaggaggaggaggagaggagaggagattgagataacttggaagtgatttattaacgtgaatataatttactcttttattccagtgatcgaggctatgctttcataacttatcttctcattttttacgtgcatgctttccaaactactgaacgacgtgtttttgcaaaagttttttaatacgaaagttgctttaaaaatcatattaactcatttttttaataatttaaactaatattatattagttatacggtaacgagtgtttcgtcgtatgtgctggacatcccgaacacagcctatgagagttgctagcttgctatacgctctctggtctatgctgctctgcctgtcttgctcgtcctctgccgcggagacacttgctccctctgttctgattttgacatcttgcttgtaatattttaccactcgtcttattttaaataaatatataaatataaaaaacgaaaagttatgcttaaagtacttttaataataaagtaagtaaaaaataattctaaatttttttaataagacgagtggtcaaacagtaaaatgtcaaaatccctaataacttatactttctctgttttatattataagcctttatagcattacccacgttcatatatatatgttaatgaatctaaacatatatgcgtacctagattcattaatatatatatatacatatacatatatatatacatatatatatacatatacatatatatatatatatacatatatatatatatatgtatatatatacatatgtatatatatatatatatatatatgtatatgtatatatatatgtatatatatatgtatatgtatatgtgagaatgtgaaggatgctgggaagttttataacctgaaacggaggtagtattagtgacggagggagcataatagataaactcgttgtcgtcgtcccgtgcggtgcggcccccgctacccgccgcgcgatgccccctcttctccgcccgcctgatctagggttttactggagccgccgcgcgcagcgaccagccgaccacggacgaggacgaggggatcaggtgagcccgccgccactctctcccccacccctccgaacccgttcaattcagctccccgcggatgtgatcttggttaggggctagggttgggtcggttaacgaagatcggttccgcgtctcatcgtggcgtgtgtcttcgcgtgtgtgtgttgggttggggggagtccgcgcatgcgttgtgtgggtttttttttttcaatgctggatgcgattgaaattgagcagaatgcccagtttactcattcagaccgaatgagcttcatttactcattcatctagtgttggtgttggaagttttgaagacctgagtatgcggtggctatataatgtttttgttgcagatcagttagctttgctggttggacaaatcgagtcctagatatcttggatttttcttttttccatagcagaaggttgtgggtaaaggtggtgcaagacaacatggaatataaaaggccattgtattcatgctggctgaataaatactagtttctcgcacacattatccaatggactctgttttttcattgtgcataggcgaagggggttatgttgtttaaataaagcattagggcaccattatatttccatatgcacggactatttctcattatatattctataattgacactgaaccagtagggtctgaaaaggtcatataagcttagctgtgagtagctcagatattcttttcctatttattttggctgaacaaatttaacaattttagctaatattcgtttcaatatatcttagatgcaaaaaaaagatatgccttgatgcaaaatttagtcgcttttgcttgcatcgtgtagatttattgctattgtgcccctatgctctggcctccaggcttactcacgacaggtgatggaactaccaacatctgtagctttccacccatgcagtcttgtgccaggctggttgcatgctttagctgttttgcatgtgtcgtctgtcctatttttgttttcttgatgtcagttgaccaatggaaaatcttatgagtataggattaaacaatggtctaaaagtcggtgctaggtactgggtagccactgtaatttggtgcttccctgccttgggggctctatattgctatgtaatgttatattgtcttctttcatgtcatatgcttcccaactgcttgaaactccatagtcaagtttgttctaggctgtaggcaccgcctagttgacatctaggtgctaggtgccagccttgctgaccctctagcgcctagcggcttcttgaaccaatagtattaaagtgaataagtgttttagcatttgttttggaagatatagctttactacggggtatgaataccattatcccaaagagttgattgcatttttcaaatttttttagatgattgatccgtaattttcctggttgatcatgatattctttacattgcacatgccatgatatagatttgaatgttcccaaccaattagttaattgcactgccatcctgtcctatgagaagttgaaaatactggctgtatatgactaataagcacttgattgagttcttccctctgttatttcctttggtatgtcttagaggtagatctatagggtgcttttatgctattctcatatcaccaaaccaaaaattctgcgcattcttactggataacactaaacagataacatgtcaaccacttttgcagagaaaattatgtctgtgacacgagcaagcattaaaagtatcacatgtacttttgctgtagttgatatatgacggaactaaccttttaattgttctgattagatatgcaattgggggcagcaagctagaggtggcaactgcataatttgcaagaaattgtaagttctcttggaaaagtctgaaatgacatgtattcataattttattgatcctttagttctttctag

SEQ ID NO: 8958 - DNA, 1199 bp, Oryza sativa
actatttttcttgttcattcttgttgacgtacatggttctagttgctgtagctatataataacttagctgttggtaaaataatgttcttgtgacttgtgagaggtgattattcaatggcagccttgattccaggatctgttacgaacaccaaattttgagctaagcgcataagcaacttttctcgtatttaaactgcacttgaaagaggaacccttttaagttaatactcccccggtcaaaagtatttgtcgtttaggacaagatttggtcaaaattttaaaattccaacaaccaattttatgttagaataaatgtataaaatctaataagtttatgatattacaatagtacttttcgaggcaaatttatgtatataatttcttttatttttaaactaagcatttaagaaaccaatgatggttggaattttcaaagtttgatcaaatcttggtctaaacaacaaatattttgaccagaggtagtattaacgttaaaaaattaatatgaagtagcttcatggtacttggaaacagaatatagaatgtaagttctatatgttttctatagggactatctatatttatggcaccatatgaaaaaaatagttaaatgttttagcatgtactatttacaccgtaaattccatatcttggtccatatatttacactgtaaattacaacttacactgtaacttaaaacttacacagtaattttctctaatacttacatatatacaataactagaaagtactagtgcaaacttacattaaaaggtgatggatccaaaacaagtagcaaaagggcaccaatttcaatcatccagatgcatggtgaacctaagctgcatgtgaacctaatcatattggcatgaacgtccagatgcatggtgccataggctcaaggcaaaaacgagcggtagaactacgactgaaaacagaccaaaacagaaatatagcaaaatcgttttctatatatttattctccatatgtaagatcattgggggtgccaagttacccactatcccaattccgcatccttggtcacgtgggtggctcatttgtgaacttctaatgtatcactggatattattctgctgtttagcattttagatcatcggcaatttccttatattccaagcagcttcattgcatttcaaaagtaaccacatgcatctaccaagttcaaatcaatacaag

SEQ ID NO: 8959 - DNA, 1099 bp, Oryza sativa
gtccgcacatcctcaaatacaaagcacttccctagttagatgtaggttacacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgcggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaat

SEQ ID NO: 8960 - DNA, 29889 bp, Oryza sativa
  unsure (1)..(29889): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgggttcttggtctctgcccgaggcatcgaagccaaccccgagaagatacgagctatagagcgaatgcgcccccccagcaagcttagggatgtgcaatgcgtcgccggttgcatggccgccctaagtcggttcatatcgaggctgggggagaaggcgctacccttatttaagctcctcaaacgctccgggccgtttacttggacggaggaagctgagcgtgccctcactcagttgaaggcgtatctcagctctccccggttctggtcgccccggagccaaatgaacccttactactctacttagcggcgaccccgcaagtggttagtgcggcgttggtcgtggagcgcgatgaggacaaacctcattccgcgcacccccaccttgtgcagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggtctaaggctcctgacgaccggagttggccctttgcccgcttgtccgacgatgccaggagcccccgacccccaggacggccccgaagccactgtgggaaggccgcccctgttatcctccgaccccgaagtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtaatgcagttcgacggctccttgtctcttcagggcgccggtgcgggggtcacgttgacctctccgagtggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagtgccattttgacgggattgagcttcggcatgtgcccagacgggataacatgatggccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcagggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcaccaatgtgggagagtccgtatcgagtggtcggcgtcccccggccgggctccatacggctggccacgggcgacggcactgagctgcctaacccgtggataaccttcgtcgcttctacccctgagggggggtcgggtgtcaggtttcgggctcgggccaaccccgcaccccctcgggcgtgcagggttggccgggggctgccacacatgcacattcttatttctcttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcatgaacccttaatcaagctaagacacaaaaggaccacggcacagatcatcctcatcttatacacacagcaagatgaaattgacacaaaaatttcttcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgtcgtctgcaccaccggcattgccctcctcgtcggagttgggggcgaacgcgagccgaggggccgagccctcgaagctgtcgacgatatggtcggcggcatcccggacctgcgcgcgcgcgtggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccctgtagatcggcgatggtgtgttcggcagctgcgaggcgggcggctaagtcactttcgcccgcggccgccccgccgctgcgcgccctcgcgtccagctccttcgcccgcgcctcgagctcagcggcccgttggttcagtgcggccctctcggcgcgggcaccttctagattacggcgcgcctgctccttctgcgctgcctcgcggagggacaggctgtccgccagctgttgcgccgcggcctcggccccctcgagagctcgctcccgctcggtgagcgcgtcctcgcggaggcggagcgcgagctcttcttcagcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatgacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacatgcgcccacgcggcatcgagctccgcccgctctgcctgcagggcctccacctgggcacttaacccatccaacaccgtggtgtttgcggcggccaaggcctgcagaaggggctctgcgttcagtggggcgatagaaggcgtggggaagagccgccttggagaggatgccatgcggctcgggccaccgatggaagtgccggactcggggatgtcccccggacccggttggtcctgagcgtcgcccgagggagtgggcccaagcgacgcgcccgcagcctcgtcgccagctgccccggaagctgtcgcctgagcgtcgcccgagggagtgggcccaagcgacgcgcccgcggcctcgtcgcgagctgcctcggaagtcgccaacgcctcgtcctggcgaaatccggctttctcccgagcggcttcctcggcctggcgggctcgggcggcctcctcccgaacggcttcctcggcctggcgggcccgggcggcctcctcccgaacggcttcctcggcctggcgggcccgggcggcctcctcccgagcggtttcctcggcctggcgagcccgggcggcctcctgggcggcctcctcggcttcccgtaggcgatccgcggcctctcgccggtcagattcccgcctccgggcctctgcggccgccggatcctcggcctcagactggccgggcttggaatggcgggagggacgcgacgggatctcgctgaaacaaaagaaaagaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttgcggaaccgcttcttcttgcgctccccctcgggctgcgatgtcggcacggccccctccggccgcctgctgctggcgcgcaccgccccgccccctcggggaggagatgggggaggtgttcctccctgcttcctcttcccccgggcgtcggcagggcggctgctccccgggcccctgtcgcgggacccagaagtacgaccccctcccggggtagattgttcccccctgcggctcccgcctgcgtcgtcgtggccctttggagctcgctcctctgaggccccgaccgccatcataatggttaggatggaggcgcagtctggatcgctgcagagggggaggattccttggggaatgagggacgcctccacggagttgagattcagcacccgttggaccaatatcttgaagtcctcaggagcctagtcccatctcactccctggtgggtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcaaggggggtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggtgccgggcgtccctcgcccagcgtgactatctcccggccggtggcagattccggcatgaagcggcgcggcagcccagcctgcctctcgctcacgatgcgggaaggcggcagcacgctaccatcgagcagagcggagccccgtgccatggccccggaggaagagaagattaagagcgagcgcgtgtggtgaaggtagggcacaggaaagaaggagttagggcgcaagcgacgaagacaaggggaataatggcgaaaggaaggaaacagatcccttcctcagtgcctttatactcttaccaacgctgtgcccggctcctcgcttctcgcgcccactatttcgccccctcgtttctcgcgcccacgcttccactaatcccattcgcccgcttgcggagcatgaggtggacatgcggttgtggcagtcgagatagatcatatcgtgcgcgcgttaattacgctcgccgaccgaagcgacgttaccatatctccaaacgaaacgaatcgccatgtccagattcgtgtgctactcgagtaatgtggcagtcttgaagagaccgctcattattgacagccgagttaccactgccgatgtgcgtgatttgtgaccgttgggtttctgcccaatcgtggagaccggtcccacctgtcaccaggccttaggagtggcgtcacgcccgaccgcttcccttaaagagggcgatcgccctggcataacgccgggggctactgtcggtgacatgggaccgggagtatcatgactagaggcttgaggcagacacaatcgcccatgtggcctggcaccgtcagggggcgtcgggcccgagggtgatgtgttcgccctcctctttaccgggagtatcatgacttagagacttgaggcagacacgatcacccacgtggcctaactccctcgggggggggtcgggcccgagggtgatacggccgcccttctctttgtctccccaaggggttgggccgctcccgtctcggccccgagggccgaagcgccccgaccccttgtgggttttgcgccacgtatatggggtaggtgagcatggcggggctcacctaaccacatttattgcagttttgacgagcgcgtcacgccgcatgtatcgcagtacagcacgctcgtttatccggtctgtgaccagtcacagaccggtcagatcatgggttaggtggcgacaggcggtctgacgcacgcctcgccccatcccgtcaggacgagagcctccaagcactcgtccctagctggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccagtctgacaatggtcaagtcatcagcagacagccatcttcccacgtcgcgcctgcctccggcggaagtggaggtaggtatgggccgtcccgtcagaaggtcattcggacggcgacgatgcaaatctccgtctgttaatgaagagaagtcaaattggaagaaagagagggggagatggtgcatgtggtatccccttaagatataaaaggaggaccttgcccacttagagaggggattttggatttttccagattgggaacccagaacgagggagaggctggctcatactttgtagttccttcatacacgaatccaccaaaacacaggagtagggtattacgcttctcagcggcccgaacctgtatacatcgccggcgttttgtgtgcttcctgtctcgcgaaccttccacagattgggagcttagagtctcacccagggtccccggccgaaccggcaaaggggggccagtgcggtctcccggtgaggagccccacgctccgtcaatagtaataataggcttgaaccttgattctataatccaactattgaatgattcactcatgttgttgtcaactgattcacaatttgatccaagtctgaaccaagctcgagaccaatgaataggatttgttttctccaaatcctgccatccacgaggagtttttgcagcaagctttctcttgtaatggttaaacaactgctcattaggtgcttttgcaatcttccaaaacctcttttggtactcctgcagcctatgtttctttctccagttggcatatatgtggcgtgcacacatcctatgctcagcaaatggaaacaatgtagatactatgcttagcagcccctgcataaaatggacacaaatgatttaaccattttattttaatgattaaaaaagcctctacataaaatggacaaaaatagatagaaatttaccttctgttggtctgttataaacacccagcctgctgctccaacaggtatgttgatgtctttctgaagatgcccaagaaaccaattccacgagtctttattctcatattccacaacagcccatgcaattggataaagctgattatttgcatccctgccaatagctgataacaactcacctttcaatggccccttaaggaaacatccatcaagcccaattatcctcctacatccttctaaaaatcctcttctacatgcatcaaaacatacataaaacctctgaaacacatggtcctcttcctctgggtcaagggcaacatgcacactagttccaggattactacgctgcaactccagagcatagtcaaacagcttggaatactcaccagtctgagtatccattattttcttcattacatgtgcctttgctctcttaatcattgtgattggcacatccactcccatgtcctcttgtactgtctccttcatttctctagccttccaagatggattagccttgatagtactctcatacctatcacatatccttcttgtagataaccttttatttttaagctcaggacaacaagcatggttgggattataagttacaatctgaaaccaatcactccttgagttatgggaagcatatagaagccaaggacaacctttccacctacaaacagccctaatccttttctgctcattcttcacatatctgatatttatcttcttcttcagagcatacctctctatagcatccttcaattggtcctttcctctaaagcacatgtcaactgcaaactgtggagtatcagcgaaactgtcaaatattgggaacctgcacttccttcttgtaaagacaccatcactgtcctcatcgtacgatgcatcaccatctgaatcaaagtattcagcaccatctccaccttctaagacttgattattacccaatggaatatctccaccttgtatgccatcaacctcaattggattgtctattggaatatctcctctcttctttacttctgacataaactctttgtatttggttcttatctctctaacttcatcatcttcatcacttgtgaaacctgtagcatcacagccatcactctctgcttctaaatcttctgctgcttcttcattcggactatcctgaccatgggttggaccttccaaacacagcatgttatcgccctgaacaaatttgtccctattttggacagtttgttccttgacaataggttctgcatgatccaaatccatgatattatcatcttgaaatagggcaaatacattctcatctgcatactgtgttccagattcttcattcccacccatatcaactgattcggtgtatctactgttgtagcagttcccagctcatgaatcatgtccaaacatgacttgtcatctacaagtaacctcataccactattcaattctgcaccaaatggcaaccagtacatcctaacagattgaggaaaagttgtgtgatccaataggtggccttcaagttcagggatagagatcttgtccttctctatgtgggacactccacaatccccattgcaatacgacatctttgactcatcaagaacaaattccccattaaaatgaaattgaacttccagtacctcaaattcagacattgcttcgtggccctatagatcaactatatggtcaaatttaaacattctacaaggaaatcaaactcaagtgcaaaactagtgaagtgccactcatcttacctttgcagcacgtcctctcctcttcctgtgtcttggttgcctatgagcagtccgtctgcccaaggacaagggcacgcctccaccaggagaaggggtgcgcctccaccccttcgaacacgccgtcgtcctgtactgatctccgccccagcccccaagccaaaaccctaacctacctatatagttgccatgacgaacagagaagacgaggatgagagggaggcaacggggagcctgaaacgccatcagccatccaacatgtaaagaattgagcgaggggcaggacggacatttcgcatgtctagctggccacgtggcgtgctatcaaggggaactgacgagattgagttcgaaatcaattgttgaaggacgaaattggacaatttgatagttcagggaccaaactgagcctcgggcgatagtttagggacgaaaatggctattttgccatacaaatcaatgtcgcatttggtgttcgactgttcgtttctacaaagaatgaagttatggcatagaaagaggaaagaaataaccattaaagcataaaattaattaaattttaattattataaaacccaaaaaaattatctgatatttcatagcagtttttatatagaaagtttttacacaaaatgcacccttcaacattttaaaaagtgagttaacgaaaacctaagaaaaacgtattattatcttagagatgaatcatcgcccaaaggggctgttttcttaaccaggtaaatttcccccctcaatcctcatcactgtctaattaacctcattatcatttcatttcacaacttcttttgggaggacggtattctattcagacggatgagctatatcgactgtctcagaggtatcatcccgttcgaatagagtatcagccgatatctaccaggttatcaggtatcagataatacatgtgaggtatcattccgtccgaacggaataccattaagtagcattttctttttttttcctccttgggttttctcccaatctccctgcagacgcatgtccattattagtccatcgttatcaacaacctgaacctgctactgcaatgctttgtggcgagaggaagaaggaaattaaaaaaaaaatctgagggggggatcaggatcagtggcctaggagtccggaccccgaacaggtggctccggcgacgccaacccaacaacccaactgggccacaaatactcccccctactctcctcgccgcacgcacgcccacccgctgcatccacacggcccaccgagccacaccaccgccgccgcggccgcgaggccaccacactccgacgacggcgagagagagagagagagagagagagagagagagagagagagagggagaggcagccatggaggcggcggtgcccagccgtgtggcgctctccgcgagccggctctccaaccaccaccaccacgcggtgggaggtaaccccccctctcctctctgtctatttgttctagtagctggataaggatgatgggggcaagttagttcttcgctacaagtatgggagatattagtttggcactgccactgacccgaaataggcgtaattgggctcttagggttgctcctgttggaaattgcccgaaaattcggtcggtttggaaattgttgggtgggttggcacttggctggaggcctggaaggaaggggggccttggcgtgtgtgtccttggcaattaattggttcttggtagtggcaattgacgaaatcagttagtaaatgttgacatcgttctgctcaccaataggctgtgcctgttaattcttgcaacatatgctgtggccatgaccaaagttacttcctgcctaattggttatatatgtttttttggttgctcttattttccatgggagatcatcctatcctttcaaattaccctccttagaattatgtgcaagaaatttgatgattttaattagattgaaggtgtgtttgctatgtcattttggtcggtggttgctgttgcaggattgtttgttcatcttttctgtacatgttgtgcaggagaaagatatgcgatttacaggggaaggtgcccgaatcctgccattcctatggctctggcagcagcagctgcaccagggaaaggtggtggcgtgcttgatcggccaatagagaaagttactcctggtcgccagtctgaattcgatgttaggtaacaatgtgctatttacagttcatttgttttctctatcttgtgtaaagtacagattctctaggattctgaaaagaaatggtacgatgtgaactaaaatttcatactaggctctgaggtctgagcttgtgaacttaccccagataatgatggaaagttgtaattacagaattttcattaagtgctaccaaacggatttcaagattttcattatgactcaaatatttggaccaaaccactataaaagtcatctagccaaattccagtttgttaggacaacagtaaaagggagagccctcctgcaaaataaagccaatttcttcctaggcatagtggaattgcacatgtacaaaaatattcaggagtcataggatcccgcttgactgaaactgaactactgaagtgttttctagccatgtctgtttcgcaattttcagtttgcatcttttcagaaacaccctcttgctcttatcagagttatgtcaagtagggcatgccatcaaaatcaactgctagtgtgggaacataatcgttcctttaaatggtgtcagaaccatctctgcatattttctcctagtaggggatatactgatatgtccgttgattgccttttttgggaggaagggttaaataaaattgaattggatgaataagtagcttcttgatccaaaggttgttatcattgtgctaatgtgatctgatggtttaaaattgttgatgtggcttcttgcatgtcttgctttataagagtaaatgccccttagtgggtaccaaatatataggaagataggattacctttgttgctacgcattttacatttactatctttttcaggcataaacaaagttgattgttgcagcacattatgaaccaattctatattcagattagctcgtttagatgttcttttcttttaaaggtggtttagatgttctattgtcatcattgcttgattttccttaaacatgtttgatttttattatgtgttgtacacaagtaccattacaatgatttgtttgccaatgctttaatctgtttgaaaccatagtgacatgtcttgagttttactttcaatgattactggacccgctgtctagtttctgaattaagtggcttctgatacattgatcattttatccttgtgagcatatgtcatgtagctgatgttctgtagtctgaccagaccagcagattggctaaagacatagttgctattcttgaatattgctcattgtgccttagcaagacatgtgtccctacacaaaagcattgccttgttgaaaggctacatggaatttctatcggttttcagacggactgagtaatattttttcacatcggatgtcttgtacctgttgaaatagtttttgttggtcaatactgatataacacaattcccctgatctgcagaaaatcccgcaaaatgacgcctccgtatcgagtcctcctccacaacgacaactacaacaggcgtgagtacgtcgtccaagtcctgatgaaagttatccccgggatgaccgtcgacaatgccgtcaacatcatgcaggaggctcatgtaaacgggctgtcagtggtgatcatctgctctcagtcggaggcagaggagcactgcacgtcgctcaggggcaatggcctccggagctcgattgaacctgcgagtggtggctgctgaagaagaggctctgctgtttcgatgcttatagcttgtagatagcccccatcaaatctagataaaccgcaacgaattaattacagtaaaaaaaaattgctgtcatgcatcaggatgaacacggtataccgcttttgaagatgtaaatcatgtaagtcacgtagactaaacgtagcatttttcagtatgaaacattggtcacatacttgtacatttggagctttatcacagctagcatcttgcaattgtttgaggtagtaaactgctacttctagctaattggtttttgtgttcctctatgttgcttgtgagataccgtgcatagtccagtgattaacaataggaatgcctaagaaaaaggtgttacataagtggtatgaatatgatgcttttgtttagagacttttgtgatggtacatgtgttgctcggcttctaaacaggtatgacgtgctactactgctaccccgtctgtcgctgcttttgtgtacaagctttctgaagctacaggcgcagaggtgacgcctgctgagcagcttctcatgaggacagtacggtgacttgcgagtgcttcatacttccacgtcatatttgacctgccagctcaacaaggggtacatgtggcctatgagcactcaatcaaagtgactctcgggagcttaaaattcgaagaaataacttccgagaagattttactcggcatatgcacagagaatttggaaaagctgggtttcccagcttctggcttctagtttattttctatattctacaactacagtttctcagaatctggatcaaaagctgaattgtttggaggagcttctaatcctaggagaagctacagcagctagaagcttcccctaaacatacccaaagagtagttttcacgcggtatatttgttttatgagcgctcgtagtaggatattattagagttatggcctatattaactataccaagtagtgaaaattcctacaatgtataaatatccctaggaattattatggggcccaccgatatagataaaatatattaactatataaacacaacactatgatcggtggagcccacctgttagattctatcttctatctgataggtgggctccatatttttttaataaaaagcactgattggactgccacgtaggatctgaaccactatgaatcgagtcagggggttatttgtccgatttaaatagttgagaatgtaaaatatatagtatttgagagggggggtaattcagtcgaccgagatagtatgacagtactatctttttagggtctactcaaactactcgcatagagaaagataccataatatgataatttttttattgcaaatgctcttaatattgcaggctgatccaacaaagtgaaatatgcggcacaattaaaaaccttgttagatctataggctgatcaagtttttacataccatatcctatcttactatacatttgatgtccactgactcctaaaacttaacatgcaagtgtgtcatatcaacatgcaattcagattctgggtagatttggttaagaaaattaatcaattaaagtaagtttatctaaaagaaaccgagttcaaggagaatgcggtatgggggtttatttattaattagtaaatgtctattagtttcctttaattgttaggaaaatgtgtttagtgtccgataaggcttttatgtttttctttttatctttaagaaaatttgtgtcatgtcccataaggactcttatctacccatgggtataaatatgtacacccagggttgctggatttatctcacatatcaatacaactactcttggcgcatcgctaccctcttttttgaggttttctttaccaaccggcagaatttggcaccttgcacacggggctgcattggctttcgatcttcggcgaaggggtaagtcctacgtccgtcagctttagtaattgtatcggctacattggcgttgttcaagactacatcgcttcgacctcttgtatcgctatggtttggttgatatatttgcctacctgtttatcatatatcttagttaatccaagtcgattattcaatttacttgtatccgtcagatcttttctagggttttgccagtatcagctaaattattttgttgatctagattagctaaggtatccaccaccttgaaaatcaatcaaaggcttgattgtcaagatattatatttctttttatacttagtgttgtatcaattgggtttgacctactaagtcgtgcttagaaccatagtctctagactactttttgattaccaataagggtttcatcggggtttcagccaatgagttatctggatgttgcatcaacttataaggattacatacaaattggttttagccaatcgcaataaaggtttcactgattatctattcgtttggatttaacaacatcaaacttccagccgatatatgctttaacctttggatcaatgcttattgtatcataccattattagccgattggtttatgttggattatattattgttttattacattatcatcagccgattgtctttatgccattatttactcaagtgtctgcaacttttactctgtgcatatgccgagtaaaatcctctctgaagtcggatttccatttactaaggttgatgggcacattattgaatatgagatcatttcttctattcgagatattccaacatccaattcctagcacttccatgaagaaaggttgcagacaaacccagctggcaatcatagaaacaaaactttagctgatctaattgtttgtttaattgtttttctttattttttgcttcctcttcctccccccttgtatatccaccctttgtacatccattcttttattaatatagcacagtaggagcctctcgtattgtttaaccgtaaaaaaaaatttactcaagtgtcaggttctacattggacatatatccgattgctcaaaatcccatcagcattggctggtatccatatcggctagtatcgctctatcggctcgttagccgatcgactctttggtgatcaacatatttatctattttaccagttgctggatcaaattgactggcacgcccacatctcatcgattttagaacctgcactggagctaagcagaactcccaggctgttgtgttcgtcaacttagttcgcgccaacacagatctagcaccatcgatcgagtgcagatttttcgtcaacacacgtttggtagtggatggagcacatctggtggtggcggcgagcttctcgcagtggtggagggtctagtagtagcgcgagaagatccaattgtttatacccaaatttggcacctaggattaaaataggaaaaaattgccaaagtttggaagtctgccgatttcctctgaagtgggccggtctgaccgccatgtgttggccggtcagaccggcggtgtgtggccggtctgaccggcagggtccgagtctgagtgtgttttgtcgggtctcgaagtttccttgctcgagaaggcatgtttcaggtttcctttggtttctaccccgagttgaacgtggaggagggcctgtagagggtaagaccaaccccttatagggacatggccggtttaattgtaactaatcaatctacaatcaatcaatcgaatcgtttttcatattgctttagttttcttttagtttgtccatctttgtcggtttgggctgtaaaccgtccgccgccactgcgagagtgcgacacctctttgtaggtttgtcctgaaaaccttccattttgcccatgagacgggtagttatctagaaatcggcttcgctagtcggtttagttatcaaaacccatcttggtctagtttttactagattgaggtggttggcgactctaggattaccgcaagacgttaggtgttgcaatcgtgcttgtcaacttgtcaaaaaaagttgccaatgctagtgacagacgggttcaacagcggcttggagcgaagtgttgcaaggaggccaggtggcagcaatgacgaagactcgaagacgacggtgagctccatccccatccttctcgaatatgacgaccaaagtggcatgaataagacttggagacctgtcgctgtcctcctcgagctcccatgcaaggaccagcctcgccaaggtgggccccacttgccagcctctaaaggctagggccgggtatggtaggtaaaaacctggtccagctgtgtccgagacgacgtatataatgatataggggcagatccagcgtgggtgctggggggacttgagtccccctaccccggcccgctggatcaccattgatagaaggggagatgaaaggggaagaatagggagaaaatgaagagtaggggaacttaaaaggaagaaggagatgagtctccttttaaattttattctggatccaccctgtaatgatatggtttaaattttacgtaattctgatggcaaccaattgatgtcacgaaaatagtggaattgtttaattggataaatttgcaatgacatggattccatattaacccatagcaacgagttcgtgctgctgagacactgcgatcctgcgtgttctttgctcgaggagagctagcaacatcctcgctggcatcccagagtactttctcacatcgcgggggcgagccccgtcggccggcagccggcccgcgcgcacgatcgaacctgcggcacctctctgacgacgacgcgcgcacgatcgaactccgcgcgcaatccacacgtacgccatgccatgcctcgccaccggcgccgcacgcaccttaaatttcttggcggccggccggccctcacaccgcgcgcgcgcgttgatgatcatcatatgcttgtacgcacgtcgcggcgtctggcgccgccccaccggtggtgggatcgctccgcagctcttacctcgccgcccgcctcacctagctagcccggaccagctacgtacgatcgagtactgtactagcgctatactagcaacatccaacatactcctactagctatagtggccacagtactggtcttcacagtctcgtgtatatatggccgccttaagtgtttcgttagtgttttttttttatttttcgaataaagcgtatggccggtttttaaactcaggactgcaatcttattaacatagatgtgggttttagaatttgttaaattgtatcattccggtcctaaggccctatttagatcccaccctaaaatttttcaccctattacatcgaacgcttaaatacctatatgaagtattaaatataggctaaaaaataactaatagcacaaattgcaactaatttgcgagacgaatcttttaagcctagctgttccatgatttgacaatatggtgctacattaaacgtttgctaatgacggattaattaggcttaataaattcgtctcgcagtttactgacagattctgtaattttgttttgttattagactatgtctaatacttcaaacgtgtgtccatatatccgatgtgacatgacaaaaaaattttacccttaaacctcgacccaactcacttgaggggtaggaattgggactgccgccggccccgtaggggcgggtaaccactgggtccccatcctcatcgaggaaattgccacacctatcgtcatacctcccaccattaccggcctcaatgccgacaccaccaagaattcccctcgcaccactacaacagccgtggcaagatcttctagtgcccgaggcagcaagcggtgctctggaggtggcggttgtggaggacgtcctagccatgctcaggttgctccttgagaagggggaggattttgcagcggtggagtggtaggagtagctagcgcttgctcatggaggtcgtcctagccgtgctcggggattttgcttcccttctcaccaacgtgctggctctggaagctgctgcagcagccacatattggcccatcagtgcgactgtcgaaccctccctcttcggtgccgtcaaagcctccatacattgcaaatacaggtctcaagcacatgtctagctaattcccacattataaattaacctttattatacattgtaactgagaaaatcttttcaatgtagcaaaagttctacacattgcaaacacaggtctcaagcactaacatagcaaaagtagtgctcttcccttaagaccaggtacgtactttaaataaaaaaataatattttattataagtatggcatgagtccatcttgatactcataggtatgtgtcccattatagagttgatgtgttctatacattacacatatctctctattgctttatgcatagtagatggatcttatcttattaccgtattacataggaataactaactatttgccactcttataaatggtgataacagatttgtcaccggtttaatatatcatagacacatataagggtctacatgtcagataacaagtggcaaatctattatcatcgtatcttaaaagcgataaatagttaaatgccactgttacacacggtgaatgctctcggagatcaggtttgtagacttcagagatctgcatcatatccatcctagtagctgctggcctgctgcatgctgctgccagctgctactagtgcgctttgaacagtcagctactagcagcggactgtacattatacccggccccggcagccagtttttaataacaaatgtcctgcgcgtccaatcgctgctgctgctgcgacgacgtgccgccaaaacctacaaaacgttccatccgcaaccggccagccagcactgtgcccaattcaattcgatctatagccacgtactgtacatataaaaagtaaattttattttgaatcatcttttagtaccagatgttttattttatgctaacctttaacaaatgttctctctttgaattggatcaggtaattttaggatcatcccaactcatttctcaagcatactaatgatttaaagtgcgacgtcaacacctacacactaataaactcccacagttatattatgacaagttgatgcaggccgtgtttagattcaaactattttcttcaaattttcaacttttccgtcacattaaatgcttggacacatgcatagagcattaaaggtggacgaaaaaatcaattgcacaatttgcatgtaaatcacaagacgaatcttttgagcttaattacgccatgatttgacaatatggttctacagtaaacatttactaatgataaattaattaggcttaatagattcgtctcgcggtttacaagatgtttaatacatcaaatgtgtgtccatatacttgaaaaaaattttggcacacgaactaaacacagccgcagatagataaaatcattgagtgtggtccaaattgttataaaaataaattacccagttcaaagtgaaactatttattaaaaggtggaccaaatcgaaacaacgataataaagggtggcgcaaagcaaaatttactcatccaagatagccaatgaattccctaccatctgtaaatccagctaagagcatcaccaatagattagcttcccaaaatttaatttttcatttcctaaactgaaaatataggaagcgaaaaaattactccctctaaaagagagcctaaattcaattcctaaaaactaaaagtggacccttctattaaataaactacgtaccaacataaattttcgttttcttcctcccgcgtggaaagagatcgcacccaagcgcgggaatgggaagagagaggtgaggagcacacgactgggagcgggagaggcaaattcaggagagggaactccaaatcttgggcatgagagtagggatctgttggagctgttttctggactaaaatatctcaaaaccagttttgggaatggattaggggactattggtgctgccctaagccaaattctgaaacgagaaacgcgtaataccggacatcgatctgaaccgtccgtggccgtccaaatcaatcacggagagatcacgaaagaggaaacatccgtggattgcacgctagcttggcatccaatcagaaattaagacaagcgcacgaacttcatcttagagagagaagggtagggtgaggccgtgaggactacgggccaaaacggttacagaaattccctatcaaccgagcgctatttccgtatataaagagtaccgttttagctatttataaagtttattttttctaatttatttttcatcgtattaatgttggcactgagtagtttaaatgataaatatgatccattatcagtcgatcgaacattgttttcgaaaagatgttaccgattccgttaattttcacccctagtgacgaggacgatgctatggcgggtagcgacgtgctcatgctgctacgacctgtcttgacaccgatcacgctctcgatctgacacggtagaaaaaaaaaaacaaatggcattggcaaacttagcattttgtcaggagctcagcttgcagatagtgagatggctagcacggccaggcccctacctggagcccttctccctacatcatatatagatagatagatatctctggaagaacaacttcaattcgccgatgtgctttctgcatcccttcttatcatatgcttggtcgatcgtatacatcgctcttctccatcagctgcatcgtcccggccgttcctcgatctcctctgaacatacagtaattaaacctgtaagatatcttccctctgttaattatttaccagctagcttcttccattcatgagaatgtatgctaattagcactgaactgatcagactagccagcaaattctcttttctgttttggttggttgcttcaacaaaatctctcgtagccacacacatatgcttgctaattactccctccagttccataattcttgacgttttggacaagatttaaattaaatttttataactttgactagcaataactttaaaatcatttagtttaaaggcactagaacaacatatatagatttgttttacaaagtacttaaaaaaaagtaaaaaaatctatttatagtatataatataatagaaaaatatagtcaaagatatatttagaaaaccgtgtcgttgtctaaatcgtaagaattatagaagagggagtaataacaatcgaaattctatggtgatgtatgaacctccttgcctcttcttgtactcatcatttattcagtttctgaacaccgaaaaaaaaaatatgccacatgcatgcagcattcagatgcacactgggcattttcatcgtcatacatgcatatctcttttcagtatcatgtacatatatttttttttcgaaagaaagtatcatgtacatatatatgttgggggaaattaagatattgactcacgttgttaattttagaaatttgaatgtcctcaagattcgaaatatttgtatagttatttagttatgcaatgacactcctctcaacagaatgaattattccgaacttctttgctatacatggcaagctggctagctatatcgaatcacctctagtgtaccattcacatcattactcctacaattgattataattaagttgtaacgctaatacacgtctaaaaaataatttatgagtaaaactttatgtatgtttttagtgacttaaagcaatgctggaaagtaaattaattatatatgatggaaaaaaatcaaattaattctaaaattgagttttaaaattctggtagcagctgataagccaaagagcataccataagagcggagaaatatttaagccatcatttccatattaaagtatgctagctcttgaaattatattcaagtactatagatataagcctacattaattaatttatacaagggtgaacaaccaaatcaaatagtctatacctactactagtggcagtgaatctgccttcccactactgcagtttctatataaattatgacttgatattattaatattatggaatagcccaatatttaattcaaactagttaatactatatatttaaataagcaaacaagtgatactaacatatttaataaaaaaatattttttttgctatgacatagtataatgtatttccttttacccatagcaaagcatgaggattttgctagttcaatataatgtatccatgctaattacactcttgatgagcaatcctatcttactataaagttataacccactaactactaaaatttaacatgcaaagatgccacatcatcatccactaacagtcaatacatttaatatcatacaaacatgctatattatctataatttaaaatttattacattttagagcttttaaaatgaaagcatgttaaatcattatcccatataattcatataatatttcaatatatatcttcattactttttataatctatgtaagttcatcctcacttcgttaatgttatttctctcttctctaattaagccatatcacatcaattgattttagtgcttatataagtttatgttgtttagctatcttatacattatttttacttattgttatcatactaaactcatgcagcaacgtgcgaggtttcacctagtagttaaaaaagttggcacctagcccgttagttttattctgagttatttttttaatctctatattcacaagaccttgatcaatgaagctaaaaaggtcagttacaaatgcatccaaacatttagttatgttccgtttgacagagtaataataattgttgtagagtgcaccatagacaaatctcagtgtaagcaccgatatatctaaaacaaataacaaaacaaaattttaatttcctcctgcttatatgtatatgcgggatcagtaagattaggtatataataatatactgatatggatgcatgtcttaggctatgtttagttcctgaaaaaagttgaaagtttggggaaagttggtagtttgaaaaaaaattaggagtttatgtgtgtaggaaagttttggatgtgatgtgatgtgatagaaatttggaagttgggggtgaactaaacaagaccttaattccctccctgcatgctgtcatgcaatcaaccaaaaaaatacataatttcatggaactggaataaaaaaatgcatgcataaaaaatccatgatatataaatacaattcaatttaccatatccttttcatacatataattttatagacatgaaaatgacaattacacatacgtttactatagctagtctgtataattcagaaatgcagtatgtaaatacatgagcaataaaaaggaaattgatttaattgactccagatactttttaatttgtccttgtcattgcataagtgattgcaataaattatatagagtcaatactgtacagtaataaatatgcaggaaatatttaaattttatatttcaatttaagattcaaatgttttctggtggaagaataccaaatcacaccccaaaaattaaagttaattaggtctgcctctacataaaaaaaaacatttatgaaaagtggtccgaagcttatttatctgttataaaaaaaattatacactttaagatagaaaactgattataccacctagataaattttgctgatgcatgggataaattaattatcctactctaaaccagctggtgttgctctgctttgtgtatgatacagctatatgagatatttgccattcttaaccaatcaatggagcatgatcaagttaccctttttgtctgtaagaaagtaacaaaagctttctatactcttatgtggacatatgcagttattagtacatatcatataaagagcatgattgtatatctgcattcaggtatgcgtagtaaggcacaatttatatcttcattgcgggatgtatggtgcgtgcaataaaattaaaataaggactgcattggttaatgtcattgaaaaaaataatggtattgatgttgttgaagaattaggatgaaataagctattatattggcagtgtattacttcatttgtgaaggtaactaaaaagatataggagtatatattatagtcactcttttgcaactacaaaagcatctatcatttgtgaaggcaactataacacatatatgttaaatgtattcatgatgtcctatgttgtactaggtttcaaaaattacatgcattgcaatgattttttttaaatatcatatcttttaacttgagaattatatattctcggaaaaaaatatatagaattagcaagcaaacatccatccaaaaagtccaagccacatgcacaaaagatatatttattcatccatagaagacctcatctctatttgaggggatggcagattcaccaccactaggttcttttatatagtagaaattacttgcaaaaccataggtaactagcttgttcatcctctgtccccaaacttaatttggacaaaggatatacatttacctgttgatgttagtttctgaccatgaccaaattcataaaatgtttcatacatcatcatatatcatatatttatgcatgcttttgagtttctcaacttaggcacttatggttcttatgatcctgatgcaggtgattgcagatctagtgctagcaagttaaaaacatccttctcatgcaacaaataaattttaccattattttagaaaaatgacaaggaaggaaccctcaattttcattaacagagaaactgaaatgattttacaacatcaattactgttcaatggtatattttttaggacaaaatattggtttgtcatcatgctgttactgttataaaaacatcaagatcgagtattaaatattcttctatcgtagctagaattctagggtgcagggattacacctgaaatttctagctcaaacctttcgatacaaaatgttcctaataattgagtactcgtatggccaaccacggatcaccggagaactaattagagaaacttcaaaaatctcaaagttagcacatggacaaaccaaaattaagtcagccaaaaactagcacatagaaacaaaccaaaaatcagaaaatatagccagaaaaaaactatagcacatatccaaaaatcggaagtaacaaatactcgaaattagcatatcaagttatcaacaaatcaacaagtcttttctcaaaataaaaaaaacaacaaataacaagccaaaccggtattgataattgattcatagagaagtgaactagcaaattaagtagcaaaatatcatgacagaggaaggccaaattaaccaagccatataaatacaaagccttcaaagttttcatacctatttttgtttgattgtttaacacaagaaatcacctttactggctttactcatccgttgtcgtcgttgggtcgcagctcattatctcctccagatgattgtagtattggaagtagtactccaatccgtccatcggctgctcggtgctcgccgccgccgccgccgtccagtcgagctcgacaccgcggcgcccgcgctcgtccatgggcgccaccggcgatgatccgtcgtggtctctgtttctcgcccgcgccgacgacgcattggtggtgctcgacgagctcgcctcccctttctccttcgcagccgatgctgcggcggcggccatggccgaggaatgctgatccgccggcggtggagcggcggcgaacgcgggcgccgccgccgcgtcggcggagtcgggaagggtgaggcggttgatggcgtgcttggactgggtgagcagccactccaccgtcctgctggccttgtcgaagccgagcttgtcctgcagcgcgaagaagtcgcgcgcgacgccgacggacagccgcattcgccggtcccgcacgccctgcgccgtgcggatcttgctgtgccggtccgtccggaacggccgcctcggagtcgccgccgccgccccgcggggggatcccccggcgcctcctcttccacggccgccacctccctccaccgccgccgccgccgcggcngttgtcgtcaccggctgccgcagcacggcctccagcgtctcctcatcctgccggtggccgncggtgtacgcgtcggcgccggggaagaaaaagcgcgcgtcgtactcgtccagcgtcgacggcgacgacgacgacgacggcgcggacatgaggaaagctggtggatgtaatggtaagtgtggttcttggtttgagctgcaatggtggtggtgatggtgaaggttgttgttagggtaaggaggtatcattagtgaagctgaagatagcactaaccccaaccaataacaactccacttgagattatgtgtgtctttatatcaggcagaaactgaattatgctcttcctagctcaagtacacaacatagtgatagtacatgtaatatggatgcaataactgatagtgataattctaccattgccgtcactactagtctacttcctccatttcataatgtaagtctttctagcattacccacattcatatagatgttaatgaatctagatatagaagttaataaatctagacatatgtatgtgtctagattcattaacatatatatgaatatgagcaaaagtcttacattacgaaacggagggagtactacacttgtacacacgtcttcttgttcttcttaattctatgtgtgcaattgtgtgttgtggtatgaccagatcaatggaaggggcaaaactaaaccttaatccatctgttttttaatatatgacatcattgactttttgagatacgattgatcattcattttattcaaaaaatttatgtaattatcatttatttattgtgacttgatttatcgtcaaatgttttctaaacatgacttaatttttttagatttgctatagtccaataaaaagtacctcgagg

SEQ ID NO: 8961 - DNA, 16781 bp, Oryza sativa
ctctacacttttttatatatgcaaaaaagttttataagatgaatggttaaacgttgccaaaacgtcgttgacgttagatattaaatatcataggtagtaaaagaagagatgagatgcaggcgagagatagagagggggggggggtgttcatggtcacattcacatactagtacacaagtgcaaagtgctaattaagtatacgatatgtaatcagctactagaaatgtatggcagctgctgcagtagagcctgggctggtgctcaagctcaagagagctagtggtagtacgagtagtagtcaagactcaagacgactcagagctgatagatgctctgaaacaagctgagcaaagtgcatggtgtgtgtgtgtgtgtcgctgttccactgtgttcatgtacatttacatcactgtactctattttgtctcttctttcaccagctgctgcttggcctctttattattggccatacccatagctttatgctctctctctcgctctcagatatggcatttgatgaaatggatatggtacattgataaactgttaacaagtgtccagggcgtggtgggcccactggaaaggtgtaggtgctctagtggtgagcgaatgataaagggcatcatggtgaggcactgaggccctattacgtgagggcaggggggcagggtacgggatactgtaagtccacgtggtgagaggcatatgctcctacaaaatctgggagggggctgatagaaaaattcggagtaggacaagttgataatcgatcagtaggtcacccttgtggcttggatatggtcttttaaaacggaaaattttaaactgtttgtaatcatttttgtatttgttctaatatgtttgcgaagagagagaatatttgcctggtgctgaggatggagccacggggtatgggggaggggcacctaatcccgatcccgggatatgggggaggggggaggggcacctaatcccgatcccgccacaagcctgctggcagcctacgagcttgacaagccaacgagtacagatctaccatcatacatccgcccagccacaaccccttgtttaaattctttataagagtctgctgctatcccggcttctgatctcttctttgtgatgacttccaactgatcatgatgttgatttctttttaatatatccttttgcatatttgcaaataaagatttgtttgaattaactatgcactttctaagttttgtaacccatatgagtttgaccactaatattccaacttttcattgtctaagcttgttctacataccatgtcgtcgataaattaaatggttaaacggtttggcaactttgtacattgacaaagaaatgctagatttcgtaaaaaaaaaagagacaccactagatgagattgatatggatactatcataatgactttgcgtctagaaatgtttatgatgttttctgtaagtattgcttttggatgcagattaaatatgtagcggtaaaaaaatatttatgcataagtaaaacgttgtgtgctatttagcgctatattgattattatttagatgtaatttttttcttgcgggagtttagatgtaaaattaagggcccatgttttttaatttcgtcctaggccaccaaaatctcagaatcggccctgtttcttaattttgcgctaatgtttacgaagagagggaatgattcttttttttataattttgtgctattttcgtccatgcaacggtaacagagtgttgtgccaatgtgtcgttgctgatgtggaatgtccatttggcccctgctccttctgttgtcgctttatcttgtccagaaagtttttatctttgagcactaacaagggtaggactagcataagcaacctgcaaccatacccattccaccttgaactaatatcattatcatctcaatctcactcgccagaagtcgagaagcatctgccatggatgatcaccaaagaactggcgcgacacgcggtggtgtgctacctagtggacactatcgacagggagcatcctctagcactatggtgtcatgccaaccatcgagacaccaagctggcagcacacacaagccgaagccttccgcaatatagcggacaatggtgttgcgcgcggttgtctctatggagtagggcatcaaggctctatagctctactccaaggatgtcagccacctccatgccttcatcaaatcccactccactgccaacaaggccctaacgttgtccagcattccgaataagaaacacccccctacccacctcttgccacttttaactggtcgacaaccctccaatgaggtgcacagagtcactatcgatgatggggcgacaatgtcagagcattagatgacatgcttattgcaggccttgtcgagcaattcgcaaatataggtcatcaatggccttgaatgttgatatgcagagcgtgacgttgggccgatgtctctttcttactattctcggttggcgtgctggagccatcgcgtccctggatgaagaactcattttagtggatagcatcatgaaagtagaggaacatatgtgggctaggggcaaaatggacattttgcaccaatagttcatatcggcatgtatgcatgtcactccatatggatgaaagaggcacaacattttaaaaaaagttctctctccagtgataaatatatagtgacaaatgtaaccgtggcaattggctagagatcagtggcccattataggagtggcaaatagttaatttatcttcaaaaactagcactcccttaggttgttatttacttctattgcttatcgggtatgaaacaaataaaatgtgtcactttctctttcgagcaaattatctttcaaagagacttttacatcatttggtttgcgagactaggttgtcatgcaccatttgacatagcgtcactccagatctaatccgccaattttacttagacaacataatcccaagaaagagctattagatttgactaggaggtacgtagccaccaagcaaaccagatggaacattttggaatggtttaagaccagccatccagagtagaagagaagagcctacaccatgcttatttcaatcccgttgcttttttttttactgcatcaaaactgcatgtagatatggtattcttggtttgtagatgtttataagacctgtaactgctacagaaacaattggtacaggcttcaggtaatttttcacattttcacacatggctacataagaattccgcatgcactaatgttccattagtgaaggtagttacttacgacaaccgagtgtgaaaatagcttttgcaaagcggtttcactaatggttgtatttccataggtcatagctgactgcctctggaaccacattttcacaagagccttgcataaccacgtgtgttctctagaaatcttcatcttctcgcagcttattgtagcgccacttcagtgatcatgcgccgcttcatctcctactcttctttgttagttgagatgcggcgaacgacgccagccctaaaacacagtgcaatcctttcctctccaaaccatcgctcctttctagacaaggattagaagacaagcagctcgccatcatcggagaaggcaccggtgtcgtcttccgatgacctcccctctttgctgccattgctcagggatgagtgggactcagatgacaagtggtttttttaacgattccccaccgctgaaggactccgatgatggggacaacaaggacgatggcaataatgataaggacaatgacgcgacagcaaaacgaggaggaaggcaaggacatggccgagaacaggtgcgctcagtgggacaaggacaagtaggctcggtgggaggtgcgtgaaggatcgaatacaagaatcaagccaaccagagagggggttgaatgattggaacaccaaaaacctaaaactttttgtgcaattaaaagttaccttcgtatagcaaatggagatcggtctgaccggtgtgattcctctggtctgatcgtgcccttgccactggtctgattgaagtagatgcaccatttcaaccacccttatagctattgtcatctgctgttgccgctgccggtttgaccagattgatgtcaccggtctaaccgtcggtgtctcgccagtctaaccgctgcctcctagccagtctaaaccatcgggatccagaaaaacacgtattgacgaaactcttgtgagtagatcaactttattccatcaatatgtgtctacaagtgcatctaaagcactcctctctcaactgacgaactagggttgaaaccttgaggcaaaccctaacttttctctccgaaaaaatcgatatcttcccatctcaacccctcatctatttataccctcaatgtgattgcccctatccacgaatccaactagaactaggactcctaatcacataggaaacctaccaaacaagggaaacaacatccccatacaactccatactccaatctttccaaacttggactccaatccaaatttgactcatctttccatgtgcacacaataccacgtgtatgccatatggaaacattcatctccacatgcattgttctatagactgagcatcccgtgtgctatccttgaccgtctagaccacaatttatcccaagcctagtggctagtcccgatccatcgctggctatactcccatggcctcaagcaacacctgcacatgaacaacaaagaaactccatatccgagtataagtttgcaccaacttgatcactcacattagcacacaatagtatcacatacaaatagataccatctagaagtcataaacataaagcaatctagacaatccacgaagacaacccgaaaccaacttcctcctggagtctactagtttgactgtcggactatccagtcagaccacccaatcaccaccggtctgaccggtggtacccgtccggtctgaactgcctcccagagtggacaacatcgttctcaaaccaaaaacactattcactatattttcaacaaacactcacctttgacaattgttcatcatgacgattaaatcatcaaatgctactacagtgcggaggtgggagacaagtccgctatgaagaagattagggtagtttaaaatataagccgtgcatgtttttactaagaaatcaacatttctagattctgaccaataataatttagttaacaatatatatatttatatataattagtatgtaacacaattgaatttgtgtttgaaactactttcatataattttaagaaaataatagttaaaatataatattgcatgcatgccatgtaaaaaaataaaactaatactcctcaggtgactgtgattcccccaattcttagtcaatgcttcctagccattagattgaaatccaacgatcagagaatcatacgtcttaaagcttcagccagtggaggaaggagaagccggaggagagactcacccgaggatgacttcctagcggtggcgacagcaacagcgagctcctcttctccgttgacaatgtggcagtgatggtgagtttagagtttagggtttgtggccgaggtcaggttaggaggggggctaagaagggtttccccaggtttagagggatggccttgggcagtggctagaacagtggtggatggtgtcgacggataggtggtgaggcggtaggggtgccaccggagccatggagatgggctgacggtgggcagggttggcagtggaagagagggaggctatgggttaggatgtggcagtcagtggcagcgaatccgacaacgcaagcctccagagatgaggaagagagtggatggctgggttgggggggaggggatggtgtcactgctggcttagggaggaaggcgaggagttgtaagggggaggatcccagtttggcagggctcgccagcaccattgacgtgatcttctagcttgctggtgaggctagggacaacatgatcaagcgatggaaaaagggtggtgttagcgagctcgagtgcatggagctcctgagcttgaatgcagttgtggagtggaaagggaagaggagatgataagatttactgttcacacaaatatctcgatgcaaccttggccgttcaaaaaaattgactgaaatttggggtattttcaattggctgaaaactaggtagccctcaaactaatcatatagcctctgccttacaccctctatcctaaaatataacatcttatattgtttaaattttgtccttattataacaacccatacttataacggtgactttaccattaaactactcatactacaattattatcaattattagtccgaaccactttaatcatgttaaaagtttaaaacttactccctccgtccgaatataagtatagttctgcatatccaatatttgaccgttcgttttatttgaaatttttttatgattagtatttttgttgttattagacgttgtgcgggaagtccaccgacgccgtgcgggaaatccgccgctgtcggccatcgccgacgcacgcgggaagtccaaccgcagctgtcggtcattgccggccgatgcacgcggaaagtctaccgccaccggacatcaccgacaccgtgaggggcacgcggtcacggcggctccggagctccgcggcacggctgctcgacggtggcgcactcaccctcgggcgagtgcacacaccggcgagggggtgtgcggcggtgccgccactttcaccggcgctcccgctccggcgagggagggaggagaagtggctagggtttcggtggcaaccaaggtcgggctaaggtttcgttgcctcgatctcggtgctcggccgtccgatcgaaaagtttaactaagtttttataaaatttaataacatctaaaatatccaattagttttattaaacttaacattgaatatagtttgataatatatttgttttgtgttgaaaatactactatatttttctataaacttggtcgaacttaaagaagtttgacatagagaaaaagtcaaacgacttatagtatgaaacggagagagtaatagatagattctgaatttacctataaattggaacattgtgcggagcggactagaaaattttagggactaaaaaaatcctttatcagaactaaaggcatacgttggaagaggagagtggcttaagtatggtttcatcctattcctgcaatcctatcctaggacccttgaggctacacatcgaagcaaattactacattgtaaaatgcactcaccgccacttaccagcctaccacgcgatgagctatgatgtagccatggctaaatttcgaaatgcacagtggttggttggagaaattatgttaactaggctcccatcatcagttggccttggtcaaaattcagatgcttcttccccacaaaaaaaattcagatgcttcaactgcacaatttcgatggcattatataggttaattggatccatgctattgcaaatttgcttattcagaaaaataccattacaattagtctattcgtaaccgtgccactagaattttacaaaattagaaccgtgccactgccgtcatgttttccatccatctcttcattttttttttcagttttcttcttcttcctccgtcttcgtcttcttcctctttccttttcctccttctcattcttcccctctcatgtccagtgaagccaagcctccactagacctcctcctcctcctcctctgatggcaagtggacgatagcgacgacgcgagcaggacggatgggctcccagctcgaggatggagagaggacagtggtgctgacacgaggaggatgaccagacgacgccaacgacgcgaggaggaccaccaggatccatgccattgcaaatttgcctatttagaaaattgtcattacaattcgtctattcgtaaccatgccactggaattttacaaaattagaaccgtgccactgccgtcgcattttccatccatctcttgttcttttttttgttttcttcttcttcctccatcttcctcttcttcctctttccttttcttccttcttatttttcccctctcatgtccagtgaagcccaggcctccactggagctcctcctcctcctcctccgatggcaagtggacgacggcgactacacgagcaggatggacgggctcccgccggcagctcgaggatggagagcggattgtagcggcgacacgaggaggacgactggacgacaccaacgacgcgaggaggatcagcaaacgctggacggcacgagggtaatgctactatggctcagatctagcggtgtggactccgacgcagtggcctactccggtggacaggtgtttgctcgtctgcgtcctcctcggcggacaggcgggcgagcgaaggagtgcttgaagggcgtcgacttgcccgggcggaagagtagctggtggcggctagggtttggagcgggggaatgagatgtagtgcggcttgtgctcgggctccatggatcctctcgtgcttgtgcagagtggatgcgcgccctcctcctcctccggtgccgattcatccatcgaaactcatcgttgcaagccaccgtcgctctcactctcgctgtgcccagacaataggagaggtgacaaccgccggtgaggaagggtgcggctggcggcggaggaggctagggaagaagacgggagaaagaaggaagaagatggaaaaggaagagatggatggaaaacgtgacggtagtggcacggttctaattttgtaaaattccagtggcacggttccaaatagacgaattataatagcattcttctaataggcaaatttacaatggcatggatccaattaacccttttatatatgagacgctaactatgatggtttcttttgatatatgaacaaaacttaaagttagagtaaggcacctttagatttagacttattagcttaagattttaagctgatttttcggtttttatggtgcataagccagtagattttaagcccctcaaaagttcaaggatagtattctagctaatctaatccacataagaaaaaaagttattaaaatctagcttttagcttaaataggaaaagagagtgagtttatggttatgaaaatcccaatcgaaaacttatctgtttgtttggacttcatctttttagcttgactgacaagcccaaacaagtaattaagtttacgtaatatatacactatttcgcatgcttaaaatcaagtgattaatttaattatactaaattgaattgtcttgcttcacggttacgaattggacttcagaagtattattgacttcacctgagagagatataatatagtggtttcctcacatgcatatgaactagacgacaaatcaataatggaccacatatccccacgaatcacgatataggataaacaaaacaaagggctaaaatcatttaaaagataccttttcagcaatgttttgagaaatggcaatgataagtaacttaatgaccgatattgatgagctggtcaaccgcatctatatatatggtgatcactaaacccttatctctccattgtaatggttgaagttttccgtctaaaagctgtaaaaaatgagctttaattaatttctgtcattgttatatatgaatatagaacatatatagatttgttattgttatatatgaatatagctagatgatatatgcatggcaattgggagattttttttttaccacagacatctcgcagtcgaagagcacgtcgtctaccactgaaagaaaaatagtcgtaaatacgataacccgtgtcaaatctaggacttgaccccgagtgggttggttctaccacaaggaacctaaacaattgagctatacccacttcgcatcaactttatgattttgtcctcgcttttcttttaaccaaatcataagtttatctctattccgttaagtcaacttaatagtattaacttcacggtaaaaaggcatatatgcccttgttcatgtggtttggtggtttgtatagctcagagatacgcatgcgtttggccatgttcaagctgagagattttgggttaaggcatatattgcgtcatgacttgttatacttttacgtagtgattgattattattatataaattatgaataccctgcaaaaaaatataaatacgataaatacattattcagattctctaaggtggattaaggacacgtacttaaaccttctttactttcatggcatgactggtaatattcaacgtgcatgtgctagttatcccaatttacatatcttcgctttataagcaaattagtaatgagtaaggaactggacattgctatttttacttacaaattaattaaagcgaagccctgtgtatatatatactaccttcgtttcagattataaaacattctgactttagacaaagtcaaactgctttaagtttgactaagtttatagaaaaaagtagtaacatttttaacctaagacagatttattatgaaaatatattcaattattgatttgatgaaactaatttagtattataaatattactatatttgtctataaacttagtcaaacttaaaacaatttaactctaaccaaagtcaaaacgtcaaatagcctcaaacggatggagtacgtaataggcccagttctaaagagcaactagcttcaacctgttagtacactccgtgaactattaaatggtgatttttttaaaaaaaaaactttctatatacaagttttctaaccaaataaatctgttttttaatttataacatttaatatttaattaatcatatactaattactttttttttgttttgcatgtaagtatttagcctagccaatatgctcaaacaaactcagcttaagccctataaattaaacacttgctgctgtacctaccagcacagttgtttagaccaatccttccgtcctaggtagcgaaaggaaacacatagtaggttgtttgactaattaaattagcatctcaatttgataacgtttaccttataatttacaagcaatatatactactagcataaatgatccaaatatttatattgatttgtcctctcacttaaattaaatagaatttaatataaaattaaaattgtttttctatttaaattttttgcaaatttttaaagtgtacttattaatactagcaaggcatattatcggtaaattatatcataaaagtcctattaatttagtggcggagccacctcccggacaagtcgggcaaccgtccgagtcgctgccatctccactgtccatagccgttgacacctataaaaattaatcaatcatcgtaaaacactattagtcgccggggcttgacgacgccgctggctctgccactatcttaatttaaatgcatctaaaaaacaagtataatttaaagtaaattgttgttaggtactcaagtctaattgtaacatgtagtacgttttaccatatatgctttttaagggtaaaaaagttcacatcaagaatagaagcatcaaccaagatagaaattgaaccggtacatgaatactaaataagtaaaatgtttttaatttgggacaagcactggtggagaaaccctttgtagtcccggttcgtaacccccttttagtcccggtttccaaaccgggagtaccaatccgggactaaagatcgttatctttagtcccgggtgagataaccgggactaaagatctagctgaccttttttttttttgcatggccctgttgctgcatggtttatatatatatataaaccatgcatatatatgtttcaatacatatatatgcatacatatatatatgtatatatatatattatattatattatatgtatatatatacatgcataatatatatgtatttatacatatatatgttatgcaaatgcatatgtatatagaaatatatgaccaaaatatatttacattgtagaaaatgtgtacacatgcatatagaaacagatgtagtcatgtattaattacaatccattatatgtcctagctagcgagtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaataaaacaagaaatcgctacgtactgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtaatagcaattaacataattaacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatcgaactggacgatatacttacaaaatccagcaactcataatagagacgtcgacggcgtccagctggtatagttcgtagatatgtgtgaaattgatccagagaatgtcatctccttgcaagaagtccgtgtccctgatcctcgctccgatcatctctctaccggaggcgctcatctccatgtacagctgatggaacttgtacatttgtgtgggtagggactgcagcagctcaggcttgacaagcggtttaccgagttcgtacatgtattttacttccgccttttcgattggtgcgactcctagcaattgacccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtccagtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaataccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttcttgtacagatctcccttgaagttctgaaactgttctgccattttcttcagagtccaccttttcactttgtcctctgtacccgcaggaagggtgaatgtctcgagcattgtggtccacagcatctctttctccgaatctgggacaaagctctcatgatctcctcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcatatatgctaagtctaattaagacaacaatagtcaattgctacttgtcgcaccatttccgtagtaaataattatatactaagtctaatctcaaataaagtaatcttatattaaaactcaaataatattaattacatgctaagactaaaatagtcatgtctgctaagtgtttcgtgcgtatatgctaagtgtaattaagactacaatagtcaattgctacttgtcgcaccacttccgtagtcaataattatatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgagaagtaacatatacatatatatatatatacatatatatatatatacatatatatatatatattgcatttcacgttaacgttcgtcctcgttcgttcgctcgttcacgttccctagctcgttcacgttcgttccctcgttctcacttgtcttcgt

SEQ ID NO: 8962 - DNA, 2452 bp, Oryza sativa
gagatacggcgggcgtcggcgcggggatttgccttaggcagtggcggccgaaggagagaggctgagagagatcgatcggccgaaaacgtctaagtgttggtgaagaagacgagggcgcaccgggaatatatatacccccggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattaattcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatcctctagtcaattataattagcatatgaatgctagtaaattaaatgttaaaaactctaattaacgtacatatgaaattgccacctgtgtgatttaaaacttttaaaaattgtaagtatcacatataactagcatatacatgatttgaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaaggcggtgccccatccaactgatcgtaatcctcgtcagtcttgtcttcaactccgacgatttctcttttgcttcgaacaaccacttgacgcttaggctcatcaggccatctgcccttctttcctttgctagacaatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcactggaacagaggaaccttgagaggaccatagtcaagttcccatatgtcctcgatggcactgtaatacgtggcagttgttccatcgtgtcccatggcatccccacgaacagcgctgttttggttcgtgctaatcatgtcttgggctctcgtgtagaatgtgtacccattgatctcatatccatggaatgtcgcgatagacccaggcggtcccctcgccaggaaggcaagttgttggttgatcgactcgttacccataagatgttttcgtagccacgcggggacagtatcaatgtgatgcggtgtaatccatacatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgtgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggatacccctattacaactggtagcagttgtgtcatcaacacatgacagtcatga

SEQ ID NO: 8963 - DNA, 6229 bp, Oryza sativa
acatgttgtgtaggtacataggctagagaataaggatctctttcacaaggtgacaaagcagatgtgtcattatattgaaaaatgaaggtggaaatatcaactcaaaactgacgagacattgcaccacttcattctgaagggcatgtaatatatccggatcgatgacgttctgggaaattgtgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcctcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaacaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaatgaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactacattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcacaaaccggggctaaagatcaccgggatctttagtcccggttggtattaccaaccgggactaaagttagcatctttagtcccggttggtgttatcaaccgggactaaagataccgggagggcctgacagaccctgacagcattcgaaccgggactaaagatcatctttagtcccggttggtaatacaaaccgggactaaagatcaaatatgcccgttacccttttgaaccgggactaaagaacatctttagccccggtttttattgcatccgggactactgtggaaatcggccgaccgacgaaagatggtttctccaccagtgaagacagccaactcatgagtccataagctttgcaaaaaagggcaggcagggccagctagttaattagccagcaagactaattagggtgacagagtatcatgaagatttgctttacttagctaattattccacatcttcatgaacctcgtcagtcatcacaccttcctttccaaaaacgaaactcagaaaaccaataaaggaacccgctttagctagcaacctaattaaattagaagctaccctatagcttacgacaaacacagctgaattaatcaattaatttgcagcattatgatggggcatcctctcatgcacgcgtcggccatcgatacgatgaaggttttgatatgtttatcatggcacattaacaaatgaggacgaggtagacgaaagctaaaaaagggattaattgattgatcctggaagaccctgcctgcatcgtgcagcctccaaacgcgccctgtacttgtttaactatatattttttttattttatgtcctctcttggaatactttcttaaggaagaagttgtagtgcatcagggctagctacctagctagctaaccagccttgattagagaaatagagctacctgtaaagagcactctaaggagattagcacaagattagagatagatagagagcttggcttgaaagatagccgaggttgttgctgctgctaattgttatttctgcgtagatctgtaagagggaaaaggaggaggagatcgaaggggaagatggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccaggtatttgttttttttctttgcttcactcccacattagttagcttaattaggatctaagctcctaattagatctgctaattacggggttaagcatgtcttggaagttagaacgctttggttgactttagtttagggcagtgatgatgtgcaagtagcagagatacctcgtaccaacttggtacatgatgcgtttgctttggagagatctgtacggtgattggaccacttagattcttactctgaaatcgactttactggtttgatttaagtaatttttggatggttctgcgcgatcaatagaccattccaacccttgaatgaggagaatcctcaaacagaacgtgctaaaatttcctcaaaatcaatggaaactatcatagataagattgagtcatagctaggtgcatgtctttgtatgataggatttaaattctgatgtccaataatattacacatgtgtaatatacgtgtgtttttaatagaaatatgatcaaagatttatcactattctcagtactttcaaattgaatttagtgcgataatggacttgtcgttaactacaatgtataaggattcgtacaatattcaaaatttccatctcttggtgaatgagaatgaaatgaaagaacgcttgttttttttttcttcctccctcactagctactcaatgaatcaacctggtggtagagagatacatgtagctaggacaacagctttatcaagatctttactttatgtccctcaacaattgtcgaagtctattatgttatcgtacaaaagaatatgattaattctacattgttcatcctggcttattaaactacatatagtaagatattatgtatcatctatagatacgttgttttctgaaacttaaaaataggtttcaaagtaaatccaaaggggaaaaaaagttactccttttgtctcaaaatatagcaatttgaaactggatgggacacattatccgggacacattatccaacgaatctatacaaggagctaggacatatcaggagacaactgtattgtttgccatgctattcacaacgatactcctatgtaacaagattaattaatggatttttcttgaaagggggtgggcgagcaactctgatagaatttaaatcttgatgctcatgattactcacatatgggtgcacgtttaatttagtgaagttatggattcatcgctactcctatatagtatctatctcttgcccgtgtgttcaagcacgtttcttatataacgtgtgatatacgtatatatcagtgtccgtcctccacatgatcggaaaaataaaggctttaattttttaaaaataatgttatcaaaatgttcataataaaataaacaaccatgatctacgaataacctaattacttaataataataaacaacaacgaatagttttggtgctaggcccagcccagccgtacatgacaaataggaaaatatggatagaaccatcgtgtcatggccatggcaggttggcttgctttgtgttcagaaagtattcagtccggatgcatagaaatatttgcatatccaaacatcccgttcaatcatccactgaagtatgcaactaattatgcattatgttgacaacgcctgaagcttaatcttccaagtgttttggatgcttggatcctcgtaacagcacggttataacttgaggcatgtcttgtagtgccttcaaaaccatcttttaccattgtcactgctttttctccatacaaatagctcaagattcgtagaaaacaacaaactaaataggaaaaggatgacaaattaggagaacagtgtctagttttaagataacaggaagttttaagataacaggaaattaagcagtaagaaccaattaactcaaaacactccacacttaattctttgtgttgaccttacagttatctatccacgtggattacttgtcaaagaactaggccttcattaaaagtttgcatttgtcatcttacatactgatgcccatgtactacaaaataagcttgcaggagctatatgatagcattcaacactactgtggcatgtgttgacatgtgttctaatgggatcttgattttttttttcaaccagcatgaaatccataattgagagatacaatgagacg

SEQ ID NO: 8964 - DNA, 631 bp, Oryza sativa
actttgagacacacacagcaagatcaatacaccatgaagcttcggtgctcatcagcctcctcctccaactcagaaaaccacactccacctcaaacttcaaaaccatcgaagcaacaaaagcacggtacgggaagcctacaagagagggaaaaaaagatcaaacagctgtgatccttgccccaagtttcggatgacgaaacgcctcaagattcaaagagaggtcaagacgcggttgctgctcgatcaaatgccacaacagcgaaagacatgatcgaaccagaaaaaaccgcgacgcccccaaacacccaagcacgcagaaaccacaccaccaggaggagagggagaacaccaccagaagagcgagatcgaaggaaagggagaagaatctcacggcgctttgggaggacgtagggtttagggatggaggaggaggagaatctcacaactcacctcgcacctttcgccgctactgctcttgagatgagtacgttgcgagagagacagagagagagagagagagaggagagagatgcggaaaagtggttgtgcagcgaagcgcaaggagaagaaagcatcgcgcttaaatacctgaaccggacgcatctcggctgtcggatcgtctctcgcggct

SEQ ID NO: 8965 - DNA, 8208 bp, Oryza sativa
atgcacatcccacagctgacatgtggggcccacagtctcgcttctgtctcttcttctcgacgcataggcctctctctccgcgccaccgacgcgagctgccgcttcctgacagccgcgccgccacccacgccaccaacctcacatagtgcagaagccggagtggctttgttcctacgtgacaatcaaatcaatatttttttaaaaaaatcagtgggacccaactattagagagggaggggtgtgagagggaagctgatcaaattatcacaaaactatatattcgttgatcaaattatcatacattgatcgaatttatatttctaatccagtacattgatcatcaagttcgcgaatgtatgatggtatcaaagcttacaaggcagagacctgctgctgctgctgctggcctggccttggtatgaattgtgatccaccgattccagtgctcgtgatttctgaagatctcggaatagagctgcaaactggtcatgttggcctgcaaagagacaaacaagccaatggaggagttagattgaattgtgagaggttactgaatttccagcttactgaaatgggctctctttatgagtaaaaaaggagcttactgaaatgggctctctttatgagtaaaaaaggaatgatagagtaagtacgttacaggaaactaagggcccctttgcctttgatttgtaggaaaagtgttcaaaatttgaaagatttcaaccctttggaaaaaattcctatgaaagcctttgaaacaaaggattgaatcctatactatccttcaaaattcctatggaatggctaatcctatagagattttgaaggaaagttagcaagaggtccaacctcttggaaaaatttctttgagtctatctctctcatccgattcttgcgtttttcctgtggtccaatcaaacggttattcctgtgtttttcctgtattttccaatcctctgttttacacctgcattcctgtcagaatcctacgtttttcctattcctccgtttttccattcctgcgatacaaaggggccaaacataatgtgggagttatttgctctttattttcagatagtgaaatcatctcgcagtaaaattgctcttctttcaggctaaaatcaaagtagatgaaaatgagatattgtataacgtttacgctgaacacctgtatttctttgttggttgaaaaatgaccctattaatattgtgcgctcagccaataccataattgctctctacgttgacgaacaaaatacaaactagtgatccataacagatatatccccccatagtgaccagaatacttactgatatgcattatgtatcaggatcagcttctgcaacatgaagagcccatatgcatatcaattccaaaccagttggaatgtcctgatttctttctataagaactgatgagacatacatcaggtgcagcgctatcaatttgcaagaagttgcaaacaacacatagaccttctgacatatgcttcaggatgttgtgaaacagctctgttgaaacaaaagttaatgtcaaaattgtacctaactaataaagttccttaacacaggaaatgtctgtttaggcttggagtacccagatcttattgtatcaagaatagctgtggcaacagctgatgcttccggatgcattgtcatgcacttcatacagacgccaagcatgcatacaatttacctaggacaacaaagtagcgactgagcaaatcgataccatattaccatgtgatcttttatcatatcattgcatgagtgggagcataaaagcagcagcataaaccaaaagcatacaaaggaaatctattttttgaccactccgactgcaaatctttagcttttccaagaccccatttacgagattttcctgatttaagtatttaacttgacatgatctagatggaacctcctctttcataccagtgtgaacaattcagaagtgtcctgattctaagacttccctccaaggacctgcaacaggacaggaggtcccctgtccctgaagtagctaaatttcgagcatgtactatgtcaaccaggccacagggtaaagtatagaaaaatacagatttataccttctccctgacacttatgaagtacaaggatttggctatatgggcctcacgcacttcaacctcacccaaattctcttcagcgtcagcaattcttgatacatgaaaaaaaattactttcagaggaagcaatgattcttgtcaaacttgctagtaactgaaacattagatacagaacaaatgcggagagcagaacggaagatatatgtgaccagctaaaaggggatgtgttgatgactggaaccacaattatactatttatgctctagtgaagttatatatcttgattttccttcacattagtttacattgggtttttttccttggtgaggagggtgcataaattacttttatattggttgggaagttgtgaattgtgatccttaggaatctatattgcttttctacaagcccaattacatcttgtaacaatgaaccaaagcatgcattgatgcacatctgtgagcctggaatcaagatacacgaacactggcaatatactgaagacagaattaggcacttggtatgcaaactctctcaagaggaacctcatacaatacataccgaccccattctgaaacataattcataaattacatatatccagtcaaatgcaagtgatcgacaagttccccaaagtaacctaattacctaacctaaggttcgttgaggaaaacgtatcgtagcaaagacttgagttgtcacaaaatttatccccacatagagagtgctacagcctacagctataagaacagcaacgggcaaacctaattttctgggcaataccgcaataagagtaacatgatgccaaaattgaggggaggaagaacccactcacttcccgtcgagcttgcggacctcctcgtcgatccgcgcgcgcgtagtccggcggccagcgactcgaccgcggcgtgcaggcggggagccggccgatggatagatggagagagacggcggatttgacggcgtggaggacgtcggagcggagggcgaccatggccggcgaggtcgtcgtcggcgtcgggatgggagaggaggaagagcttgcgggccggcacgagcaaccaggtggcgctcctgcttcgcctcctcgccgccggcgtccatgtcgtgccggtcactgacgagtctctcacttttttcagaacattttttttttttgagaacaacgagtctctcactctcttgctgttgccgactgccgagccgaactgaaagaggccatgggccggtttcagccacgaaatgcttttcagttcgaaaaagttctctccacgtcccttatgtacgaggtagagtttcaatcgcgtcgcccaattctaaaaccaggtataagcagggtttcttttcggaaagcaaaaaaaattcggtaggcaccattccgaacaaaatattttgaaattttaacacattttttttactaaatttgaataaataaacaccaaattcacaaatatttggaaaaagcaaaaattcaaaattaattttaatattttataacttattttgtcaaagaaaatttaccaaatcattctcttaatgcaacgcgagaaggtttcataaagtttcaaagaaaaagtgctcccaatcacatagtagagaacaaaacttaatgaaattaatagacatgatatagccgagctatcattactgcaaattctgaaagaatgagttaattaaaaagccctcattgagttggcataaaaattcaagttcgatcctccatgtagtgcgctcctacttcttcatacctagaagacgtttgagcggctccaagggaaagccacaaccatggtatgagttcttcgtttcagggctgcttgccccttcgcctcgataaggaggtcttccagccgtagaccgcttactcttcttctgatttattaacttatctttctgctttgtcactctcgtattctgaataggaatcggcaaacaggtacaaccatcctcgaaaaatcgaacaaccctcttcaccttactcaccttagtgtcttttacctcataagcattttccataattgttggccctacctgatagatattttcaacacttcgagttgttccgccatgatatccagaaaatgttggcatcaatacttgaggcgactggtgatacggaagatttgtgccgggatcgattacaaccgtagttcctcgttccatgtcgtatacacacaacactttcccattgaaccccgagtagtagacgcagttccctctcaagcccgttccctccgtatcaagtgacgctccaaaactgcctatcttaacgaagaacgctctgccacctagcgaatccaccttcacccacgctgctgatctttgcccctgcgttgtcgtcagattaatgctcaacctgtaaacgcctacacgcgcgacaatccggtcacatccgatcgggtgagagaagacaacggagtgcagctccccgtttgattccacgaagcaagtggtgcgtttcttgtacaccgttggtctcctgtcgtcgtcgacgccgtgtacggcgatcttggtgagcgtcagctccggcgagaactcgaggacgccgacaagcccgtcatcgccgatgaggagttcgctgtagaacttgccgtcgatcgccgtaaactggcgtaaaaacctgatgatgacgtcacggtgctcagtgttgctgtgctggtacggatgctgatggagcctcacccagtggttgtcgccggggcggcaataccagagctccgtgtcggcgaggtcgatgacgaccacgacacagctggtcgggtccatgggaccgcagcatgagaggaggcacctccggagatggctgccttcggcggcgaggacggtgccgtcgtggtcggggggcagcccgacacggcggccggtgaaagggtcccataggaaagtgcacggcgagccgcggtgcgccatgagcaaccagccctgcgccgtggcccaccagcggtggcctctcatcatgtcgtcgacgccgccgtcgcccaccctcgttggcgttggcgttggcgccagcagcgctctcttcggcacgctgtagaggaacgtggcgtcgccgtggccgccgaacagcagcagaggagcaagcttgggatccagagcggcagatgcgtcgactgcctcctccatgatttcaacggacggctggccgatcgatctttcggtaattaatccttcgtaggagacggccggtcaatctgtgctatgctttataaacgaggagagtttgtggcagcccgatttaagtgttgtctcgtgatttctgttcgaaatcatccgagaggctttgagaactagtatatatatatattggcatataggaaagagaaacgaagaaatctgcacgcctaaatctgcagcgcccatgtaagtaaatcaggaaaaggaaacatgaattcctacacgtacggcatcaaaattcaaaccaattataatctgcaccgccggtaaatcagttttttggcacggcatagagacggatcctccacattactatgcaaccgacaaaaaccaaccgggtggggtacaaactattacaagcggaagctgacctatatgtgatgcgagtccggtggaaacacgtttccgaagaagcagtgcagcacagaacgcagcacgccatgcaggtcacacgcgtgcccgaactctcgagattctccaatctccaatcacagaggcggccgctgcgacgacggcggcgcagctgggacaactgccggactggtcgtctctcccgttggacatgctcgtgctcgtcctgggtcgagccacccgagcttcgtgtatgatcagtatcatccgtcgcatgcagatgcagtgcatcatcacacatcatctccgtcttggacatcaaaattgagtggaactgtagtgaaccggtgacctcctcctgaatcatgaatcatgcatctacgggctgtcgtcaggagccgtgccctcgtcatcagctaaacttagtcatcagctgagtgactaagtttgcatgtttccgctgacagagatcgattcagcgcggctaaggattcaagatgccgttcctatcaatcaaggcggcggcggcggcacagagagagcaagcgagcgacaagctacggcaggaaggagagaagaattctagcacccggtgttagtatgagtggaagagggaaggacatggcttaacgatgccaaggggcgccgtggcgagatgacggtcgttcggcctcggcgtgaaccaaggagtggcgccacgggcaccggggtcggagaagaggaaggcaaaagcggcgagcttgctctggtttggcggcaaaacggtcgcggcggacagaggggtgacgcgcgcgcgggggaaacggcgagcggcgcggcggtggagcgggagcgccgtccccgtccgcaccggcacatgcgcgacgcgtgcggttgctgggccgtgaccgagcgctgggctgggtcgacatagaaaggaaaaagtacaccgaaggtccctcaacttgtcatccagttacaaaatcatccaccaaccgaaaaaccagatataacacaccccctaacttataaaccagtaaaaactagatccgacgtggcgactgagtcagtgtgggccttatatgtcagaatgccacgtcagcaagccacatcagcaggccggcctgtcccttcctcctctctctctctctctctcactcactcttctctctggcaggccagccggtggtggggaggaggtcgccgaggcgaggaggtccgacagccggccggtgatgtggcggcggcggcgacgcggtggcggagacacgggagaaggggagggcgtcggtagggcgaggcggcgttggcgggcgagcgcgctggcggagaggcggtggcagctgcaacgtgggagaaggggagggcggcggcggagacacgcaagtgccgcttccccacgcgcgcgtgcaggagaccgtcgccgccagctacgacaaccttgtcgccgcggcgcacgggttcctcgcccgggagggccacatcaacttcagtgtctccgccgcgttccccgcctctccccatcaacttcgaagtcattagtcgccgcttcgagctcaaccaaagaaaatgatctgtatgctggaatgcccagagcttccaatttcactgtctgagatatgtaacctgtttggttgttccaggtaaatgcaacaagaagttagtatttcagataaagttccagaaaaaaaaatggcgctatcaagttagttactctaacactaggcaaagttccagagaaaatgacgccaaagtaaacgaatctaaaaaagagcaaaagagatacagaagtttcagtcaaagaatctgaaattcagcaaaagtttcagagattgtgccaagttggtgactctgaaattcagcaaaagtttcaatgaatgactgaaatttagcaaatgatccagctaatgactgaaattcaacaaattttcagttaataaatctgaaattctaggaccaagttacgctgacagggacaagtgaagcaccgagtggaagatcagcacaagaagataactctgaacagacaggactttttgcaagcttgcaaagtgcagatgccaatcctcatgacatctattcttctttggttagagaaggcctgtttgatactggtgatgagattctgtctatggatacaggggaatctgctgatactcctatttcaggcctagcgtcaggtttagcaaatcttggcactgctgatccagctgaaaggggctactcaataaacgagactacaaatgaggagggatacttgattgaaggggatgatccatcaccatcaaacaaagacgaacaagatgaccaaactgatgcacatggtgagtctacgccagaggcccagagccacaagatggctgctccatctcccccagctgccgcccatcttcgccaccgagcgccgccgccgcgcttctccccgtcctccccgtccgccgactccatcctcgctgccttcgtgacctgctgccgccgccgccgccgacatgcgcagcagtgggatggaggcgaagaggctagtcaaggcgcgattctcccgtgcgctccgggagagggccttcttcctcgccggcctccgaccgctccccgtcgcacgaaccctcctctccg

SEQ ID NO: 8966 - DNA, 4810 bp, Oryza sativa
  unsure (1)..(4810): unsure at all n locations
ccccccccgggcgccggcgcgcccaccgggcgcggccctcctcccctgtcggctatgctcctcgacaggacgactagagaagagagaggaagagacgtggtgactgggaggctcttccccgtgtgcaattaagaaagatagtatgggcttgtttggtttgaaaccctaccaaaatattggtagtaccaaaccttaggcacattttggcactaacaaattttttatagtacagatttggctccactctattgatttggcaaaatttggctccaatccaaaatgctaacatgtactattcaaaactaccaaagaattggtagggcaagaattggcatcaaaccaaaatggccctatatgtccctgtgccactaaaatatttgagccctccctttataccattgtcgaattttatcgcgccctccacaccgttccgttgctattccgtttagatttaactatttggcagctctgacatatgggcccgggtagaaaaaatgtcgctcttgccctttcactcagtcttctccctcgattcccctcttctccctcaggcggtcaggccgccgcccagctggggcaccgcgccgccgtcgcctcggcccggtcgtcgtcgtcctgatcctcgtcgtcggtgcgctgttcctcaacctcggtccaaccggctcctccagcttcaccatgccgtggatccgcatggagttcaacgaaccagtccacgttgcggtggcggctccgcctccgccgctgacgcagatgcaagccggcgtcaacacgagcggcgaggacctccggccgacaacctccgcctccgccctgacggcgcgctcgtcgtgctccacgtccagccgccgccgagcatcgccgccgggctcaaccccggacccatccccttcggcggcccgagtaagcaatctctcgcactcgtcttcgcggaaattaggacggacacttggtcctgtggctgtgagctgtggttcttgcgaattttttcggtcgagctgggtgggtctgatggcttcctggatgtgccgcgcggctgatcaggcgaggtcgctggcatcactagtagcaagcatcaatagtcctcgccgccgtcggccgtcgttgtgctggtcctggcatcactagtagcaagcattactagtagcaagcatcaacagtcatgaacaccagtagcaagtatcaatagtcctcgcagccatagttgtgttggtcgtcgtcgttgttgtcgcagcgctgccgcccccgtcgtcgcgcagcactgccgccgccgctgtcgtcgcagcgccgcccccgtcttcgtcgtcgtcgtcgtcgcagcgttgttgccgccgtcttcgtcgcgcagcgatgccgccaccgtcgtcgtcgcagcaatgccgccgccgccgccgtcgcagcgctgcccccgtcgtcatcgtcgtcgtcgcagcgccccgtcgctgtcgcagtgccgccgtcttctcccctccgctccttggctgctgctgctgcatctgaggggagagaggagagtgctaggagagagcatattggaccaaagggcaactaagtcattttactgcgccattacccaccgttacaacaaaaacagacggaatagtgtggagggcacgataaagtttaacgatggcagagagggaggcttaaactttttagtggcacagaagcaggcaccatctttcttaatggcatataggaaaaaacctcgttgactggtgaggaagagacgtggcatccagaaatgtggggctcacgtgggtcccacgctgactcagccgccatgtcaaataaaaccagaacaaaactactaaaggatctaaaatgaacgattttgtaagttgaaggatgtcatatatctgattttacgggtgagggatgattttgtaactcgatgacaagtcgagggaccttcaatgtactttttccacatagaaaggagaggctagctaatcgagtggaacgatttgatcctcaggctagctaatataactctgtcaaatgaaaaggactgctttgtatggtcgctctataagaatggtcaattttccgtcaaatctatgtatgtcgcgatcatgaactgtaatgttcggatcaaaaagagaattctgtgggacttgaaaattccactggagatcaaggtctttatgtagtttcttcacaagaaagtatttctaacgaaagataacctgggtaaaagaaaattggagggggcggagacaaacattgttctttctgctatacacaagagacaatccaacatcttttctttgagtgtcatgttgctcagtttgtttttggagatgtgtgttttttgtttttaatatccccccaccccgtaacgccaaaaacattttcgataattggcttagaggggtatctaggtccattaagaagatgattctaattggagctagcgctgtatgttggtcaatttggcgttgtcgcaatgataaagtttttaatggtaaacaattatctaaccctatgcaggttatcttcatgtcttcctactggctccacttatggtctacaatgctaccacaagaggagcaggatactatgcgcaatggtgctacactcttggaatcggtagccaagggtctcttattccactatgggtggcgtagtttcataagaattgctagctaaaatattttatgtggtttaacattagtcaataataaaggggagttggggatttgtcccatcaccttatttctcattttgatttacttttatcttacatttttattactattaaatttatggctgtgtgtcttatgacagaagccggagatgcaatccatttccattatctaaaaagaaaggagaggcagcccaccagaggggaaaatgtttgaccattttccaggaaattatttgaagaaatttggggtctggtttgatttggacttgaattcaaattggatatttgaactcaagggttcaacaaggagtcaagaaggtaaactgaggtccccatcggttggcttttttcctacggcttattaggaaataaaaatgaatttatagataaaacttttatatacgtgtttttatgacttaaaaaccaatggtgaaaaagaaactacgttgaaaatatcttaaaattaagtttgaaaatttaacatttggctttttctttgactgattaggccatccgatgggagcgtgaatatgaattcgatatttttggaattgggagaagtagatggcaaggattcataggaagggatatttaattggaaacctgaattttgagattcaattttggaatcaaattcaacagtacccaatacatagaactccctcctgcatcgctgttgcctgttggtttcccgcacgatcaagcggacgggtgggcaagtgaacgcggggaacggaaatgctactgagcgatcgcccagggcgattagatttccccctcctctccctccctccctccacctaatttattttttttttcaccatattactttcctattttagtaaatttatacacctaaagtttatacacctcaagtttacatatctaaagttttttttgctaaaagtttatatatccgattcaaatttgaatttgaattcaaatatttttatatatagtatttctatacatctaaagtttatacacctaaagttcatagacctaaagttcatatatccgattcaaatttaaatttgaattagatctgatttaaatttgaatttaaattcaaatatttttcatatatagtatttctatacatctaaagtttatagacctaaagtttatatacccgattcaaatttgaatttgaattcaaatattttctatatatagtatttctatacatctaaactttatagatccaaagtttataagtcaaaagtttacatacctgattcaaatttgaatttgaattcaaattttttatacataattttttctaactttctgtttttttttaccccccgcgcggggaaggcggaagagagaggtcgcaaattcaggatatctcttgaaaaaaaggagagaaaattttcgtgccttaatcctagttacagattcccgagaaaagattttgagtatcacagtcacagagactagaagaatgaagaaaactttggtcaaaaggaaactgggaaaatactactagtagttcataacccnctaccatgcacagagattcaaaatgaagatcaacaaaagcatcnctagatcatcnaccttcagaactanaaaggctagagatgattcgtaacaanttaatcaagggtgtctcagtctagcaaagtagcacacccaaactactactatcaacgggtcggtgctattactcgtctaccactaacaggatcagaattcagaatatataagttcccaatcggaaagaccggaactggcagtggcgtcgaccttgacctcgtcgccggtgttgctgtcgtcagacccggcattggcagtgggatcaacctcctcgctggtgttaatgaagaagtagttgtccacaatggtgatggttgcagtcgacaacgacaccacggtggcttcgtcggcagccacggcggtggtactgctgctgccgacggcagtggcagtggcgtcgaccttgacctcatcgctggtgttgctgtcatcagacccggcattggcagtgggatcaacctcgttggcggggtcgttgttgtcgacatcatcgccggtgtggctgtcagtgtcagtgtcggtgtcgaccggcggaacagcagggtaggcgccgggcttgaacagaaccaggatgacggtcgtgttgtcgcccgatggcaagccaaactgaacaagctc

SEQ ID NO: 8967 - DNA, 482 bp, Oryza sativa
ctaatggacaactgtacacgatcgaatgacttcatgtgaactatgggaaccataaaccatttacaatatatcaaagtgattttacacttttatagtatatccacagtcacaagcatatgtgcttacaacaaaatactttcagtaaaaggaactttcatgcaaaataaagttactcccaacatacccatattgatcaaagtaccctccacgtccttcagtcccaaagtcctctctgaatacaatctgcagcatatatttattatgttcaagcacatgttgttcgcaccatgataatgataaaactttccagaatttccaaaactaatccattcaactttataccaataacagaggatgtcatagatgtaactacagttgacaaataaaaatacaaaggactacatagaaaagcatattacctgtacattagcaatgttatcacgattccaaagaggtaggaacaaacggtttgcaaagcgaaa

SEQ ID NO: 8968 - DNA, 525 bp, Oryza sativa
agcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatttcattgttcctgtgtaatttctgcagcatggatgaggacctgcaactgtccgatgcttggagggagttagttattcctcgtaataatggatggatgtattttctcaaggctgcagcttgtacaagcatttgcaaggtatcttttaaaccctgaacgtcttttaatatccatatattgaaggtactcaaaactgtatttgttggacagtgcatattgtatctatgaaaaaggaaatggaagaatgtgtgtgatatcgagactattgttctttcttgagatgtactttggagttggaagagatatgtttaaccctaaccttgactaattgcgcctattaaaaaaggtccagttagttacatatca

SEQ ID NO: 8969 - DNA, 1940 bp, Oryza sativa
accaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccaccccttcactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgaactactaatataatccatccgtttcacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcggtttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatcccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattgggtaaggtttctatcttgtaatcctgccccccaccctatataaggtgggcaggaggccctctatggggcattgatgacacaa

SEQ ID NO: 8970 - DNA, 4149 bp, Oryza sativa
gcctccgcctacacggctggcctattatgccgccgctgttgggcgtctacgacttcaccgccggcctgcctccgtcgccgccgactggtgtcctggcctatacggttggttggtcacaccaccgttcatgggcgtctacgacttcaccgccggctcgcctccgttgccgccgagtggtgcctccgcctacacggctggtctattatgccgccgctgttgggcgtccacgacttcaccgccggcctgcctccgttgccgccgagtggtgcctccgcctacacggctggtctattatgccgccgctgttgggcgtctacgacttcaccgccggcctgcctccgtcgccgccgagtggtgcctccgcctacacggctggcctattatgccgccgctgttgggcgtctacgacttcaccgaccggccgcctcgtccgccgccgactggtgtctctgcctgcacggctggcctattatgccgccgctgttgggcgtctacgacttcatcgccggcctgcctccgtcgccgccgagtggtgcctccgcctacacggctggcctattatgctgccgttgttggatgcctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttggccgccgccgactggtgtttccgcctgcacggctggcctattatgccgccgttgttgggcgtctacgtcttcaccgaccggccgcctcgtccgccgccgactggtacttccgcctgcacggctggcctattatgctgccgttgttgggcgtctacgtcttcaccgaccggccgccgcatccgccgctgactggtgtcatcgcttgcacggctggcctgttataacgccaactgatgctatcttcttcacggctggctacatcgctgtcactacttataggcatcagtatcttcaacacaagctgcctacgtttgccatggctgccgactggtttcttcacttccatggctgcatgattctgccagtgttgattggccttaccatcttcatcgcctttcgtctcgtctgctgctgactagtgccctcgcctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtcatcatgcctcgacatctcggcatgcgatgccatgttattttactacaataagaggctctccaacattcatgatttctacttggaaatcttcaacacatatcttcaatcaagcaataactattcgacgacaagaggctacagttttcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagctataacattaatttgatggattattgtcactaacatcatcaccagcacctctgcttcatcgaccctgacatctctgctgttgctaatggatgattatgttttcgccgacttattatttcaccttgacggttgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattagtggatttcgccatcactgttgatgcgcgtctacgtcttcatcgtcggtttgcttttgtcaacaccgactgtttcttcgcctccatggttatgcaacttcattacctttgattggtgtcactgttttttactaccactgacatcttccgttacttctgatgagcaatttcgtcttcatgttggtcatttcatctccatgccgactgcgtcagctattgccaatagacaattttgactatgacaaaatgacaagctatatgctcaggggctcatcaactcaagcgtgaggattatatctccaattgggacttgttccggatacattccacatggattcatagtcatgagtctatcttctatgctcaaagactggaccaattattattccccgtaaaggctatcaaccgaatacttgcgccagtcgggattcaattattatatttattttggagtatcccataagggataatcattcagatcagaagctattcatatgagctacacttggtctatattacccagaagatttgttacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagctacttaactttttaggagttggtacaatgcatcttaaaaggtgtcaaacagtaaagctttattgatggactactgt

SEQ ID NO: 8971 - DNA, 16346 bp, Oryza sativa
  unsure (1)..(16346): unsure at all n locations
nnnnnnnnnnnnnnnnnnnnnnnnnnnnnnnnnnnnnnnnnnnnnnnnnnnnnnnnnnnnnnnnnnnnctatgcacatagaagtaatcatgatccatcctatcgagccaccatactgagttgtttattttctatcacaggagctgaagtagcatcgtactgcgcaaaacgatttcacattgagctttgcaatcatgaagactatcacaatgatctcaccaacgcactggacaatgtgttttttaggttattttagcctactttatcattttgtttatagctgcacttggaaatgtgggatatcattgttcttgtgtaaatgctgcagcatggatgagaacctgcaacaatccgatgcttggagagagttagttattcctcgtgataatggatggatgtattttctcaaggctggtgtctgtgctaacttttggcctttcccgcaggtagtaatcttttatcccctagtgtcctcgaatatccatatcttgaagaagttactcaaaattgtatttgttggacagtgtgcatattgtatctatgaaaaaggaaatggaagaatgtgtttgatatcgagactgttgttctttcttgagatgtactttggagttggaggagatatgtttaaccctaacctcgactaattgctcctattaaaaaaggttcaattagttacatatcaattgctggtttacagagttggaggccaacaggttattaagttctcattgcaccttggttcttatcatactatgctacccaaattgaggtattttttgcaacatcccttcgatggctatttctttcgtacactggtttggttttcagaaatgtttttctttacctgttggctttcttgagctattttttggtagccttttccttctatgttgtggttctgtgttttacacttcagttttgttcttgtttttccaggcgtatactgggccagcatatgaagggagcacagcatgtgtggttgtcatcagaggtgaccaaatgattgttggacatgctggtgattctcgttgcgtactctcaagacaaggtggtctggtatagtgattgtttccctattgaatttctggtcgttacctaatttgcatgctcgtttcttgtggtgcctaacatttgtgcttgtttctgttctgtcaaaaggctattgatttatcctccgatcataaaccaagaacaagcgagtctgaaagagagagagttcaaaatgcaggaggaatatctcttggagttgattgtgaaaaagtaatggagaattatgtaatcaaggaacaatggatcctcggttactttggggaaagtgtaacaatctcaagatcaattggtatagttttgcctgagcctatttttcattgattgcatgtaataaaaaaaaccacataacactgtgattggcgttttacctacttacatttcaggtgactttgctttcaagcagaacaaagatttaaatcgtgaagaacaaatgttgatatgtgatcctgacatccacactgtaagtgtaaatatgttcgtttggtagaatataaagtttgttttgccggggtgggatctgatggaaaatggccctttctacgtcagcatgacataactggtgacatggaatttcttgttatagcaagtcaaggcctctggtaagtggtaactcttcagcaaaaaagaactgtcagtaactatttgatcattttgatgtcaccagtactcattggcatgattctttttctcctttttgatgcatatatagtttcattcataatttcatactaaccgcattacgtactgtatattttttccctgcaggtcttgcatggaaagtgcggatgtggttgcttacatacatgtccgtttattggtgagtctttttttttttcctcagtttgtcttcttggcaggacaatatatcttattggtattaattatgctatctgttctaggaagtgacttcaaccaagaaatataaataacctggtttctcttttttatagaataacagtgcttatcccctaaacccccgaaaaccagtactttgtttcgcgctgaatatacatgcctgactgacaaactgccatctgctttgagtttggattctttccctgttaaaactgctgttaccaatattgctgtgaccaattaatattgctatgcaggagggtgtagagctgcgtgtcatctgtgaggagcttgttcagtccggcttggcatcgggcgagaacacgaccgtcatcctggttcagttcaagcccggcgccttccagttccagtatgagctagtcgatcccgctgcctttgacactgccgcctctaacgttgccagcaccagtgccggcccggctggtggcagcgacagcgacacgagcgccacgagcgacgagggcgtcgacgacactgccactgccgggaccaccaccacgggctatgaggccggctccagcaccggccccggcagcggcggcggcagcgccaatgccgcgttcgacagcggcggcgacctcgccgctaacttggacatcgccactaacttcggcagcgacgacctcgccgctaacttggacatcgccacggacatcgacaccgaggacgtcttcaccttcatcaacagcgacgacacgttcggcatcaacagcgacgaggtggagctcgatcccaacttcaggcccaagcctcaggtccgcagggcccacgacggcccctctcccactcccagcgaaatcgaggccgacctcaatgccagccccacgaggtacaatatgagggatatcttcgaggccttcgacaaagtcgaggccgagttgggcggcttcccgttacagggccacgatgtctccagcaccagcaccaaccccaacaccgcgactgacactggcagtggcagccgcaccggcgacgatgacgtcgacggcgccattgccagagccatggccgtggctagcagcgtcatgacgggcgcgggctacgaggtcgactccaccaccaccaatcccagcgctgcggctgacactggcagctacaccggcgacgagatcaaggtcgacgacagcaccagcggcagtgccaggggtgacagcggcgagctcgtcaacaacgacaccaccgttgctgacaacaatgccagtggcgttgctgacagcaccaccgtcggcgacgaggtcgatcccactgccactgtcgcggccgacgacagcaacaccggcgacaaggtcgatccccctgccatcaccaaagccacggccgacagcaacaccagcggcgaggtcgacgtcgacgccactgccactgccactgccagcgccagcgccgccgtggctgatgacgagggcacggctcctgatgacagcgagggcagcccgtagatgcatgattcagaagaaagaggtcaccggttcattacagcttccactcaattttgtccaagacggagatgatgtgtgatgatgcatgcaccactgcattcgagggatgttactgatcataggtagtagtagtagaactaatgcattgataggatcggagtagttggtttctgctaccttgtttttggtttatgactcctggttggctgggtacgtttggggtaggagattttgcttgctagacttggttactgagaacacttgtctggtttttgagtttttatcaaagtacttaatctagtgatgcttttgttgatcttcattttgaatctattacacatgctgagagctgagtatgtactacttgctctgttcccgaattaatgttctcttggatacgtaatcagtaatgcgcttggtttggctgattacctctcttctcttgtctgaactgaagagaattgcgtgctgaaaccggctctgaaaatctgaagccggcctatggcatactccagcaccgcaacagcaacggactcgtcactatcaatataaggaaatcgggacatttctactagttctgcacatgggttcttcatgctgcagaagctgatcctgatacaaaatgtacgtcagtaagtgttctggtcattatggatcactagtttgcatttcgttcgtcaacatagagagcaagtatggtattggctgagcgcataatattaatagcgtcattgttcaacgccaaacaaagaaatacagttgtgcagggtaaatgttataccaaaattcatttgcgtcgattttgattttagcccgaaagaagagtaacttcattatgagctaacaactgcaatttgggtcaattagtactaaaatcaacccaaatactataatctactctctccgatccccaaaactctcttgcttcgtgctgcccaaactcgcaggaccaaatatttatgtccgaggtgatctcccttgtggcagacgaactgtatgacttgggaacaaatgctatttcgctgtcacgtataacaaggtcgacatggatggtctcgggccagtcgtacagcctcgggaggaacaccttgttgtgcatcaacctaagcttagtcttcctcaacatcgtcgtgtatgtcccggtgaacaacgcatgtccttccaatgaccgcatcttctcccactccatcgtctcttcattgagcttgacgacatggacaggcgcaccactgtagccaacgaggacagccatgagcgcgccagcttggtcggactcaaacaggtggctatcgacttggtgttcgattccaaagctcccaggcttatcaagaaccttaaaactatcgccatggttgcacggatcgtacaccgcgagctccccgtcttcgccaagaacgtacagcaagccaccgtggagcaccgggttgctggtcggtgccgccagaatttgcggtccgaagcccgtcaattcccagggcccccattggccatcgtcttgttggatcgcacgggcgagccgtagcgcggacgtcgtgttgacgcaatacatccttcgcgcgcggtcgtcgtagacgatgaaatcgggcgacgagtcgaaaggcggtgtcggcttcggcagctcatggatggtgctgccggcgagtagtacgagatcggcttggaggatcgatttaggtgagcacagcgtgaggcgtcgtccggtggagcagcagatcctagcgttaggcaccttgacgagcgtgtcggcgatctggaaacacttgtggtagtaggggctgtagtacctggcgctcgtgacgccgacgtcggcggcgctcaggaggagaggcgtgatccacgccgggtagaagggcgacacggcggagcgccagtgccggcacgtcgacgcgaagctggggtgggtcgaccacccgagccgatattccaggacgagcacgagcatgtccaacgggagagacgaccagtcccgtcgtccttgcgccgccgtcgcggcggccgcctccatctgtcgatctctgcttgcgcttctttttgcggtgctcctcacgcgagtcgcgagagttcgtgcctgcatggcgagctgcgttttgtgctgctacggagctctactttcatggcgtgtttcctccggactcgtattataggtcggcttcagctcggagattgtataccgccccagcgccccggttggtttttgttggtttgctacccactctccatatatgcaaagtatttagattttgcttttgaattgggttgatagtttgaattttgatatcgtgtaggaactcatgtttccttttcctgatctacgggcggtgcagatgataattggtaggagtactaattgtaggtagtggacgtgcatacctctttcctatgccaatagttatttataaggactagcaaatatacccgttcgttgcaccgggtgaatatcaaacaaatatggatggttaagattgcttgtgtacttataatacatgtgcacaaaaatattgaatttgtacataccttgcaaatatctccaagttttatacaggaaaatatcaaaacatatctcatactgtatacatattcagattcaggtcgtatctcaaactatattccaaattttctacacattcagacaatattccaactttcacaaattttcataaacgggggcagttacagctctgaattcaccatgctctacaaaagaaaaatggtaaaggcatctgcaatgggaaagaaacacacactttgtagtatcgaaataaaattcactcaaaaatctttagtggaatatgtttgaattctagaaataatttaatatttaaggaaataatggggcgttttggtttgataccaaaatattgccatatcaattttttggtagtttaaatagtaaatatgatgatttggtttgaagccaaatgtttggtaatgcctatactcaatttggcacaattttagaatattcttcatgacaattaaaaatttggctctcaattggcataaatccaaagacactcatttataattctaccctaacaaaatattgatagtgtcaaaacttgcctagagtttggcactaccaacataggataataaaccaaacaagcccaataattatatggacatgaaaccatattaacttggtcaaatacaatatcatatgattaatactttctagataaattttttgttggtttcatttatctaaaaataatctatgagtgattaaataattaatcgtaatttcccaacaattttaaatggcttaaaatagtaccaaacaaatttctgtaaatataaaaataattaaatcagttgcttagaaaaataaactgattttggcctagcattgtggtttagggatgaagatttggggacaacttgagggaccaaatctgaacttatccgtgcgaagcatacacgtggcccaattgtgtggcggcctgggaacggcaacccgacgcgggagaagccacactcgtctgatctgatcaacggtcccgattgatccgaacatatataaaaagtcggcagcccaaaccctaaccctaaaatcacttcccctcccttctctctctctcaaacctacggcgtcagcggcgcctctccccttccgccgcttcccctctccctccccaccggcggcgccgctccccttccccctccctccatcagcaacgccgctccccttcccctcccccatcggcagcaccgttccatctccccctctccctcccgtctcgctagcatggcacagtgttgggggacgacggcgacgacgaccatccttccatttcccctctccccgtaggcctcgatggtggggctacaagcctatgacacggagacggcggcgacgacagtccttctctctttctctcctctgtctccgagcaagaagagagcgccggaaggtaggtcgccggggtagagggagggggtgtgtaagttcaagtgccttaatttggtttcggtgattaatgacaaatctaattatatgagactaacgtttttatgagtctttctttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatgcatatgtatgcacatcttgagggggagcttattctattttttttattataagatttctatcttgatttgaaattattttttatctcatctctctatattgtttatatcgggttattatccatcaccaaagagagaaaagattgaaagatcttggattaaacaatttgtgtaattgttactttggtgatagatgataaaccgatgtttatgggattaacttctcttttgtataagttgtctactaggttatttcccgataatgagatgtggaagacatgcatttttttgtgatggaccttaatcatgacaagaatgaaatgcatggagataaaacgatatataccacttcttatctcctacgttttgatatgttcatatatatgatttccatgttattgatatataagtgtgagactaatgtttactcgaatgttatcttatttagtctcatttacattgagaacatggagatcatgaaggtatatgttttatgttagtctacatcattactacatatgtcttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatatttcatatgcacccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcatcatgttggcaagaatgaagtcaagcttgtgatgagaataaagtcctgacaaaagatggacaagacctcggcataaacatggttcaaccggatggttacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaagaggggtctatgaagcgagcttgtggatgatcttgtgccatattagttcctatgcatgtaggtgcattttgtgggcttgtctaaccaagtgtgatgagttttctcaagtcctaaaccaagagagaagtgggcatgtcaaataggagtgagtgacatcttgtgggtatgtccggtggatatcctttggagtgtgagccctttatccttgacttaagttgtgtttcttggatggatttttcatgggttggatggccctttgaataagctttccatatattccaagaacgccaaattccgagacccgagtaagagatatcgccgttttactaacggtcggttgagctgaaaagtgacctgcggtctgaccgtgggccttaggccggtctgaccgggtctgttagccagtctgactggcgtggtaaggccggtctgaccggccccattggtctgttgcactagtctggtttttggtggcgatacagagccgccagagccgcaaccggtcagaccgagccgacagcagtctgaccgagccgtggacggtctaaccggccactacactgcggtcagaccggccaggttgagtgggctcaatgattgccctgtaacggctagttttctagccgttacaaagtagtccggtctgaccggcatcacaacgggggtctgaccggcagaacacaaagttggggattttggttccaacggctagttttgatggttgggggtatatatacccactccccagcagcaagggtaaggttttggcactccattgcattatcttgaacccttgcaagagctctcacacccttgtgcacttagtttatctagtgaggtgttagagagtgagttaagtcaatccaagtgcattgcttcattgttagagctagtgtggcacctgatcatcctcggcaagcatcctagacttgttactcttggaggttgccgcctcctagacggcttgtggaggtgttgcccggtgacctctccgaggagattgtggaggaggcccggcgccggttgtgagtggtttggagttcaccaccttcggagcgaaggaagaactacccctagtgatcgaggcttgggtagtcctctccgtgggccggctctcaccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttattttctgcatttacatttgtgcaatttgcattcatagagacatatttgagcccatatcacctaggtttgcaaaatttaacttagttgcttagttaaccttgcacctcaccttgcctagcaacttaggttagttttgtttaagtgccattaagttttaagaccgcctattcaccccccctctagtcggcctccttgatcctacagggtgccgtgcgcggttggggatgtggtgagtgtggccgtgcccggcgggcgaggccatgacaggagcgcggtcaatggcaatggtgactgtcacaccctgaagttctttcccaagcctaaattgaagttataaatggtctcaagaaaataccagtgtaaagcaagagtaaaccttaataaattaatgcaaataataatcagatttggcatgtgggatttttcttgagttctaaatgtcgaaatacgctaacaagatttttagtggaattttcagagctctagaaataattttaaccaattaaaattgagcacaagcaatatttaatcccaggaaaatccatttccttccttttctttttcttttcccctttttttctttcgaatgggccgccggcccgttctctctccctcctcttcttgttgggccggtcgaaggccgaggcccagccgagctgagccagccgcccgcctccctctcccggggttgccgacaggtggggcccacctgtcgggcccgtccccttcctccggccggagccgccgcgccccgctcccacgtctcccgggccacgtcgcccacgtcgccctcgcgcccgcgttccccgcgcccacttcccctctctcccgcctgcgcccgcgctcgagacagccgggattcgattttcgaatcccgcctctctctcctctcccacttcccccacgtcggccggcgattccctcttctaccggccacgtccgagctccctctcccctatttaagcatccccactctctcctctctctttttcccatttcgccaagctctcccgtgccctctatcgccctagcgtcgtcaccctcctctccgccgctgccgctgctccggtcgccgctagccacctctagccgccgtgccgagccgtgtcgtcgacgccgtcgcgttcgccgtcgtgccggccaccccgtccacccctctcccgtcggattccgccgccggaacccgctccacgccgtgcgccggtgagcatcgccatggccgccgcccttggccgccgtcctcgccctcttccatctccctctccctctctaactcctttcatcgtgttcgctaggtggttccggagatcgtcccgccgtcgccatcgccctccgtcgctcgccgtcgtcgcttgtcgtcgatgaggcacctcctcctctttctctctctctctctctctctctctcccgcaccatctagtcgccgcgccgccgcctagccgtttagccgctgccagcgtcgccgcgccgtcgcgccgccgccgcttgccgtctgccgcgccgccgccccgcggtagcgccgccgtgcgccatggccgccgggccggctcgagccgcccgtgcgcgccggccgcgtgctccccaccgccgtccgatctaccctcgggtagttcggggccgtcggttcagccgcccgcgtggcgtgccatgtggccgccgcgtgtgcgccacgtcagcgccacgtggtgcgccgctccttccccggtccgtggacttggtccaccatgaaccgccctccccgagtcactgccatgtggggcccgcatgtcggcgccgcccctctctctctcccgtgatttatttattgcgcaataattcaattaaggatttttctgtttatagtaaaaacacagtgaatcttctaaaatttatatctaattcatccaagctccgtttaagcccattgaagtctcagtaaatcaataaaaatgtgtagaatccattaaaaatggttttgttctctgtttcagtagtcttatagcctgtttgtattgtttgctttgtatgtcgcttagattccggctctccccacgctccggtgtactttgaaatagtcgccgaggttcctccagcagtagagcaaggcaagtcatgcttgtcacttgaacatgttgatcctatattgcaaatgctccattgttttccttcaaatactgcattgttttataatattaccatgggaagtttacctactgttatagccatgctattttgtaccatgttcctttgttagcttgggatataacatgactagagattggactagggatttcttagccttgcttagttcaactagcacacaatgggggacaacattaatgcatagatatcagattctaggaatgatgttggttaatgctcaccgctccagtgttggttaattaaaatatattaaatggtgggctgtgggtgcatggttttgatggtcgcgcccatggcaattaaggaccggttcgcgggaaatcctggaagaattcctcgtacttaccacaagccagcgtgggcaacggctgagcttgtagtgtagcttttctctagccgacacatccaggcaagggtgggcgtgatggagtttggatgggccttacgacggcctatgcggcttccggattcacctaggcacgagaggggactgcccgctgccttgcgagaagtgggagtgaaacctgaggtgtggtgtgcttggttagaggtggttatgcgaagggtcctgtcatggcctctttccggtatgtcgtggtggcatgtcggcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagggtagtctgatggaactgattagttcaggtggatggttgggcctgttgcaacgtggtgtagcgttggacagtggatggttaatattgattaattactataatggttttacttcttccaactactgtttataaatgctcgctttatgcaaatgaaccactctagctatcctttgattaccctgcatcatacccctatcccggtatgacttgctgagtacagtgggtagtacttagtcttgctctatttttcccaaaccccagagtttgagtatgcgtcagatggtggcttttccgaggagtaggtttcgtccgtgccatcgaggatgcctgtggagtggtgttcccgctgcagtccaagtcaaggctaagctccagatatcttttaagttttccgctgcatttatgtaagacttttataatatttgtaagacgtggatctgtatgtcaactttgtcgtttgtgtaccccggccggtcctggacggggattttaatgcacattctgcttggaattctattcgggaatttctaggcgtgacagtgacgagctcagaacaaccggatccgatggcaaactcgctcatttgtgtgatttttttcctctctttttttccttttttctagggttctcaatctgtgtaactatccgattggatgattcttttagattctccgtgtagttctgtttgataggatgacttttttcaggttctctcagtccgtgtagatctttgatttgattttgtgctttatccatcgtacatgattggtatatagagtgattaataagaacaaaaaaaattctaccttttttatcacggacggtgggtcttcttttctccgtgtcattgatgaatcggacttttcttttttttttctttttatatgatgagggcatcatcaccatggataaaccataatgatgttttacctaatcgaacataaggtgcaagcttcttatgaatcggagaggtgtatcgatcgctaagggcgcaacgcaatgccttgtacggttgtagtcggatcatcaacgtttcttccaaatcgtagttatctcaactcaccgaaagatcggtccaaacaacagctttgagcatcttgagtggagctcagggtttatcattatatatttgttcgcctttttttttatcacgatgacgaaaacaccttcaattttttaagtatttttttaagtagtagagatagagataatagaaagattaaacaagattcgatagacgcatgtgatgatatctctaatctaaaaaatataccaacttagtcttggagattctcatagagatatgttgtgcgtgtgtgctttcatatggatcaatgtgcacgtgtttatatgaatgcatgtatctatactgtgtttcgaaaaaaaatacaacctgttctcaacgctatattgacgtgaaagtaaagtgaaagtcttttttactttcacgtagaataattgattttgtatttttcttatttacttaaagttgtctttataaattttagcaaatgagatattttcaatagactttcatgtctaaccggaggaccgtagcgtttaaaaaggaaagaaaataaataaagaaaatgggaaccgttttctcgctccccttcccaggcgctatctcctcccaccactcgaaccttatcccctccaggcgcctcactcgaaccttaatttcgtgttctagttagaaatttggaatttagaaacacagctggattggggttctcctatggatcatgcttcagattttatttaggtggattagagtcttattcctttcgattttggaacgacctgggctacggactacacacgttaggatttttatcgatctctttttctttctttggccgctgtaaaatagcgaagatagagggccactcagtcggaatcgacggacgaatcggtcggaattgacgcacgaaaattttgtgacgaaaggaaaattttgccaaaggaaaattacgattctttatattagttaagatttatgaatttgatcggccagtcgtccgtcgaaatcatggaggaggcagtcgacgcatctgccgctctggatcccaagcttgctcttctgctgctgttcggcggccacggcgacgccacgttcctgtacagcgtgccgaagagagcgctgctggcgccaatgccaacgccaacgagggtgggcgacggcggcgtcgacgacatgatgagaggccaccgctggtggaccacggcgcagggctggttgctcatggcgcgccgcggctcgccgtgcactttcctatgggaccctttcaccggccgccgtgtcaggctgcccnccgaccacgacggcaccgtcctcaccgccgaaggcagccatcgccggaggtgcctcctgtcatgctgtggtcccatggacccgaccagctgcaccgatctcgtcatcgacctcgccgacccggagctctggtattgccgtcccggcgacaaccactgggtgaagctccatcagcaaccgtaccagtaccgcaaccctgcccaccgtgacgccatcatcagttttttacgcaagtttacggcgatcgacggcaagttctacaccgaactacacaccggcaatgtcggcgtcctcgagttctcgccggaggttgccgaggggaactaattcccctcggcccaccggcacccgttgtcaagcgttatcaaatccatgcaggctcttaagtcgtgtagttatacaaagtcacaaacctgtattatcgacgaaaatctcgttccttgtagattgagatgcatggcctctctgtttactttaaacatcattcaagcggacaacaggtggatgttaatttgcctaaaaccgacatttttcatcttcactaatagctgatccattttgctgtgctacttatttactgttctctgcaatgactgtttggagatgctgctccacaaaattcagtggtgaatagatgtgtcttgtgtatttatcatacatctgttcactttaagccaatattcgagccttttgccctgttacatcaaattgcattattcacttaaataaataggtatgaataaggttactcaaaaaaatgctttcgcagcaacaaatctgacaaaactgcaaaagttcacccttaagaagagggatatatatatatagcattggttctgcacttctgcatgctaaagtactccacatgatacagcaggctggctttccatccataaggttacaaatgggcaggattgccgtttctgtttgagataaaccaaaggagttgcaagttagaataaagcatttatagtcacatcatgcatacagtttcagtactacctccgtcccaaaataagtgcagtcgtggaaattcgtgtctaacgtttgaccgtccgtcttatttgaaaactttatgatttttttaaaaaaaattagtcagacataaagtactatttatgttctatcatttaatagcaataaaaatagtaatcataaaaaaatttcaaataaaacgaatggtcaaacgttg

SEQ ID NO: 8972 - DNA, 9824 bp, Oryza sativa
atattcacctccatatttctatcataacttatgaaacggtaatctaaattaaacataggtctaggatagtatgccaggtcttgtagaaattgatcctaaaatatctaaagattcctctaccatgattcatgacatagtaaatctcccatcatgcggcctgaatttgcttaaggactcaccaggggaatcatatgactgatcattgtacaagttcattgctgcagcccaacctacaggggaaaagcagcaaaggtttattatcacataagaagaatggttgtaaataaagttggttcaaaattagtacagcaactgtaggaatacatctttgttatatatgcctagaccatccttgattaaaagttgcctaacttccggtaaattaccggtggcatatgcacaattgcacataaagagaacagttgatggtatgattaatgaacaaaaaagataggataagcagtaggtacacagtttgaatattcttccatgttactaacatgcagagaaccccaaaataaatcacaacaggtgctccacgtatttttctttacaacttacagtatctgaatattggattatcagcctgtgtaaacttattaaagcaatgggcggttctgtaatatactgcatgtgcttttactacttactccctccgtcccaaaatataagcatttttagaccacgacatagtattcgagatgctactttgaccaacaatatctataaaaataaaatggtttaaataaaaagagttgcatataataatagtttgattaatgataaatttagtaacatcaatttcacattattgattttttttatttttttgctattaatagttaaagttaaaaatggttgacttagcactatgctaaaaatgcttatattttgggacaaaatgagtaatatcttattactgtagacataatgtatcactaccacaataacatgcaacaattcccagaaagtcaaaaagataagaacttatatcatagaacttctacaagcatttaaaagggcagcttggtctctgagaaacatacggtcattgagaagctgggcagcctcactggcacaacatccctccaagggtattaatcttgtttgactgtaatcattctgaggattgctgaaaaaagtctcatgagggataattggtggaaggttctttaatgaaggagcatggctcttctctccatcattattgtacaaataactagccttctcagccctatctgtttggtataacaaaagtgttacagtgtcagccaaaaaaaaatcacctcccttttataaattaaattgttatgcttaaacatacagataaatcattaaaaaaacacatggataaggaaaagatagcccataaaaaaattattggaaatatgaataatcaaataaagacatgtcaaggttagaagattctggacagctattggacataataagtaaactctgagtaaaaaacacatttgacttgtaaatgactgattgtggggattatgattgcaggtagcttgcattagatgcatgaagttgcatgttgtacagagtattggcatcattaatacaatggagtagaggggctcatacaaggatgtttgcttgcaaggatttccttatagatatagagtagttatcaacatggtcggtgtaaggcacatatttttcagcccatttgtggaaaagaaacatggcagtttcactgcatagaaatctactagaggaataatgaattaagtttgataccataacaaccaacaactggataagaccttatcaactaatttggagaccttatatagcagtcaagccaaaataataataaaggaaaatataataaatccccaaaacatcatgaaatccaactgattcaataataattgcgtcgattgttagcacggttcctgaagcatattcagtaaagatagccatcagaaagcatatctatgcatgatatgtagcaagattattaaaactaaataataactaacattagactgcagacaacagaatatttcaagaaataactgatggtttcaaacaaaataaatatttagctcataaatacaaagatggaacaaagaagccatatcaagttatcaactaatcaaatcaacaaggtgatagactgattgaacaatatgtcttaagcaaatctacttcttcattgtgaactccacttataattgtgaaattgtgattacgcgatcacctatcaaagggcaattttcaatatctggcagtacagtaactaaagtatgatagtctttatgcagtcattatatgccctgtgttgaagtcatgcgttaaacttatacaagctgaccgactggcagagttttgctaggcaaggttagcttaatccgctaacccaaattcgaaacatgggcaatccttcacttgctaaaacaggtagttaggtcagcattaaacatgccctgaaataagccattagccatgtagcttgaacaaagatttttctaaaataaataaaagttagttgctaaggttgttcattctcaaaaagctaaaaagagagaccagcgagccaataagccttataggtcggcttccgcttggagattgtataccgccccggcgccccggttggtttttgttggtttgctatccaatctccatatatgcaaagtatttagattttgctttagaattgggtagtggtttgaattttgatatcgtgtaggaattcatgtttccttttcctgatcaacgggtggtgcagatgattggtaggagtactaattgtaggtcgtagatgtgcatacctctttcctatgccaatagttatttataaggatttatgaatttgatcggccagtcgtccgtcgaaatcatggaggaggcaggcgatgcatctgcagcactggatcccaagtttgctcctctgctgctgttcggcggccacggcgacgccacgttcctgtacagcgtgccgacgagggcgctgctgccaatgccaacgccaacgagggtgggcgacggcggcgtcgacgacatgatgagatgccaccgctggtggaccacggcgcagggctggttgctcatggcgcgccgcggctcgccgtgcacttttttatgggaccctttcaccggccgccgtgtcgggctgcctcccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccactgggtgaagctccatcagcaaccgtaccagtaccgcaaccctgcccaccgtgacgccatcatcaggtttttacgcaagtttacggcgatcgacggcaagttctacactgaactacacaccggcaatgtcggcgtcctcgagttcttgccggaggtggcgttcaccaagatcgctgtacacgacgacgataggagaccggcggtgtacaagaaacgtactacttgcttcgtggaatcaaacggggagctgcactccgttgtcttctctcacccgatcggatgtgaccggattgtcgcgcgtgtaggcgtttacaggttgagcattaatgcggcggcaacgcaggagcaaagatcagcagcatgggtgaaggtggattcgctaggtggcagagcgttcttcgttaagataggcagttttggagcgtcacttgatgcggagggaacaggcttgagagggaactgcgtctactactcggtgttcaatgggaaagtgttgtgtgtatacgacatggaacgaggaactacggctgtaatcgatcccggcacacatcttccgtatcaccagtcaccccaagtattgatgccaacatttcctagatatcatggcggagcaactcgaagtgttgaaagcatctatcaggttgggccaacaattcaggaaaatgcttatgaggtaaaagacactaaggtaagtaaggtgaagagggatgttcgatttttcgagggtggttgtacttgtttgccgattcctattcaaaataagttaataaatcagaagaagagtaagaggtctatggctgaaagatttccttgtcaaggggaaggtgcaagcagtcccgaaacgaagaactcataccgcggttgtggctttcctttggagccgctcaaatgtcttctgcgtatgaagaaataggagtgcactacatagaggatccaacttaccttttatgccaactcgatgagtgtttttttagttaactcattcattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttccttcgcgtcgtcaagtcgatgtcccgagagagatcgatctctcggacgcttgcgtcgtcatcaagcggcagtagcagagtctccggtcatcatcagtctgcacttcgtcctccacctccggtccgccgcctccaccgcccctacctccgatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacggaccatttgagcacgtagggctggttgttactgtgctgcttgctgctgcatgtatctttttttttcccgatcagagatcgggtttgcgtcgtccaccgcctcgtcgatatctacgcgtctctgacatcggcatcgacttcgtcgtcctgccccgcgcatcttcggcttgatcacccgttcaagcgtccgactacaacgacttctgtaaccgatcgtcatcgagcatgcgtctacgccatcaagctctgggttgccgctgtgtcgcctccttgggccgcagtgccgctgcctatggtccacacctccattggctattgcaacgctgagaggcgcccttctcagcgtggcctcaccgccggtggacttctcgccgctgcatcgacatggagctgcagctgtgctgtcctctcggaccatagctttgccactttcgtcgtcttcatcgccgttcgcgcatcgacaacctcgtcgtccgcactggtcatagtcagccgctcggggtctccttcctctacttcaagcatcgccgccgcatctccaagctgccactgtcgccactctaggccggtggtgcagctacctctacatggctaccgatgtcgccgtccaggccgttggtcccgctatttcgccttctactttgtccagcatgactcatcgccagcgtcgccgtatcttcctcgactacacttcgctcttctccggcaactgcgtgctgctccggcaattctccctctacgccgttctcgcgctgcgactgtcccagaggccttctctgctagtctcctccgacattggcgtatgattcatggtggtctcctgtctcgcccgcgcggtattggcaacaccggcgcgcgcgtttgtcccgagttgtcccggggtctggcaagccctgtgtaacgtctcgtcctttacggttcgactacattggctcttcggcgtcatcttcctcaacgaccgccgcgattgtatcaccgtcttcgtctccagcgcgtcctcacgcaccattggtccacgatgccctcccgtccatccacgaccactctacgacgccccctgcgccttacggctcgactacctcgacatcatcgacttcccgacttcggctacatcgaccacggctactctacgcacggcttcatcaaccacggctctctcggctccttcgctttggttacatcgactatggcacaaagggctatcatctgtgttgagtactctttccggtttcttctccagtccaagtgtccgcgctgctcacgcttggactgcgggggatgttagagtatatggtagttagagtcatattaggataggattggtttgtttggattccttccatatatgtaattcttccttatcttctccccatgtactcctatatatatcggcccccctgaggctcaatacaatgtgtccaatattcgcagtatcctctctccctatactatctaacactgccgcgcctgtgccgtctgtgcccgcgctgccaccctgtagccgctccgctccacaccgcccctagccgtcatcgccggcgtcatccactccggccccgccctccgtgcgcgtgcgtccaagggatggaggtagagccctgcctcatcgctccttctccctccttcctttcccgttttggcaaggagtgccccccctttctttcttctttttcttctttttcctcccctcgccggcgtcatcctctgtcgccgatttggccgcgtgcgccgagcgccagccgagccatttgactgcccaaggtcggttctcccctcccaaaccgacatcgccatcccaatctctcttgttttcactctccaccgctgtcgcacaccattgtcgtctcgctgtcgccgtccgtcgctgagcgtgccggaggagctggcgcgttcgtggacgcgtgacgtgaactccgcgctcccgcttcatccccttcctcggccaaaacgatcacgtttcgcgccgtgtcctctcttcacggcgccctgtcccgtcgcggtatcccctccgttccccctcctcgctctccctcctccccgtagcacacccgatagctagtaggcgccaccccaagccccgccgccgctcggcatggtctcgccgccattgccgcccgtcgcttgccctcctcggctctgcttcgtccaatccgacgctaggaacgagtcccggtggtcgtgtgtctgctctagcttcaagaaatcgaaccctcgtcgtcacgtcgtgctttccctcttttgccgccgccgacgaacaccgccgcaatccgccgccgtcggaagggcgacacggcggagcgccagtgccggcacgtcgacgcgaagctcgggtggctcgaccacccgagcctatctaggacgagcacgagcatgtccaacgggagagacgaccagtccatctgcttccgcttctttttcgccggcctggctggtgttccacacgcgagagttcgtgcgtgcgtgcgtgcgtgtccgcgatggcctgcacggcgtaatataggtcggcttccgcttgtagtttttgttagtttgctatccaatctccaaatagatgcatactggagtactagtacaattaattttgatgtcgtgtaggaattcatgtttccttttcctgatctacaggccggtgcagattataattggtaggagttactgattgtaggtcttaggtgtgcatacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatcatggaggaggcagtcaacgcatctgccgctctggatcccaagcttgctcctctgctgctgttcggccacggcgacgccacgttcctgtacagcgtgccgaagagagcgctgctgccaatgccaacgccaacgagggtgggcgacggcggcgtcgacgacatgatgagaggccaccgctggtggaccacggcgcagggctggttgctcatggcgcgccgcggctcgccgtgcacattcttatgggaccctttcaccggccgccgtgccgggctgccccccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccagtgggtgaagctccatcaacatccgtaccagtaccgcaaccctgcccaccgtgacgccatcatctggggattacgccagcttacggcgatcgacggcaagttctacaccgaagaactctctggcattgtcggcgtcctcgagttctcgccggaggtggcgttcaccaagatcgccgtacacgacgtcgataggagaccggcggtgtacaagaaacgtactactagcttcgtggaatcaaacggggagctgcactccgttgtcttctctcacccgatcggatgtgaccggattgtcgcgcgtgtaggcgtttacaggttgagcattaatccgacgacaacgcaggagcaaagatcagcagcgtgggtgaaggtggattcgctaggtggtagagcgttcttcgttgagattggcagttttggagcgtcatttgatgcagagggaacatgcttgagagggaattgtgtctactactcggggttcaatggaaaagtattgtgtgtatacgacatggaacgaggaactacggctgtaatcaatcccggcgcacatcttccgtatcaccagttgtagcgcccgttccgtcgtggcgcctagcgggaaaattatctcttaaaaaccctaattgcgaaatttgtttccttgctcgttgtgtagtgtccgtgccatctcagatctcaaatccccgatctatcatcgagttcaattccgaatccaaatccttccaaatcaaattcctccgcaaaagtctagtttgcctcccccggggtcgatgg

SEQ ID NO: 8973 - DNA, 4891 bp, Oryza sativa
tgcccgcgcgcgtgcgcgtgagccgcccgcgccgagccgagccctcctcttcgctccctcgctgccgctccccgcgctcgttcgcgcgcgcgcccgcgtggttgccgcccgtgccgcgccgtctacgccgtccgcgtcacccggtcccgctgccttgccgcctgcagccgcgccgccgctcggccccgcagccagcgcgcgtgcccgagccgcgccgctccatccgccgcgcctcccgttgcaagccgcgcgcgcgtgccgagtggccgaccgcctggtcgccgccgtcgtcagcgcctgcccacgcctgtcgcccgtgtcgccgctccactccaaaccgccccgccgtcatcgccgtcgtcatcgcctcggccccgccactccgcgcgcaagccgccaaggaacggaggcagagccctcctccctctgccgcgacgcccccgctcccctcctccttttcccaaagaagaaaggggcgagccccccctttctctccctcctttttccccttttcctcccgccggcgtcatcctccctccgccctgtcgccgattggacgcgagtgccgagcgccagctcgcgccttgaccgcccaagtcggtttccaaaccgacattgccgccctttaaggccccgggcgccctccctctcttctcctcccatcgcctccactccattgttgctgcccctctgtttcgctgtcgccgttcgtcgttgcgcgcgtcggaggaaccggcacaagcgaggacgcggaaggggactccgggcgctcgtcttcctcctcttccccggcccgaggccggagagattactctcgcgccgtcggcctctcgtcacagcgcccctcctcatctcggtagtgcctccctccgttcttcctcctcgctccatctcccccccttagttttcggtagtagctcgagtagcctccccgtagctagccggcgccgccccgaccgttgccgtcgctcgctgtgtgctggccgccgtcgccgcccgagctccgtagcacccgctcgtcgccggcctcgctcggcgtagctccgcccaatccgacgctagcaacggattcccgtggccgcgtagatgctctcaccgccgggatttggcccctcgtgacctcgtcgccgtttcccccttttctttccgccgggtgccgccgccgcaatccgccgccgacggactccctccggcgaatccgagccgttagctcgctccctctcactctccctcgtcatcccggtgtacgccccgtcgcccctcatcatcgcaaggcgtccccgagaaaccgccaccgcccgccgtccattcgcggccgacgccttcgtcttcctcccgccagcccacgtggcagccacgtaggcgccacgtcggcgccagctcgaccgaggtcgggtcgggccgaccccggtcagcccctcccgtgcgcacgttctaccgcgagccgtgaggctgcgcgtgggcccgccgcatccgttcctccgcgaaccgcgcgcgtgcaccgcgtcccagccccgcccgcgcgcgcgcgccgcgtgctcgctccgcacggtgaacggagtcaccgacaagtgggtcccacccgggaccacgcgcggtgagcccggtccaccggctctctctctctcctccctcccgcgcgagcgcgcgccttgggccggccggcccatttagctcggccagaccgccccaattctctcgggccgcgccctagccgcccgagaaaagtctatattccctccctcttttcttttcttttattttcttttcaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggaccgcacttaatctgtttgtcccgtctgcaaggcagattggcggacctacctagtttgttgcatttgatccttcctttgttaattgttatatcatgtccccttgtatccatctagttgtgtctcgatattcgtgcaccctgtgcgagtatcgacggacgccttcaaacttaaaatttgaataacaacttgggtaaaacttgggttttacaaaagacttggaaaacccggcacctgggtcggtgcttgcgaactaaatgaatttccaaaaccgcggaccggggaacgtaccgggagtacggtttcccgctcttgcacttaaggaccgtttccttggaatttcatccaaacataagacaagtacgaccatatgggtggaatgggacacccctagctgagtaactagcttatcaggggagccttgatgccgagagacatgtggattcgccgaggtggtgtcggggaggactctgggcttcctggcacagtatggtctgggacctaacctgttgttggtctgggacccctctcgtcggcatatggtaaacctgtgtcggctttggaaatgccttgttatgaaagcttggaggtctcccgatgtggctgattcccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattacggttgtggaaaggggttcgatgtttgaaaaatctgcagctgatgggatcagctaggcccgggtggccgtttgaaagttgttggcccgggtggccgtttgaaaaactgttggccgggtgccaaccttgattcaattctaaagactgatacattgcacatactccgagcggacgagacgcactgtctcatccgtgtcgtttgagaagcactcacttagttgtttttagaaaagagttcaaataaaatcaattgcaaaaacaacagcctttcctcgaagcctgcattaaacacttatttcccatggcttgttgagtactcccgtactcacccttgctctatataaataatcctccccccccagttgctgaagaagatgaagcggaagctgctgatgagtagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgaataacaggttaatttggagcgtcacgggctagttccggtcgggactagttcggggcgtgacaccagtcgcctcaagtattgatgccaacatttcctgcaggatgttacggcagaccaactcgaagtgttgaaagcatctatcaggtagggacaataattctgaaaaatgctaatgaggtaaaagacactaaggtaaataaggtaaagagggatgttcaatttttcgagggtggttgtacctatttgccgatttttattcagaatacgagagtgacaaagcagaaagataagttaataaatcagaagaagagtaagaggtccatggctggaatacctccttgtcgaggcgaaggggcaagcagccccaaaacgaaaaactcataccgtggttgtggctttcccttggaggcgctcaaacgtctcctgggtacgaagaagtaggagtgcactacatggaggatccaacttacctttttatgccaactcgatgagtgtgtttttagttaactcattcatttagaatatgcagtaatgttagctcggctatatgacgtctattaatttcattaagttttggccactactaagtgattgggagctctttttctctgtaactttatgaaaccaaaccttctcgttgcattaagagaatgatttggtaaattttctttgataaaataagttagaaaatattaaaattaattatgaccttttgtttttccaaatatttgttaatttggcaataatttattcaaattcagtaaaagaatgtgttaaaatttcaaaaattttcgtttggagtggtgcctaccgaaattttctagctttttagaaagaaaaaatcctgcttatacccggttttagaattgagggccgcaattgaaactcgacctcctccataagagacggaagtggacttttccaactgaaaagcatttcctgcctgaaaccggagagtgagagtcagagactcgttgttctaaaaaaaagttctgaaaaaaaagtgagagaccctcaatccctccccaaccggaacacccactccgacgagaacgacatggacgccggcggcgaggaggagaagcaggagcgccaccgggttgatggtgcttcgccttccatggtcgccctccgctccgacgtcctccacgccgtacggcaccgcaccgccgtctctctccctctctctctctccatccatcggccggctccccgcctgcacgccggtagctgacgtgttttggtttttcttttcttttctttttttatgcggggttggctgccggacgacgcgctgctggccgagacgcgcgccgcggatcgacgggtcgtgttactcttattgctcagaaaattaggtttgcccgttgctgtt

SEQ ID NO: 8974 - DNA, 5528 bp, Oryza sativa
attgcagataatagcaccgaaaaaaaaacatattatgttgtgatttgctgatgtgttgtacccacttacatttcaggggacttcgcttgcaagaagaacgaacgtttacctcctgaagatcaaatgctgacatgtaatccggacatcctgactgtaagtgcaactatgtttgtttagtatttggttgaatttgaagtttgtactgctgtgtggggtctgatggaaaatccccctttctgtgtcagatggacataactgatgacatggagtttcttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgtgactaatatcttgcatgtttacgtcaaaaaaatatcttgcatgctcgattgtttcgttgttaaaactgttgttccttttgctgtggccaaatattgctgacttgctgtgaccaattaatatcgctatgcaggagggtgcagaagcgcgtgtcatctgtgaggagcttgttcagtttggcttgccatcgggcgacaacacgaccgtcatcctggttctgttcaagcccggcgccttccctgctgttccgccggtcgacaccgacactgacactgacagccacattgacgatgatgtcgaccccaccggcagcaacaatgccaccgcgtccgacaacaacgaccccgccaacgaggttgatcccactgccaatgccgggtctgacgacagcaacaccggcgacgaggtcaaggtcgacgccactgccactgccgtcggcagcagcagtaccactgccgtggctgctgacgagggcactggcaatccttctcatggcgcactagttgacaccgacgacgaggacgggctgacctactcccaggacatggacttacccccggcgtcgacgtcccccccaaccttcccggacgaggacgacctcccccggtctaacccggacaagtcccccccgcacgtatcaatcttattcagagtttgagtccagatcaggaaaggccagaagctatagctatgattcggaaggagtagttcgtttccacttgatttttgtctagcaagtcgaagatgatgtgtgatgatgcatgcaggatgatacttatcgtaggtggtagtagcactgtgcattgataggagtagtttgtttctgctaccttgatgatgtgtgatgatgcatgcaggatgatacttatcataggtggtagtagcactgtgcattgataggagtagtttgtttctgctacctttggtttgtggtttttgcctgctgctttgcataggagattaagattttgcttgtcagactcagataacttcaattaactgtctacgaaatctcgctcactggtttttgagttgtgaaggtgattgatctagtgatgctttttgttgttgttcattttgaatatctgtacatactgctgggttatgacttgccccgtttctgaatacttagcttttaaccaaattttctcttcattcttctagttatcttgaatatgtaatcagtaatgtgcttggtttagcggggaagtctatttgtccctgaaggacaattccttctgctgcatgccacccaaaaactcatcaaaaagtttgaaaaaaagaaaaggacgagatagatcgaataaataatatcactccacaaatatgcaagcttaaatttgacacatataagtagaattagaactaagtaatttgattgtgaataatacgaaaaacttttttttatgtcaaagacaaaaagctagggcgaattctcattgaatctcggttgttcatgatagtgatgaccatccattcaaatcttcaggtagcacccccaaatcttcaacaaggcggaaagttcgtgtgttaaaattgttgttttttgttttgtatatgttgaatttgaacttacatgtctgttgagtaatatattactcctacatgttaatttatctttaaaatctttaatgaattttcggatgacatacatacataaataaaaccggagacaaatccacctctttggttaagttagctctgttgcctgctgagaccggctctgaatccggcccatggggaccgtatctgaatccggcccatgggctgttaggccgtagcgggccgcactcctctttcatcagttcggcaacagcaacagactcggcatcactcacccacccaacccagtacccaagccccaacctcgcctcgcctcgtctcgagccgacctaaccgcgaacccccaactccgacgagaacgacatggacgccggcggcgaggaggcgaagcaggagcgccacctggtgctggcccacaagctcttcctcctctcccaccccgacctcgacgacctcgccaaggtcgccctccgctccgacgccctcgacgccgtcaagtccgatggcatggcgccgctgttcgagtcgctggccgccgcgggcgtcctggagccggacgacgcgctgctcgccgagatgcgcgcgcggatcgacgaggaggtccgcaagctcgacgagaagtgagtggattcttcctctcttctgattttattttactagcaaatatgcccgtgcgttgcaacgggtgaaaaaacataatgataatatacatttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgcccttttttgaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcatggtttttttattttttttaccgcgtcacatataattcctttttctttatcggaaagttttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggaaagatttgttttttttccacccggtttttttccgcccaggtttttttatcggaattttcttttttttttttgctccacgatacatataattcatttttctttggaataggacagttttctttttatttttttaaactctttttaccgcgtcgatgtagtcggattcgtttcggtattttttccttttttttcctttttttttgtcggacatatttgtttttttttcgcccggttttttttcgccaggtttttttatcggacttttctttttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggaatcggacatctttttttttcctgtttttttcgctgtttttatttatttgtgacggacgatggaagcacctcttattttttaagtagtagtagatttttagccccccaaaaattaggccgccccttgctgtgttgcgtatgcgataagttttgcgataactcaggtgttgatatggtccgtttgcattagctaacctagcttactctgtgttgcgagatgtagatgctaaaactggtagatagcttgcatttgattcggtagttgtaatttatgaattatgtttagggccaattaattcacctctatgcaaatctatactacataataataaactttttccacatttttgttttagattcatgtacatattcatgattttgtacattttctctgcaatgtgtaatttagcatgtagagaagtaattgagattgctaaggatcacaatacgcaacttctcgagacaaaataccagtgtaaactaatgtgaaggaagaacggcatgttgaaatttgttagaaatagtttccttgagaagttgaggttccagtcaagatatgtccttttggtgatttgcatgtttcattgtttctactttctgatcttgctcttcgcatctgtatctaatatttcagttactagaagtttgataagaatcatttggttcctctggaagtaactaagtaattatgtttcatgtatgaagaattgctgatgctgaagagaatttgggtgagagcgaagtgcgtgaggcccatctggcgaaatccttgtacttcatgagggttggagagaaggtataaacttgtgtgcttctatactttacattaagtgtgtgcttgagatttagctatttgcattctttgaaatcaatattgcag

SEQ ID NO: 8975 - DNA, 6731 bp, Oryza sativa
tgcaagatcgataaggttgctggtgttctggagacaaaccgacctgacgctaggaatgccttctaccaagcgaccatcaagcaaggggacttcttgctgaaccgcatccagaaactgtcacgagtcattgacttgtaaattcaatggtctacgttggacgttggaggtgtgatccttctagatccctgcaaagctccccatggacataaaccgtactgaaattgctgttctacttgtactcctaggctcatgagaacatgatctttatctcggtttgattttattgcggacagcaaaaaggttttaaagagaacctccgtgtgcaatttcagtaagtgtgctttagatttgtagaacgagaagagtgcatgtctttctgagatgaatctgttcgttcatttcaagtcttgtggcgatgtctttttggggttccgcactgtttgatcttatgggtctctatatgcttgaaatagcctgacatgctagtctcaaaagagaactgcaaaatagaaccaagcgtaattccttttgttctgagcctgttttcagatgcaacatttcagaaaacagataaacagcattcggtcatacgcaatcgcgcgcacacactgtacagccactgtaactcatcagaaacgaggtcaatatacaacagtaattttcgccgttccataagtccataaaataccgatttctaatatcccaggagactctagctgcagatttagtaaggaagaacaaagcaagttactcagagtcacaggcaagctacacattgtttgttgcaaaaaaactcgaagtattgaggaactacacagagctaatctgggacagggaaatgagcacactggaaaattacagccggctgttcacttgacgatctctggtatgctgcgctttacaatcagctctccgtttctgcagatcagaaatggtaaccatgcaggcaggtcagaacgtctgtgtttgatggctatacaaaggcctagagattcacacaagcaaaatcacaggaagcagtaatgtagtttagtgtaggagcattgtctctctttacttactgatcccctgcttctggttctgcttctccttctgtttccgcttcctctcgtttcgcctcttcacccagggcttctcttcctccactggcgcttctgcctctgcgctgacagatcctgtaatctgcgcaaacgactctttggcgccagaggttacgtcgccgaagaagtccttcaccttgtcaaccacagttttgagctcttctttctttgggagctgggataatcaaaacattttactgttagtgacttgctacctttgctcaagacatgcttactgaaaacatggtcatttgtacatttactataagaaatgcctaccatcctcacttaactgcatagaagttcttttccaggacaacattttctgagctactatctagtactaggccaaaataatttgaaggttgtgctctagaaaatgtcagcctaggataaagcaagatacaagtctgaaatgtacattttcagagatttcagctctaatgttcatgagaaattgctactcctacataacttgcagagaattcgacagggagaggagataaaaggcgctagcgaaacgtacttcgatcacattacttgtcgtcagcgcagacctcaggttcccattctcctgctcacccaaatgagacaggtaaattgcaattctcaattttttcgagtgcaacaacatacaatcacgcacagaagatgaggactgagaaaattaccacaactttgtagccatatcgaaactcattgtcggtcttcagcaccctgtactgctcttttgctgtgtctattatgtcatcctcatccttcagaaatcaaatcatgaaacacgcacatttaaatcttctcttttctacaactcttcaaacacgattgtgtgacaatttgtgtaagcaaacagattgtgctgttaattactttgtagatgacagcggcaaggttcctggcgagcgtgtccttgtagatgtactttccgaggaagttgtccttcgccgcgagcatgatcttcgccgtcgtgccgccggtgacgatgttgagcgggtaccagaagtacacctgcagaaaccagaaaaaaaaacccacacaaatcttgatcacacgcacgcgaagcattgggatcaggaatggagaagaagaagaagaagaagaacaagaatcagggcagcacggacattggcggtgcggatgaagatgacgaagcgcgggttgccgtcgtcctcgatcttgggcagctgcggcatgcgctgctgctgggaccgccggtccgaccaccccctccccctcgcctccaccaccagcgccgcccgcctcgccggcctcgccgccgcctgcagcctgctcctcggcgccgtcctcatcagcaggaagctccccccgccgctcgcctcgccgggcgacagctgccgcagccgcgcccgcgccggcgccggcgaagacgcgctcagcgacgacacgccgcccaccacctccattgaaacctcctattccggtctcgcgccgctgtgtggtgtacgtgttgtggccgccgacgaggacttgggagaagaagcagtggaggggaagaggagggaagataaagccgtggaggggagcttatctggtggtggtgagatggctgtggggtcgctgatgtgtgggcccgggtgggggttctggacccacttgtcagtgtgccagtgagtggaccgggattatgcggatagtttttgagatggtttcgtgctctcggcatacgtggcgtggttacggacagctgaaataaaggcacagtagcagtcgcgtggcttctcccggggacgccacgttgcacatggaacggcctcccagtttatatgttggaacacatcaaatttacaaaattcttgcaaaaagataagtttaacagattactcgttggattattgttactgccgattatatatttgatttatgaatgaattaatgttttaaaagtaaactttataaatggcttcgaacaagtgatctatagaaaacatatttaagagacctagagtaaataatctgtgacaataatccaataaagtagctaaaaagcccgtttaatccctaaaatttacttatatgaaaactatctgttctaaaaggaggcctaaaaggctaaaacggagtgtaaacaaagctagaaagatgtaattattatgtttaaatttaaatggtattatttgtagacaatgaaaagcatttttttccgaaataaaattttagaagtaagcaaatacacgtcatcgagaaattgaacttacgacgtttccaaacatctcatttcacatttcaattaaaaaaaacttacgtacagatgctaagctacaattacatgcaccaccttttttacgggcgaacaaggcgttcgtcggccaagagaaatttactaagatcaaattaatggttacaaagaggtttaccacaatcaacaacatcgttgatgaaacctcacacgtttgcaacggacttctgcttgtagcatcgaaatgccggcaattttttccccttccagatcaaccccttcttttttctgctacctgattctcttgactctcctagctaatcgtcgatcccctatatactatgaattaattaaaccccttacgatgatcacattaagactaagggcaccacaagtctgcaaggaagcaacaggtagtcaatggcgaatctgctcttcatctcgtcgtaacccggccacaatgacgccatctcatgcacgtcgtacatctcctccatgcagcgtgccaggtacacgacgctgtatcccgtcaccgcctccagcccgtcgtcctcccacggcagcggcggcggcagcccggcatctgccagggtggtggccgcgtaccgcgcgaggtacaccgccgacgccgccacgacggacggcgggatcctcaggctccggcggtcgagcagcgtgaggtcggcgaggtggtgcgccacggcgtgcacggcgtcgccgccggagtagccgtacctggcgaggaagtggtcggcgaaggtgtgcgcggtggggcggcccagcctgtacccgagcgcgtcgagcaggtcgagctccctgtcgagcacctcgctcctggcgatggcgagcccgccggcgccggcgccggcggcggcgtcgccggcgctcagcctctcctcggggaggtcgccctcgtacttggccgcgacgaagacggccgtggcgccgagcagcgcgagcaggcggtggctcaccgcctccaggggcctcaccgactggtagcggtcgacgtaggcgacggcgcggtggagcgtgccggcggcgaggccggcgtgcccccgggtgatcccctccatccacgccacgagcgacgcgcgcgtccacgggtcgacccggccgcgctgcaccgcggtcatgtagtccggcgacgaccgctcgccggcggccatctccatggcccggaggctggcgtacaggtcggcgtcgtacgtccacgccgcgcaggcgcatctctcgccggcgcagtagctcccgtccgtctcgtcgccagcagccgctccgccgggaccattggcggcgacggcggccgcgatctcccggagcatagcctcgacgtcggcgtcggcatcatccagatagagataatccatggcgcgctctgggcgcggagctaggccgcgagctcggtgatggattcttggaagatgggaagagagggagacgacgtgctcgctgcaaatttatagcgccacggatatgatgatgaacccgttgactccgacatgatcactgcgatgcgacgagctcaagagtccgaattggagttgacctggcccgcaagtccgacttgatcccgtactgggccgagggatacggcctgtgggccggcctgctccggccttgggctgcagctagctgggccggcgactccgtggagaccatctccgggcaaggaatttttttcatttttaatttttttcttttaatatttacagaaataatctatcggcgcaaaaaattacaaaaatagaccctgccgccctagtggtgggcggcaagctgacgtggcagacggcggctcgacggcgccgtctgcggccgtctgcgaaaattgcatttagccggcaaggggctaaatgcaattttcgcagcatttggctcgtacattttgcatctgggtcccttgccgccctactagacgtaccagccaaaaagtactaggcccgggctgtcttttttgcatgggggcccttgccgccctaacagagggcggcaatggttttcgtgcaaaaaaaaaccctccctcttccgtctgccgtcaccgcccgtccctccccgtttgccacgtcagcttgccgccctagtagagggcggcagggtctatttttgtaattttttgcgcccatggattatttctgtaaatattaaaagaaaaaaatttaaaaatgaaaaaaattctccgggcaagtggcagtaaaaagaaagaacctaacacgtgcatcaggaacatgcttagatctgcgagcacagtggtcagcttagccatgtggttcatgcactaatcggagtacataatacattagtacatgaatggtgattattctgtataatttactgttatatacagcgtagtactccgtactagcgagctggatattgagttcttgtttatgggttcgttgagacgtcagcgagattaggacgaagacgtttagtttatcataagaccatttaggtcatagaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccttaaaagacacatggtttcaccacacctggaaatatatggcatatgtgg

SEQ ID NO: 8976 - DNA, 10250 bp, Oryza sativa
  unsure (1)..(10250): unsure at all n locations
ataactttttttattgtgtatgttatagatgacttaaagtaacattttaattttactatatattaatgaaagatatttattattaaaaatatagctgatgatactacttcatctaattaaacatagacttatattaccaccgtcacataaatcgaaggagttaacttttatcccaaaataatagaagaatttatatgtaactgagagaaagtgattttttttaaatactatcacgataatccaaagtacggtatcatactttgacaaatatctatagggtagtgcatgttagttcagtgtccgttttgttttcagcacctattgttctaatcacatgagacacctttagtaatttggataatacatatgtacacttaaattagcgttatatattcgtcaagtggtttcttacactaaaatgtgatgtggaattattatcataacattaattattacatgccggctccatatttgtgatgtatttagggttatagatattaatagtttatttatttaaaggaatacaactgaatcacaaattagatatataattttaaaataatttaaaagatagaacgcttaaaatcattgattggatattttatatttacatttgtgtaaatttgaagattattatattttatccttaaattgttttttaggtattatccttaaattgtagaaaaatattttttaaagacctccgattgttttactttatcataagtattttttttccttccgtcagacgatatgtaagcattattgttttttttcaatcataactacgtacagagtactttttccgatcaacagttatatatttttcatgtatccgtatataggagagttgtattatttgtcaataataaatctaatctaatggtgtaaaatgaaacaactaaattgttttcatttaaattagcgttgtatattcatcaagtgatatttgacaccttaaaatatgatatgaaataaaaaatatcatagcattaattattatatatattagtcttgtatgttaagatagaacgaataaagatcattgatggaatattttatatttataatataaatttagtttaactacgtatatttgcataaatttgtagagcaatatatttatcttcaaatagtagataatactaattcaaaaagaccatcgatctttttccaatgatacatatttttttattgtttttatagtaagtgattttgaaaatactatttcagaaaaccaccgtgagtagatttttcttggttccgaaggacagtaggtaaacctcgtttcttttcccaggtcatttgcacgtactgactgcttatatttcccgtatacatacatacatagagtaatatggtgttttcaaaataaaataaatataatctaatggtctaaaatattgggttaaaaatcgacggtgatatttgcttaaatttacagagtaatagcttttatatttaaatagtagaatactccatttttaaagataattgattttttcaatggtactatgtatgtatatttttttagctttattgttttctatagtaagtctgtgcatagtttttttttttataaacagtaggtaagattgattgttttttagtcttatgtatgtacgtacctatatggagtatatacttttgtttttgttttctttttctggtgaacagtaaggtattagtttatttttaaataaaatacatctaatctaaccgaatggtccaaattattgggtccacttatttaagtgaaaaacgacgataagattatgtgatttctttctttttctagcctaacagttatatatttctcccgtttacgtagacatagtaataaggtattagtttttaaaataatatacatctaatctaatggttaaaatattagattcacccatttaagttaaaatcgacagttatatttgcttaaatttatagagtaataggttttatctttaaatagtagaaaaaaatctatcttaaaaataatagatttttaatggtagtacgtacgtagtttttttttggctttattgttttttttatagtaagtgtgtgtgtattttttttccttacgatgaacagtaggtaagattattgattgttttttagtctttacatactacgtacgtacctatatatggatatatggagtacatgtgctttgttttcttttttctggtgaacagtaaggtatttctttctttttaaatatataatacatctaatctaatctaatggtctaaattattgggtccaccgattaagtgaaaatcgacgatgtaattagacattgccacgtggcggtctaggagcgtttgtaggagtgccacgtggcggcttgagagcgtttataggaagtttaatggacttttatttagtatatatatataatagatagaagatagatagatataagtaaaccaaaacaaagaaaattcgtccctggccacctcacccggccatgacccacatacgcctcgatcgatcgaaattccgatgaagcttcttcccttccatcttgatgtcccggattcatccgcacctggtcagtaatatcgaattatcgatcatcatcccggtcgatcgatcgatagcaaccgccgatcagggtggtataaattctatacggctccgctagctagctagcttgcctcgcgctcgcttccaaaaattaattaaccacaaaattaattaagtagctagacaaccacagccgccgtggccggtgcgttctgatccaccgcgcgatggctgccgaggataacatcactggcagcggcagcggcaatggcagcagcagcaacgacgaccatgcgccgccgccgccgcagcagctcgccgttgcccgcggacggcggcgtgctgaaccgccgatgcgcctctccgcgctgtacctcatgctgttcggggcgaccgtgatcgttggcgccgcgggcgtcggggcgcccgtgacgccgctgccacggctgttcgcggcgctcgtggcctggctcgtcggctgcctctcgctgctcgtcccgctcccgccgccgtgacgacatggccggtcgcgagcgctggcgccacgccggccgggcgcgcgcgcataccaatcgcgcgttattggctatcgattgatcgatcgtttcctcgatatacgcacgatcattctatatcgtacgtaagccgcgcggtgaggtaccgtacgtttaaggagaggactatgggtcggacgtccggacgatgttgcactatacgttaaaaaatgttacaatgtttcattactcgaaaaaaaatatttcaacataaattgttctggatgtttcatctttcactaaataatgtttcaccgttttatcgaaaatgtttcaatcgaatgcaacactcaaagaacactgcctgcaacaacaaaaacacaatatgtgaaacatccaaagaaatcaaatgcaacatccacagtactgagaaacatctaaaaagacaaattgcaacatcacgaatacactatgtgcaaaaaaaaaaaaaaaaaacgtgtgtgcaacaatcatgcgcagcatcctcctcacctcttcctcctcctcgtcccacacctccgacaggtgcggcctcctcagcgttgaggaggacgaggaggcgccggtcggagcaaagccgatccggcgaccggctgcttcctcctcggcggaagccaccgcgaaggccggggcctttctggcgtcgtcctcatccgagcgctgccgccgaagcccactcacgatggagacgagctcggcgtccacgtcgtcctcggagaaggtgaacccgaagtcctgcaacttcagctccaacgacatgctccgccgccgccgccgccacctcctccccgaccgccgcaacgccgccctcctccgctccagcactgccgctgccgccgccgcctcccccggccgccgcaacgtcgccctcctccgctccggcaccgtcgccgcctcgtcgctctgcatacactcgcttcctctcgttgctaggtgagagagaaaaggggaatggtggagagaagaagacagagaaagggggaaagtgggtggggagagaagataggggagagtgctggcatcggacgcccgatttaaagcgttttcgtacgttttctcctccacggaatttcagctctcgatcgactaagtaattaacccgctatatatcaaatgccgcgtaaaggtacaagcttggcgaaaatttaaactctgtgaaaggaataggtatgttaattgtctaaaagaataggtttatgctcaaaatttaactatttaatttgctggcttgtcgggtgttttgggttaggcaacaggggggtaattcttaatttggacctggcaaagggcgccaaactaacaataatacaagatcacaattaagacggagaaaaagtgctttaagtaactttacctaaaaaaacgttttaaacccaatagagcgtgggaagaaggtggagttgcgagttcatgattctaccttaaatcttaacacccacaaaatagggctttatgtgtatctctgttctctagttagtttactagacaaaagttatacttttctctactgctgtaaagagtagagtcgtcattctcttctccaaccatattagccaccacataagaaaacaatgtttccacgaaaaaataatcaaaaattaataaaacggagagatttttttttttttagaaactgagagataaaactgaaaccaataaaaccattcacccatagttctcctaaccccgttgcaaaagcacgggtatgaaaaagagctcctagggtatgtgctatatcattctcctgcgtgatagttatgaaaagattgaactatggaatgggcaaaattttattttagtacaatggctactctccattctagtgcaaatcagagttttcatagacatgtcgtttttccccttccaaaaactgagggctttttggtgtatttctgcggtgtctgttggctcttaatttattaagtattttcgccgacatcaacgttagtctgcagctataaattaaaactctatattaattaaaaaaaaagttggaccggatcttctttagnttggttcttcttcagtttgatctttaagttctatcgatgtaacgagcaagatattctatgtatgccattaacaaaaattaatggcttgttcctatatatttttcaaagatggcttgggttgacttagcaatacaaggctacatggcttatcgttattcttacagtgcgatgatcagtggcaaagccaatgcccaaccaccatgggcagttgcccagcacatgataagagggcggacaagctgcatcgttgtggtgttttgaacggctgttttgaacgatgccggtggctagccgtacagtggagtttgcagaactggatttttttttattttagttcttttaaaaaaaacttatttataaataggtatatggaaaaacttattttagaaatacacccttttctcagcgttagggtcattggcgctgacaaatgtcttgacgctaatgacattggtgccaacactcttacctcttatcccttgggaagctaagtcactaatgtgaggggtcgatgccaataacattgtgccgaggatctatttgtaaaaaaattcagaaaaattgaaatataaatgattttttataaatagatcctcaatatcaatgaattaacaccaaatacctttttgcaagaaaaatcggttgaatgccattggtgacgaccgcagtgacttagcttcgcttccgtaggaggcgagggtgtggtcggccttgacgtctgggtcactagcaccagaaaaatgtccgttcttggaataagactttttgaagggtccaaaaatatttttttaaaaaagactaaaatgtaaaaaggtgcaggtttgggcaagttgtaaaagaatttactccgtctatgccgagacgtcctcctccgttgccgccgacacttttgtttaaaccccacgggatatatttatattaaagtagagggaaacgctgtacaatagccatgaaggctaggaggttacaacgaaaagagtaaaaagaaagcggttattggggggggggtgtgaacccaaaaaggaggcgtgcggattattattacgaaaatagatgcacaacggagacgaattttacgtggaaaaccattgtggtaaaaaaccacgagcatcaaaccggcaattatcagtattgatgagttgattacaaatgtagaggaataacaatagtaacgtcacccttttttacagcttacaacaagagtgtatgtgtgtgtgtgtgtatatatatatatatatatatatatatatatatatatatatatatatatatatatatatatatatatatatctactactacttataaaaaataaaaaataaaagaaatttccatcgtccgtttgggaaaaaaaaagcgagaaaaacaaaaaagaggaaagaaacatcaatcggcaaaaaaaaaaagtccgacacctctgttagaaaaaaaaggagagaaaaaacaaaaaacgaagagaaaaaaaaatggacgtccgactcccctgtggagaaaaaaaaaagagaaaaaacttctaccgtgaaaaaaaagaaaaaaaacgtcgactccttgagaaaagctacgactaccaaaaaaaaattatcgtccgtaatcttctcttccacttatactactttactttttaaaaatatataatataaaaattgaagatgtttttgccggtactttgatacgtcattcatgtataggtcggtttttaaatttgttcgcttttagaaatacagatccgtatttgagtcagtttttaagtttgttcgcttttaaaaatatataaggaatcctataagaaatcatttttaaaaagttgcatgttaatttgagacgatcgaactcctaattgcgattgcagctcatgattttctaacaaaatatatatccaagcgaaattaaaacgatgaatttcatcttaactaaaccatatctatataactaatataaatattcgtatttttcctttcgtcacatctaatttcatgttaactaaaccatatctatataactaatataaatattcgtatttttcctttcgtcacatctaattttcgtcctgttcgtacgcaatccgtctcagttagcaatagccatggaaaaaattgcaaaaaaaaaaaaacggtggccgccaacgccaccactgccgctggagggagaagagaggcggcggagggagccaccgctgcaggatccgccaccgctgacggattcacccgcggacgaagccgacgccgtcgtcgctatcgacgccgccgttgagagggcgccatcgccgtcgaggccgacggggagagggagagggggagtgggagggacaaccgtcgccgctgtctccggcgcaccccgtcgtcgctgcgccgtgccagagagagatggtgccggtggcgggggaggcggccggcatgggagaggggaagaggcgggagatggggagagggagcggcgccgatggaggggaggggaggggaagcggcgccgatggggagacggggagggggagaggcggcgtcgggtgcggggttgncgncgggctcgggtaggggggagggggagggttagggttatggttttcatcaatttctaactgatctgagccgtccatcaaaacgaacggctcaaatcgatcgagggtttgggccgcacgcgggccggtggtccagcaagtgagatgaggagtatggggtattaagtagacttttacgcttgcgggctaaagaagaaaatgggttgaaaaaggcccatagagaaaaatgatttttatttaaataaatgctgaaatgatatttgtattatcaaaattaccaattaagctatgtaaattccaagaaaatttcaaagagtgtaattaatatagaaaatttaacaaaaattaaatccaaccatcatattttatttctcacacttaatttacttgaaaattaatttaattatatacctaccaacataaaaataccctaatattccagaaaatgtgtatttcatttaattagaatttaatatgttttaatttaactgttgtttttttcctttctgttgcaacgcacaggcacttttgctaaaatttcaaagtgtgtaattaatattgtagaaaatttatttttcattaaattagaatttaatatgttttaatttaattttctcattttttctttccgttgcaacgcacgggcacttttgctaaaccaaacaacacttttggttaatatatacactccgtaatcacccggtgcaatgctcgggcacttttgctaatgtgtgtgtgtatatatatatatatatatataaaagaaaaacacctagtaggaaaacacatgttttactagaaaattaatccgaatatgttgtagacctaaattaagatcacatatttaacagtcaacctgagctacacatacacgatgcagctctgtcacaggttcagcatctacaccacatcaacatcaatcgtcgtcgtcggagtggatcgctgatgacacacgaggactgtggcaagacgaaaacgacggagaactttttacggtacattatactgtcagtatatactagcagtatttgtaagagcatgttaggaatttggcaaaaaattaggaagtattttttagtaattttatggttcagagttaatccaatcctattaattagtactcgttcgcctgcgctgttggttctcatacgtgcgcctgcgcgattccatggcaacggcgccagcgtgattcgacagagaataggcgcgcaacggcgattcccgttcagcacttcagctgctaccgcgtcccttgcatcttgctactgtgttcacgagagactaggcgcgtgtggcggtatcaaatactacatagtacagtagatagttagctttgtcagtgttaaagtgttaatgtttgatctctacctgatggtcatgtactggcactggcttgtgtcatcaagctgtgtgacaagtgacgactagtccatgcttaagcatgcgctgattatgtactaatctattgctgcatgtacctttgccatcttcagattaaattgttcagaataaaatggcagagaacgatagtactttggtctggccatgtagcctaattaggctgcggagtgctggagaatgactggctagttgcctttgcgtaagtgcgagcgattgtggcggcacggcgctagcggggcatgtgattgcgcgggcgtagcagtagcctgacgagcgagacgactacgacggcgatgcggagaatccggggtgcgtgcacgagccgcaagaggcagatcgatccatagatcatcgggcgctaggcaagccataaggcaggagactgctaatctactatttgtctattgcaatatctctagtgttcatggtggctggcggcaacggcgcggcgtggcatgcgccggcgacggcggtcgcccgtcgtgaagacgaaggaatcttggaaggggaacgaacagagacttttttttggctgagctagagcagaggaaacgttagaacaaataaagacaaatttaccctttcaaattttataatgcaatttaattaagtgaaagatcaaatcaatctataccgttagattaattatactagcagtatatactaccaatatattgtaccgtaaaagtgctcaaacgacgaggaccgagcaaccgcacgggttcgataggggatgaagatggggaatatgggatggctgttccatgcgtgcagcactgcaatgtcggcgagtatctccaccgtctgttatgttgaccgcgacttcgcaagcacatgttacgtggtccgtgcatcaatcacgctaggcatgatcccctgaccgctataaaagatcgctaattctcaccagagctggaggttgtgctgctctgccaaacggcgaaaacatgttgatgctgtttagcaatgttaatttcgccaaaaaccttatccaaaacgaggatcattgctaaaattgggatatgttgctgcacgtcttcttgtttggtgactttgtgttatgtagtttaatccataatttggtactaaggctgaaatgaaatgttgctgggccttactgttttcatctcatcaccatgttctgaacttatgtcgatgttcgctgtttattcccatcgattagcagttgtgtcagattaatttctctgtaattacctcagcgcatgtgaaatgatgcattatggcgtgatggactaatgt

SEQ ID NO: 8977 - DNA, 250 bp, Oryza sativa
ctttgaagcatttgttctatctaaattccatttaaggtcgtaccttatcgcccagcatcatcttattctctatttgtatttcctccatctttcagataccgatgtagcctttgatgtgcccgtgcccaatgaagaggaagagcgcaacatgaaacgtaagtacaaaagtacgggacacccacccagatcccaatagaatccgccaaatcctgcgggaaattgtaatcccattcaccagctcctacattta

SEQ ID NO: 8978 - DNA, 7225 bp, Oryza sativa
ttggtttttatgggacagagagtatttaacaatgtatcaaatgataggaaaagaattaatcattactttttttttaaaataagacgaacggtcaaacatgtttaaaaaaatcaacggcgtcaaatatttaggaacggagtattatatagagtaaaatgcactagtggtccttaaacttgtcatgaggtttcacttagatccacaaacttgcaaagtgcacatcgaggtccctaaacttggtttatcgtatcattctggtccaaagcgtcgtttgaccgtggtcttgcctatgtggcacaccacgtggatgatgacatggtgtttttttttccttttccccattttctttttcctcctcctcttttatcttcttcctccactggagccacgtcgagctcccccgtgccgaccgccgccgtcgtcacgtagcgttgctgctgtcgaaggaagaggctgaagaagagagaaatgaaagaggaagaagggagaaaaaagaaaaaataataataatgtgccatgtcgttgtctacatggcatgccacgtaggcaagatcacggtcaaatgagactttggaccgggatgatataataaaccaagtttagagacctcgatacatactttgtaagttcgtcgacctaaatgaaagctgcttacaagttcaagaaccaccggtgtgttttactctattatatattacaactttaatggagcagtttgttgccaacaaatgctaggtatgcacaaatattcattcgatctgttttcagtattgtgtcgcccctctgcaactacgtgacttctaatttcagcatgattttctttcaaaatgtaaatcatatgaatatttacttgtttcttagtttcttttttcaaaatatatcagggagatataagataattattaatatgttagattatgcactctctgttgctatgaaactacaccaccattggtcagacgtatcaaggatttctaatatctgtttcctaagcaaaggagaaaacaaaaatcattaatgttttcattcctatcaccgtatgattatttctacacttgattattttgatatctttcattcttgtatgctctttgcacctgatccatgtagagaaaaatctggtaggactaattgatatgcacctattcaaagaggttaatatggattgtggccaagccacatactcgcactgaccctgctgtaaaacggcaaaaaaaaaaaaatcttatccttgacgattggcttgaacaataattaagaatgttatacctgctttcaggtaagtggtctgttatttttgaaatgaacaagcggttaacgggacaagtgatgatcaagttctcgctccaaaaaaaaaaaaaagaagaagaagaagaagtgatgatcaagtgtggtgtgcaagattttgtcacgctgtggaaagaaaatgagaaagttgacattgttgattcactgagaggtgtgttattgtagtattcgtgcgtgtatttttgtccactcttaagaatgattcttgatccatgcatatacttttttttcttttttttttaaccttgatggaaggaacgttgaatgatttgttggtttttgcgtcatggaatgaattttgtgcattaactgattagctaagttacttgttgatcatacaaggaattaagggtgtgttcgctattcctggatcccaaccggatccctccgcacgaaaaatggagcgatctattagcgcgtgattaattaagtattagctaatttttttttcaaaaatagattaatttgatttttctaaaacaactttcctatagaaacttttttttaaaaaaatacactatttagcagtttgaaaagtgtacgtgcggaaaacgagaaagatgagttgggaaaaatggtatccgaacacaccctatgtgtgggtatcgacgtattgatgtttttaaaaaatcccatatcacgatatcaatgtatccatatcgtcgtagcagtatcgcgtatccgtgcatcaccaatggcggatacaaagggtggtccgggtggtcccgggaccaccaaaaaaagggcgatggaaccccctattaattataaaaaaaagaaaatagcgacaattgaaaagaaagaaaagaaagcgacataatccatattccctaatgccgacgcgctattccctaatgatggctccagagaccccacacacgcgtatggaatcgatctgatcgacgcgatcacgactctctctgacgcgatctctctgacgcgatcacgactctctgtctctctcctcatcgccgccctagcccgtaggccgtagcaactgccctaggccctagcctggctagcgacgccgacgagccgacgagaggagagacgacgcgtcgacgccgcgacggcgcgaccacgcgagcagcccccacgcggccacggccacgccgccgcgcgcgacgccgtgaccggcgacctgctgctgtcctgctgtctgctgtctgtttaatagtgttcgtcagttcgtgtgccgctggacgccgccgcgaggagccgtcgtcgagccgatcagccgcccgcgccaacacaaggtaacaattttagttttaggttttctaattgtccacctttttcaatttttagttttaaaatcttaaactcttgtgcattgtgagattaaattgtagtattatattgtagattgttgattgttgaatcatgaagaaagatggagttatcgtatcgctttttctttaaagtggatgaagaggatataatgaacactttcatggccattagaagacgtagacccgataagaagaaaaagtaatatggtaattttctttaagctttcatagccgtacaagcttctttaaatcaaaattttacttaattactaattttatatattttaagatgttttgttaatatatcatggtaagtttttgataatttgatctattttattacttatagttacattgtatatattagtatcgttaggtttactgtgtttagaaaaaaaattttaggtcggaccacccatatcctaaattctagatccgccactctgcatcacaggtgaacatccattgactgatcgacgtttgccaataccggtcggaaatttgaagatcatattaacatgccgtgttgttgttgacattgcccaagtgcatgcccacgaaacttcgaggaagcttcgtagatttgccattcacggcgtaacggaacaccggaaattgtcttaaaaattgtcaccatccacatgcgtatccatcgtcggctggaacaccatggtcggctggaacaccatggtgctggaacaccatggtcggctggaacaaattcaacttcccgtatcctagttgactggaattgaaggtacaatttccaacattcgcttccaaacaaggcctataaagtcccatcccctcgacctctcgccattgtccacctgccacgtacggcccaacccgccaccgaattcgattgctccagtgaccatggacgacgctggcaacagcagcaaggaggcggaggcgcaggcgccggcgccggcgaaccaggcccctgccaccgccgccgccgccgcccgcggcgcgattcatcgcgggccgatgctgcgcctcgccgcgatgcagctgatgctgttcgcggcgtacgagatcgtcagctcgtacgccgcgccgccagtggcgcttccccgcctcttcgcggcgttcgtcgcctggctcgtcggctgcctctcgctgtttgtcgcgccgccctgaagggctgcacgtttcatcggaggttgaaagcatagccatcaggtattcaggattaatctatcagcatcaatcatcagcggtagtgtggtgtaacggggctcgttttttgttttttttttcttctttatgtggagtgggagtatgacgttctgcaggtttatttatgttgaccactcgttgtttattcggacttgtttgtccgtttcagcagtaggctactgttaggctgcctgtatcagatttctctgcacatgagagcaggtaaaatagcatgctattagccagctataaatatattttaatgagataaaagataagagagaagagcagcgggctacagatctgtagccagttacagcacggactccaagacgcagtgtgtatatgacaggtgggaccgtatattaatagtatagtaaacaactattgtatgaattgactattagatcggctatagatgaattggagcaggtagtgggctatactattaaacttgctctgacgcggcttaatttttttacctcaaagcgtttgatctaaatgcttttttattggtcagtgtgagtgtgacagtttatccggctacgacgcagcgtcgcaggctcgcagcgctgagcagcagcagcagagcccagtgttttggccgagaccgagcgtccccggccaaaacagtacgagcaaagctgatgctaactagtactacgagcaaagtgtgacagtttatccggctataattctgtcacgagcaaaaataaaattgctactccctacgtttcacaatataaatcattctagcattttacacattcatactgatattatatgtctagattcattaacatcaatataaatataggaaatactagaatgatttacattgtaaaacggaggaagtatacgagagcataagaaacaagaccaagcaggagggcgatctagatcaccatgccattttctgcaactggacatgctttggaccaagcttgtccgatctggaaatagacaaaggctatagatgttgttgggtcagagactcaggccgaagccagataaaccgagccccgaaagcccacataaacaggggggcaaaggcagtagtagcagcggtattaaactgtagtacgctaccgttatgtgcaatcggttttgttaaatcatattcaacccgcaaagacagaaacatgcaaatcaagcaactaatgtatatcaagaacaactggttggatgagcttgcagcatcatgcaatttattatggcacattcctcacatcagactgaaaaactgattcagtgattccacaagcagaatagttctacacaaccaaaactgaacttcaaaacatatgggacagtatcaggtatatctacactgagcttcgatatctccgcatcccgtttcccagaaaccatcatcactagttcactcagtcttcaattatcctttttttaaaaaaagttcactcaatcttgattctcgatcagcttcttgactatgcttttaagagctggtgcactagcactgcacttctgatcgacgaagcatgacctcccttccttcagccgccttgcatagctgtggatccatgggcaccttgccaaggaaaggtactcccatttcgttgcacattttctccgcaccacccttgctgctatcaaacacctcgctgcatgcaaccattgtcaaaagctcaggagctttctccttgatatagttcagcgcccattctgtagcatccatctcgcctccctcaccttgcttcacgaatctgaaatctgagagaacctgccgcaagccactcatgttctccacaacacctaagatcggcacaccaaccttcttgcagaaatttatttccttccgcacatcgattagagagacctgctggggagtggtcacgattattgcaccatcaattcctgtggcttgaaggtactgaacgattgaaatatgttcatctgatgtccctggaggagcatcaaccacaagatagtcaatctccccccaatcgacatccttcaagaactgtttgatgagtccgttcttgcgaggtcctctccatataacagcatcatctgggttgggcagcatgaaaccaattgacatgacaccaaggttggactccacatagactggtgaccaaccaaggttgctttgatgaatatcctgaccttcaaggcctaacatttttgggatgctagggccacatatatctatatcaagaaggccaacctggcagtccatttcagcaagggcaaatgagagctgggctgaaaatgtactcttccctacacctcctttcccagacagaaccagtatcttgtgttttactgtagccatccgttcaacaataccaaccaagtctacaaacacaatcaggcaatacaatcaataattatttcactgtgtggacgaaagcagcagtaattaatattgtctatgaataacaatcggtcatggctaaaattaggaatgcgagaagtacgtaggaaagaaacaccaattatattcatgaaagaatttacttgttcaactacaatttttgtaacatgaacttgtcttcctaggtgctcaatcacatgagttcctttttttaagtggcaatactgctgtgaaatattttcatggataagtggatatcactagatgtgttctccgtattgggtttccaacaaagttttttctttaacattcttgatgcactccattttttgtatgttaaacatttaagtatttccgagtgccattctatttagaaaaggaggcagctgtgtttcaactttcaggtgggacaccagatcatgcacttccatttctttccctctttaatgttacactcacaagtaaaatgtacttcctgacagtacattagatttggaaaatcagtaaggaccacatatttcttcatgggtttgggattgggtttggctccagtgtagtaataaactaatgatcatcatgctttcaatgtcagccccaagccttgctacctccatcactcacgttgcttctgtttttttaaccatctgaactatctacctaagaacctacaaggtgtttggttgtactgttatatatgcaataaggtagaacaatagatttatgaaatcacataaaaaacactgaagacatatcattgtggtatatggcatcttcatgcccaatataaaacatcagaactgacagaacaaagctggttggtaaatatcaaaggtaaaaactatccataaggcatagaacacaatcaacatgatccagctttggagctggtagattagagcattgggcctcaaacccacatcgcacacacccaacaaaaccatacaatgagatgaggagcataataaatactttcatcccgctcctatgaaaaattttggatgttgactactaacaaccccaattttcttccttcagcttcaactgctcaacttattcatacgagtgctcttgtaagatgtatcaccagcgaggaataggt

SEQ ID NO: 8979 - DNA, 4326 bp, Oryza sativa
tgggggcggtggcgcaaatctgctggttggggcatccggcgcaggcatccgccttccccgcctcctccgactgcgtcccagggcaatctgcagaatcaaacacttatcgttagggttgcgcatagcagacacccatccctttttccattgcaaggcgatcgaaacccacaccaaaccgaacggaaacaggggggaaaggtagcaatcgagtcttacgctcgttggcgtccgccgggacgtcgctcttgccgccatcgccgccgccgccgccgccgttctccatctccctcgccgcctccaactccgcctctcgagttctcgttactttctcgcgaggtttgctgcctggtttggggacttgaagcctagagagcgacggaaatgaggagaaaaggagtatttgtgagagagaagggagaggctggtcaaagaggatatggagcgtccgattgtgatcgaacggtccagataccggttgtcaaggacaagtttgcatctcgtattctcgttgcatatccgtcgcgcgcgctctctctctctgtggattatttttttccgtgattttttttcccgtggttgactttattcctaattaaaatataatggatgatttcatattttagaaaaaaaaaacgaggtgatccaaagatattttaactactctagaagagcaaataatggacccatcgtagtagttggcaaagtatgattcgaccataaatactctcttgtttttcaaaatccaaaataaaatacagtcacaccgtgaaactataattgggtctagaaaataccaagacttttaggatctgcttggaagattagcccagagctaattttgaaaggtaatatttagtcaggaattggtaggctaaacattagcctagggtggtatgtttggatccatgggctaatttaaggctaaaaggtggagagagagtagaaagagaggagagagaaggagagagagaggtgctttttgatggtccccacataaaattagccccattagcacctcttggaggggctaatgttttgagggaggctaattcacattagctcaaaattagctcacctgtttggatccttgagggctaatttgaggctaaaaggtgaaggataaacattagcccatgaaaccaaacagagccttatgctttaggattggttgtgttcgggctaattggggcaaagaagataaacaactttcttgatctggtcaaatccatcatttccccaagcatatttttagaattaaacttttcacggacatggacccatcaacatgacttggccacaaagtactttctttattctccacaatcaaactcacaatatatatataggccctgtttagttccttaaatttttttcccaaaaacatcacatcgaatctttggacatatacatggagcattaaatatagattaaaacaaaaactatttgtacaattaggggaaaaatcgcgagatgaatttttttagcctaattagtctatgattaactatacgtgctacagtaacctacatgtgctaatgacggattaattagtctcaaacgattcgtctcgctgtttctagccgagttatgaaattagtttttttttattcgtgcccgaaaacccctttcgacatccagtcaaacattcgatgtgatatccaaaaattttattttcgcgaactaaacaggcccataaacaggttgtgaaaccgatagacatgataattgggtcccacgaaatattaccaaaccatcaattagtatactcaaatatagaacatttttaaatattatcacatctgttctaaaatatagtaacataatactaaataggacatattaatactacgaatttgaaccgataatgtgtcacatttaattatatgtctttctctggtcatataatcatcctccccagactttaattttcactataagagctagttgatgtcgttcctggtatctaaaggggataaggcggcaccatcagctgcttaactttgacttccagtctcccaccacttcagcttgaagaagtaaacatgactgataatctggcatgtgcataagcgagtctgtatagattaatgatagataccctaacggcaactgtatggttgaaaaagacataaatattagagaattatctaatatcaaataattagaaggagcgaggttttgaatttagattgtttagcccaccatctagccggcgagcatttctccgttatggttgaaaaagaaacagaagagggaaactacgattcgatatgatgagacgcagacactaatcaaaccagactacaagataaaagtacggaatactatactggtacagcactagtgtagtaacaacgacacaaatgacacgattcgttgtacatgtactaatcgtactgagctctgcaaaagcgtgagaggctcagagccacggcgcgaacagagtgatgcacccaacgagccaaatcagcagctcggcgagcagccgaggccatggcacccggtcccccgcgcccgcggacgcgccgacggcggcgatgatcatcgtggcgccggacaccatcagcaggaacgcggcgcgagtggtggctgcgcctccgccgcggccgtcggcgtgcggtggctctggctcttcgccgaaggcgatctcctcgggatccatttgccttggctcgagatcggccgtcgatgatatgttttctactgtatttgcctttgtgccagagcgtgtgcaatatatgttccagatcgagctccgttggcagtggcaacgaccatttttatatacgcatcgagggcaatataggtgggaacacagaatgggcccccggttgaaacgataagtcaatttgtagtataaagtccatgcgagctgtgtgcatttggccgcttcttgtgttgcgttaaccttttctagtcaatttcttcactgtttctagcttactggctggtttgacgctggtacgttactttgaaataagtattctgttatacctgcaccaatgcgcggtgaaatcactgacaggtcggtccgatacagcacatcgacccacttatcagtgataactccaggtcgtgtagagctcgcagttcgtacgtgtaggaacgtaattgcgtcggaagggagaaacgtggactggtttttttccattttgatccttttgaaaacttatttcgtagatagacccctaagaaacttatccgagaaatgtcctttttggggcgccagagtggctggcaccgtcatccagccttctgggcgccgtcctcatgccaacgttggtgcacgcgacccgacgtgccaggaggagggccacagcataccatgctggcgccgccccagggaggagggcgccagcatggctggcgccgccgcctccattcctgtttctctgtatggagttgcaacggtgtcatttttattttatttttttggatgttttttcacactcaggatcatgatacaaccaaaaaaaaaattaaactcgaactaccacttagctaagtctgaaaatatctagcataccacttagtctactttgcaccttcactaaaattagaccataaccatagctcctttagtaaaatcctttgatcagcatgttaaacataatgcactctaccaccatatgaaattacttaatctaattcaaaatataaccacatgaaatgagatatataagttaaacagtacatatagatgcaatttttttatttttattttattttttttttgatatttttttcacacttaggagaacataggaaccaaccgtataaaaaataaactcaaacggacaaaatatgtgacatgtagaattttccaaaactctaccgaaacggacaaaatatgacatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgagtttctaagtgtgaaaaaaatatcaaaaaaataaataaaaataaaaaagttgcacatctctctcctctgcactagttcggagagaggagaggagaggaaaaattctacatgtcacatattacgtctatttgagttcaatttttctatggttggttcttgtgtgtccctaagcgtgcaaaaaatatcaaacaaataaaacaaaaataaaaaatttcgggg

SEQ ID NO: 8980 - DNA, 691 bp, Oryza sativa
aactcgaggacgcctacatagccggtgtgtagttcagtgttgaacttgccgtctatcgccgtgactagcagtaaaaacctgatgatggcttaacagtgggcagggttgcggtactggtacggatgctgatggaacttcacccagtggttgtcaccggggcgtaataccacagctccgggtaggcgaggtcgatgacgagcacggtgcaactggccgggtccatggaaccgcagcatgacaagaggcacctccggagattgctgccttccgcggcaaggacggtgccgtcgtggtcgggaggcagcccgacacggcggccagtgaaagggtcccataaaaaagtgcacggcgagccgcggcgcgccatgagcaaccagccctgcgccgtggtccaccagcggtggcatctcatcatgtcgtcgacgccgccgtcgcccaccctcgttggcgttggcattggcagcagcgccctcgtcggcacgctgtacaggaacgtggcgtcgccgtggccgccgaacatcagcagaggagcaaacttgggatccagtgctgcagatgcatcgcctgcctcctccatgatttcgacggacgactggccgatcaaattcataaatccttataaataactattggcataggaaagaggtatgcacatctacgacctacaattagtactcctaccaatcatctt

SEQ ID NO: 8981 - DNA, 341 bp, Oryza sativa
gagaatgaagatcaaacctccatggccatcataaacaccaaagaatgacgtcatggtatcatcaagatttagatatagctgcatgctagagaatatagagggcatatgtcagtcacagtattttacacaattacttacagatcagtaagaaatttttgcagaactatccttttttttgtcatacaaaaggctgcaagtttactcacagcatcttccattttctcaccccatccttgcatagacgacacaacatacttaattctgtcattctctttttcatcagtgaactttgattctacaggaaggctgttacccatagcagacctttgttttgctgaaaa

SEQ ID NO: 8982 - DNA, 403 bp, Oryza sativa
cggcctgcctccgtcgccgccgactggtgtcctcgcctatacggtcggttggtcacaccaccggtgatgggcatcgtcatctacaccgccggcctgcctccgtcgccgccgactggtgtccccgcctatacggtcggttggtcacaccaccgttcatgggcgtccacacttcaccgccggcctgcctccgtcgccgcagactggtgcctccgcctacacggctggcctattatgccgccgctgttgggcgtctacgacttcaccgccggcctgcctccgtcgccgccgactggtgtccccgcctatacggtcggttggtcacaccaccgttcatgggcgtccacaacttcaccgccggcctgcctccgtcgccgcaaactggtgcctccgcctacaccgctgg

SEQ ID NO: 8983 - DNA, 22492 bp, Oryza sativa
aagcttaaccgcttcgtgacacagttcagcattccatccatcaaacaattatcatggtctagatcattgtttgcatcattgtcttcgttctcataatctggcatgatgctcggatctagaatttgaccaatcttcagaggaaatgcctccttggcaaattggtgaaggttcaagccatcattaaacatctcatctgttggacgcttccctgtcaacatttctaagatgataaccccatagctgtaaacatcaccctctgttgatattttactcccgaagccatattctgcaacgcagtttataattaatatgacaaaaaaaatgaactcataaaacttgaaagaaaggagtttataagagcaaatcagaataaaacacagtcagaagaaacatgcaaattattttacagaaaagacatatactatcttttttgtgcattaagaaattctcacctggtgcaatgtatccaatagaccctcttggccccagtaagcttgtagacctatcacttgtcgaagaaatattgctgtgaaggaacttagctaatccaaagtcgctaacacgtgcacccatggcattatccagaaggacattgcttggcttcagatcacaatggacaataggtggcatgcaacggttatggagataatccaaagcagcagccatgtccaatgctatttctattcttgtagataacctcactggattcctcggacgattcttgtaggatgttggatgcagccaacattctaggttgccattaaccatgtattcaagaacaagagctttgaactcatgtcctgtcggatcaaatgttgagcatgcggtgatcacccttacgagattgcgatggcgggtgttcctcaaggcctcacactctgctatgaagctttttggtgctccaagttgatcaagtttgaaaactttgatagcaactgcatgtgcttcggcgtcaaatttaccaacatatactgatccatatttccccgaaccaattaagttggttggagaaaagttgttcgttactttgactaaatcagcatatgtgagtttctccaatttcttatatgatgggtctgttggatttttagctttttttctcttcagaaaaaacactgctaaacatgacaaaaataccaaacagaaaacgctgagccctactacctttgcaatataggaagtgtggttgtttttagaagcagatatctgacaaagtggcaatttcagtagtggtgagatggcacacaactccttgttcccttggagaaaaaccttgcttgcattttggaagatcccattggatggtatgggtccctctaggttgttgaatgacaaattaagaagcaccatagagctcagagtctcaaaaaactctggaatttgaccagataagttgttccgagaaagatccatctgaatgatgcctctcagtgcagaaaaagatttaggaatttgcccattaagaacattcccctccatgttgagatactcaagacggacacaatcacctagagctgagggaatttctcctgacaatttgttgtttgaaatattgagggggccaagattaatcaaactaccaacttccactggtataggtccagagagtctgttgtgtgagaggtccagaccttcagaaagtgtggaaatagtaaataattcctttggtattgttccttccaaggagttacaagaaagatttagtatatctagtttttggcattgtcctaaggccttggggatgagtccactgaaagagttatcttgcaggtaaagctcagttaactgatttagtttaccaattgaaagtgggattttcccataaaaactgttttgtgctaagcttagaatgagtaagtttgaaagatttccaagtgagtcaggaaggttgcctgtcagcaaattatggtcaatttgaagcagtacgaggtttctgagttgttctatctcctgtggtatggtgccagagatgaaattggatgtcaaaactaatattttcatgctttgtggaagatcaccagtggaacttggcaggcttccttgaaggttatttgcatctaaatataattcggccagctgtgtatgtgctaatgctgggaggaaagtccaatctccagcttcaagctggttcttacctagatcgagaatggtcaagttgggtaaggacccaaaataaggaataatacctttgaatgcattttctctgagattaatcaattgaagatttgttgctttggccaatgatttgggaatttgaccatggaatttgtttccttgcagaatgaacatttcgatgcttttaagagtatacccaatattttgtggtaattctcctatcagattattttctgccatgccaaggaatgtgagtgttgacatattgtagagagggagtggaactgttcctgtcaagttgttcccagtgaattccagttcttctaagtacggaattctacttaaactcgatggaatacttccttgcaattcattccatgcaagcagaagtgagtaaagtgaagtggagttgcctagagaagatggtatgctacctgagagattattgtaggacagataaagaaattgaattgatgagaggtctgacaaaggtggaatggacccaaaaaagttgttttctgccaaatttatggcctgtagtgaggagctattgaatagagcgggtggtatctctccaccgatgtgattcttccttaagtcaagccactgaagtgatgaacaatttgctagcacagggggtatacctccagtaagactattgtttgcgagaacgacataggtgagtgacgagacgcttccaagtgaatgaggaatgttacctgacaagttgttgctatgggcaaacaaaaccgaaagtttgtcgagcgcggtgaacccatcaggaatgccaccgtgaagcatgttttcatggaggacgattcttttgagatttgaacagttgctcagaccaaggggtatctccccttggaggaagttgttcccaagattaagtatttcaaggctagagcaagaagatagagagtttggtatcacaccagtaagattgtttgaagaaaggtttatgtaaactagacggcgtaggtggcctacttcaattgggatctcaccattcaacctattattcgataggtgaattcgtgtgaggaaagtgagattgccaatacaggggggtaaatggccattgaggtctaaggactctaggtgcagtgctgtgacacgagattcatgtctctttccgcaggtgataccgggccaagtgcaaaattggagagactcgttccatgaggctagggatcttgcattgttagagagacgagacttgagacaaaggagggcctggagatccttgttggattcatcatcgagtgcggtgctacttagtgacggaattaatgggagggtcaagaaagcatacaggacagcaaaagtgagaagtgagggagtgagagttcctataggaatcatctatccgctactatggatgttgttgctgttatgtttgtggaagactagctgtagcttgggttgtgttttttttcagtagcagggttatgtgcatttataggttgccggaggatagcggctagccatttgttgaatttgttccaacctcacagatgcatatctacagtcaaagattcaaaagaaaaagaaagagttggttcgtagtccatctttgctgtcgtgcagactattcaaacaatggacagtcctctatatacggcaaagcattgtaccgagtacaaattttgtgcctgaactcagtttatccattttcctgagagtgctccccagttctacttgatagccattaatgcctttcatgttaaaacattctataacgttttatttggtttgaggaaagaggaacgactctcttttaaaaccgtttgaccctcatcctgtgcactcatacactccagcaatcaggtccttcgcatctcaatccgatggctaggatctggtagggtgggtaattttataaaaacccacccgcctcctatcttctacctttgcataaatcccctaaccagttcatcctcccattactctgtcagagcacaacgctgcgacaaatccaaagattccttctaaaccaccattccatatttccatatagcagagaggaattaaagatttctttttatttttttagagaaggataactttttctctgtctctacaatccaaccggatacccgtggattcgggtatccacggatacccggcccgatgggcacggcatggcgcgtgggcaccttttcttttttccgtgggcacgcccgagctgttaccgagtctctttaagttatttgctcctatgaagatttgaactcatatccatggagtgctactctggttactgcaaccactgaactacatgcccttttgcagagaggaattaaagatttaggttttggatagaacgaataggagaaagaagaattttaggaatctaagagtggatatctagcacttgattccttatatctatggcctaagtcatcgcttcgtatcagccttcttgtgggtgggtgctgccatcgccctcatcgagcagcttcacgtccccgtcattcgtgggagagacaaagtgatttgggggtagctacagccaaagaacaggaaacccatgccagggggatttttttttaacaaatatggcagattttattcatttaggatagttacatcgtttgctaacaaatcaagaataaagctagggggctcatcgtcccgagtacagttttgttttacctgcatcgctctctttgctaacttatacgccacttgattcgcttacaaaggtacaaggtgggaagtgggtggtttattttttctttttgtaaaattaccctaccaagatcctagctatccgattgagattggaaggaccttattttactactggatgagtacacgtgatgtgctgagtgcacctgatacattgccataatggaatagaagcatcagacatctggatctacttatctatcctacaaatagttggccttctatattagtgtacgccagaacttgtattgaagttcttaaaataaattgagtaaattttacaaacctacatatacttccatagatttaaggtgttctacaataaatttagtgatgccgtatctgtaattttgttatacgcatccttaaatttatagtcttgcaataagttggtcaaagtacatgtcgttttgtgaaatttatttaaataaataacatgtgataaagtttaaaaagacaataacgttatattatttgtttctgttttttttttcatttgtgtgcttatttcagttttggagacacgtgtaggcatttgattttaactaagtattttttaattgattgcataaagaacaaaaggtgtattagagaaaagtgtctaaaattgtcttccttgtttaatgcattgtctagagttcgaagaatctctctaggatgaaaacttaaaagtgtctaaaagtgacttatggtctagtctttgctgattggatcatggcaagttgataacaacggggtgtacatatgcattgttcaccttttggaggcgttattttacgagtctttatcatagttgaggcgtcgctcgctttggtggagcatgagaatgaagtttgtttgtggctgtagcttgttgtggcatgatatttgttttttcttaaataatgctaggctgtgtggttcttcttcttcttcttcttcttcttctttttttgtgagtggaggttgtgtgcatcttaggtaatggcaggagtcgtattagagtggttgtatccttaaaacagaacttaattatgtcacaccatatctattttttttcggggaaagggagatatattacgaagctatagagtcagcaccgacaaggtgtgagatgaaattacaagaatcatcaggccaaaaggccgttaaggactcacacctccctctattagctaagatatggctaatgcgattctgatcacgatagattttcgacaccaccacctccctatttccagccatgaggcatttaacctccttgactagaaatgtaagctcagacctgatctctattaacagttcatggtctctagtgatattctaaatatagctgctgggtcatattgaatcgccgtacggatatacgactatagttatagataggttatcttgttaattagattctcatgaacaacgtgcttccaagaacaatgttttgtttatgcaaactactgcaaatctaaataagtgaaaggtggaaactttcttgcaagattacatgtccatgtcatctttaaaatacggaccatttgatttttcctccagacattgctagccattagatccttagattggcgaaatatcttcgttccccttcaagaaacttcttttgtaaagaggtcctcccacgtccctaaccaaaaaaataaattgtttctcctcgttgtctccactcccaaatcgtgaaaacgtgcactcttcgctgccgtcagctcctcctccatgccaccaccacctcctcctcctcctcctcctacctaccccatctgccgttgctcctccactccatcctcatgcgcggtcgccaggcaacacctccaatccctccacctcccaggtgaccacgcagcggagcttggctgtgtgtcccctcaacatccacaaactcagaggcgatggattttgattggccggcgacgaagaaggggattcgacaacgagccgcttcttcgtccctacgagttcacatgcctccgcatactaatgatcccacaccgcttctgccatcggcgtcgtcctccccaattttcctccggggcaactggtgtgtaatactgaaacacaactgaatgcaaattcttgaagatctggaaatttgatatggaggaaagagttgaagccccggaagtaaaagatggatctttaatcccggttattttaaccgattcgtagggggttcccaattgggagtacaaagcctttctccagcagtgtttctgagccactacagaaattctatttgtattaactttagtgaaaattttgaaactgacattaagtaaataaataggcctatattgttgaattttcaaagcctgtttgcgcttgggcagtaaaataaaaataccaaagttaagagagtaattaaagaggtaaattaccactataaaaattattaaataaatcaactaaattgggcctaataacattccagaaaacctaataaaactcataagtgaatacatcccgacccagagctttattatattccgtttaaaaaatagcatcttgaatttccttctactaaattttctaattgagaaacctagagaatattacttatttggctttgatctaacgtgtggcatctggctggggtgcttttacgaaacaccaaccccataatttgtcgagccaaacgagcttcttgccagtctgcttatactcggctcgtttcactcacgagctgtattgtaggcttgggctcgctcgttccatacatgccgagctaagcctatgcaaagactgagtgaaacgagcgagcccacattacttggttaatatgttcaggaatgttttctactctattttgaatttcgtctcagttgtctagttagggcgggttaattagtcaggtactagatcctggtccaaatgttcatccctctctcaaccatgaacaaacaatttcgagttcgaacaaggcagcagccacgtacaagcattgctgaagaaaccatctttagtcccggttggtaacccttttagtcttgggttttcaaccgggagatgaaattcgggaccccggttaaaataatcgggactaaagatggacctttagtcccggttgataacatgaaccgggactaaaaatgtggtcccggttgttattaccaaccggaactaaagatttgtttttctattcctttcatccggttggtctttttccttttttattgttcttttgctctatgcatatcacccaaatcgtcatggatcggatcgaaggaataaaatcaacaacaaagcccaaatcatagatcgaatgaataaaatcaacaacaaagcatccatattctttacacttattcacatatacaacatcttcagaacaacaagcattcatcacagagaatagagaaaagaaaaaaaagttcacatctacaacatcttcagcattcatcaaagagcacagataagagaagaaaaaaaaatgttcgtccgccagccgccgcctcccgaccggcgtcggccgcccccgacgtagccggccgccgccttcccgaccagcgccagccacccctgacgcagctggctgccgccctctcgcgtccgccgcctgcgctgcccgccgttgctcgcctgtgtcggaggggaggaggaggagagaggggaggagcagagaaatgtggagaagatgagaggtgaggatgagatggagaagataagatgtggagaaaaaactgagaggggaggaggagatgtggagatcgaggactttatcgcgcgggaggacgaggcggtagggcatgtgacgcgagggattttttttcccggttgttgtaatcaaccgggactaaaaatagatctttagtcccaccaacgggactaaaaataacattggtctgacaacgtctgccatttattgaaccgggactaataatgatctttagtcccggttggtgccaaaaacttttaaaccgggatttttagtcttagtttgttagactattgtaaaatttttaatcgggactattgtaaaatttgatcgaccgataaagatggtttctccataagcgaagtttggcttcatggcgcgtgcaaaccacctttagctatgccgtgtatccaaaaggtactaatttgtatagtttcatacgcagaaattgagttttttttttctaaaacagagtagtcgtagccaccggttttctcctttagttacctcgctcattgtctgagattaagcggaccaattaaaggtactggaagttgtactggaattgacaatgtgttgtgaattgacaagacagcctgagattaagcagaccatgccatgtgcaaaatatcaatgtcgggcaaatgataggccattaggaaggtctaaatgcaaaatagtactccctccattccaaaaaacaagggattttaacattttatttgtactatttgaccattcgtattatttaaaaaattttagaattattatttattttatttgtgacttactttattatccaaaatactttaagcataacttttcgttttttatatttgcataaattttttgaataacacgaatagttaaacagtgcaaacaaaatgttaaaatcccttatagtagagggcgaaggcagtattacctccatcataaaatataatatttttttgaatgaaatatatctaactactataaatttgaatgattctttgtctagatttatatagtataatatgttccacctatctaaaaattgttctactttaggataaaaaaagtatggatgttagaatttatggctatggtgagaaaggaaaatttccgaggtgtgtgtgtgcgcgtgttggggcttgggagagggaaatatatatattatatgcacacaaattttccgtgcatactccatatacatcaactagcaaatgttattaaaaattctagaaaaaaatggacacatagttccaataatattacacttacctgtgaaatcttatcttcaaaatcattatattttagcccgtaacaaaaaagacaaaattctgatacatttttatccttaaaactgtcagatttttcattttttgttatggctaaaatataatgattttgaatatgacactttgtaaatatgtgtaatactgttatgagtaaatgttcaatttttgtggaatttttgtgatattttgtagttagtgtgtacgccgtacggtagaccagaagcttgtttgtataggagagagataacatacatgacaattcggacataattattacaacgatggtcgtagattcccggaaagaaaagaacaaacaagtatgacttaatgtttgtcttttccaatcatacatgttttaccgcgtccggaattgtgccagattacaaaagatttatatttaatgaaatgcttggatgagcgacgcgccatggatatgctttggtatatcttgagttcttgggtcagtcgtccctcgctcttcgacgtgcttaggagggcaagttttcatttagagctcgtgtacaattcttctttttttttttttgaagaaaagggttgtggacaattctaggtatagcgataatatagtagtgtaattgcgcagataatattgtagagaaagtgcttttttttccagaatataataatttttaggattgaacatgaatgttaatttaataagtaggtagaatttaatgggagaaaactgttattggttgggaagtaaaggcaagtagaaaatttaatggtggatgattataattgattagcaagaatatattgatggattaaattttaggacaaatttgaagtctagaagttattatattttggaacggagagattacatcctatatgactaagtaggtgaaatagcaaaagaaatcttgccatggatttaagcattaacaaagttcttaacgtaagactccaagaacaaactaataatacttaaagtttgattttgaagaataatttaggtagatttcttttacttttctggttagaatttattaaaaaagatcaggcaacaaaggtgaaaagaaagcacttaagtcaaatttatagtgtgttaaaatctgctctagattaatttttttttaagaattacacagtacaacgcagacactcacccctataaacgcacacacgcaaaccctaccccaaaccctaaccctatgagcatatttaaagacttgggtggcaaatccttgagaaagtcaccacagacgcctcgctgtcgaggggtacgtcgcctaccactgaaagcacgaagccgttaaatcctgaaaaatttgctcccgtgaggagtcgaacccaagacctaaggttctactcaccactaggctagaggccctttcgcaaatctgctctagattatgactcaatgagaaacatagttggttcgtagttctactaatgaaattttgtcttactttttttaaaaaaaatacataaaacttcaaacaaatttaaatgcaaaacaaatagctagttaagtaacttattcgaatgaatatgttaccgtgctcagcctgtccagtcttgatgaacccatcccagccctcccaggccccagccgttgataccttatctatcacgggaggtttgtgaccgcacgagctgtttctctccgtatctatttttctttattttcttttaacctttttgattgttattttcgaagataaactctctcctaaaccgatttccaagtcattcttttagccttaacactactacacaaaagctaatatgtgctggttgggagccggcactaggtgctggttttcccaacggacaccaccgagaccgcactaatcactgaaagtcataaaccggcacatttaaggctgcaggaacgaaaaaaaagccggcttgatgcatcgagcaatttcacttcaagaacatcaagaacatgagatgaacacacaagatgaacacaataacacacatgaacactcctgagtccccctcccgccgggccatcgccttccctcccgccatcgcccaccgctgccatccccgcctcccctcctgccaggtcatcgctcccagccagatctggcagaggggaggcgccgccgctacctctgctgtcgggccgccgtcttccctccaaccatcgcccgccaccgccatccccgcctcccctcttgccaggtcatcgctcccagccagatctggcagaggggaggcgccgccgctacctatgctgtcgggccgccgccttccctccaaccatcgcccgccaccgccgccgcccctgcctcccctcctgttgggctgccgctcccggtcagatctcgtgaaggggaggcaccgcgccgcagccgccaccgcctcccctctcgtcaccgcccgcagccgccacccccacctcccctcctaccgggctgccgctgtcttccctccgacgacgcgagactgtgagagaggcgaggtgagagctgagggaaaagagataaggagagagagagagcgtggtggggatggatggataagaatgggtgggtggtgacttggtggataagaatgagaagcggtgactcggctcacagctcggtttttaaaggtgtcgattttaaaaaaaaaacgatatctttaatttattatactatcagttctttaaaaaaccgacacctataattaatttaaggtgtcggtttttatttaaaaactgacacctgtagtattagtatcgtttttttttttacagaaccgacacctataataaggtgtcggtttttcctgttttgggccatggaggtggggaaatgtattataggtgccggttttagctgttccggcacctatagtggtgatacctgttttgtctttttttagtggtgtaagcttgcatggttacaaataagatattaattatgacatgtataaatatagagtctgatatataagccccttgttccttgtataatgatcagagtcaatataggctagctttgttccttgtgtcgtggttgctaaccaacctttatcacgtactgccagctccttgctcatacttcctccaggtcaggctaaggaccacatcaaataaatactaaaaattacttaaactatctcatttaaaaatattacccggaatttatacatgggtcagtgactaatctagcttaatttgggaataaaaacaaaacaaaggtctatttaatttagattactgagcgaatcattggcatgattatcaattcaactatctaaatctgatttgtatttttctattcgtcacctcactttcggattattttcgttcgttttccgatcgagatttcgtccggattaatttttatccgtctacgtatcgagggttcgtctgatcgctttcatcattcaatcatatccgcttccccgcgctgatacaggcctgcacatgcgtgttactggcccgtgtccgtgtgataaggaaaacggaccgggcccatgtaagattttttctaactgtaaaaaatatcacgtgtcttccctactgttgtacgaagaaaagtgacattaccgtattaattagcataagtgaactaatccaatcgcaatatcgattgtggatcccctcaaatgatccaagtgtggttctaagtacagtatagcaaattacaaattcatccctagatagaatttagtaaaaaaaaacctgaaaatacacatgatattgctaaatgaatacagtgtttatgatattgctaaacagacgcatgatattttacctgtttgattaaaaatctatatctatatctatacctatataataaaaaaaaatatgtaaggtttccggcatattttttcgtccgtctctttttttttcctttttttttttgctattttcacctttttttctttcttttttctgttgtccactttttttttcaccgccttttttctgtccgccttttttttctccgttttccgttattttttttcttttttttgaccacctatacatttgtcgacaaattttcttataaaaatttgacacatgtaattatagtacaatcgtagtgtaattacactgtaacttgtatataattacactgtaacttgcatgtaactacagtgtaacttgtatataagtttcacgtaattttgaatcgttagatctattacaaaatttgttctggtgaggaagaaaaaattcacatcatacacatatgtgaaagaatttgttctcacaacctccattttaccgaaataaatgttatggagatatttttgaaagttacatacatgttatattataagttacagtgtaattacactacgattgtactataattacatctgtcaaatttttggtggaaaatttgtcgacaaatatatagcaaattcgtctttttttgtccgtctcttttttcgccccccccccccttttcttttcttttttccctttttttctttttgtccgttccttttttttttttttttgccaggccgaaccctagcgccgctgccataacgatcacctcccatgcgttctcttctacaattgattgtaaaagttgattacccactactctctcattattttcccatgatttttcctttcaattctgctctaatttaccggatctaatacacatttaaaaatcaccgtatctgagttttatgtattcgctcatattttggtaaaaacggaaagagtagatcgagtgtatcaaaagccctcaaccaactttgggagtatgggctaggtcaaagagaggcaagcaaaacagaggaagataacgggttgggctaagactgaaaaggaaggaataaatgaggttttggccgcaaaacagaggaagataacgggttgggctaagactgaaaaggaaggaataaatgaggttttggcccaaaaccaaagagtatctctactattataaaaattgaaaatgtttttgtcggtactttcgtagatcatctgtatttgagtcggtttctaagttcgttcgcttttggaaatatagatccatgtttgagtcttattttaagtctgatcacttttagaaatacagaaagagtcatataataaatctctttaaaaaaaactcgcacgctaactagggatgcttttggaaatacagaaggagtcgtataagaaatactttaaaaaaactcgcatgctaatttaagatgagagttagactcctaatagtagcttataattttctaaaagaaatatccaagcaaatttctacagtaattttcaccctaactgaaccgtataacaacaacaataataataataataagtctaaaatagccttcacccattgcaacgcacgggtattttttctagttattgaaaagatacatagtgcttccatcgtccgtcgctaatcgatcaaaagtgatatgttgtccaaatatattcaactaataaaagtcgtaatggtttatttcattcatcatcccgatccaacgaccttgattattcggtggtcatgctcatagtttgtatttccgaattgtgacaaaaattacccatatgccacgaacaaaaccccaacacaccctaaagctcgatctaatcgttccctcacatcgcaattctcgttccctcacatcgcaattctctcctactcccttgctccctataattacaagtgtctagtcgagctagcacctgagctggccaggatttgggcggccacccaacctccatcattagaaccaccactgttgaatgactttggtgtaagtggcccatcaccggaaaaacctactctctccgtttcacaatgtaagactttctaacattgctcacatatatatagatattaatgaatataaacacatgcatatgtctagattcattaacatttaaatgaatgtgagcaatgctagaaagtcttacattttgaaacggagggagtattagatggtgactttggaaccgtcacttcctaccatcgcggttctcttcttccatgtctgctcctctcctctcctctcactctttctggttagggtttagcatgttgttttttttccctctactgtctttcaacgacctcaactgtccttccacttcatcttctcacccaactatttataaaccgtactttctctttcttttcttaacttctttaacatgatgagatctctgtgaatggagctaaggtgccaaaacagtcccaacaataaataggggtaaatatgtacaataaatattatcctactagacccttttcccgttgcaacgcacgggcaattcttctagtatataattagatataataaaaataaatttaacaaataacatacaatctaaacaatgatgtagaaacggaatagaataatcttttaaaaaatatatattttaaaaaaaacatggaggaaataatccgttccaatacttcggcgaataagaaaaaaaaaaaagaacagggcaggtcccgctaagaacgtttgataggtactccacgaccgtaggagtgcagagcgcagaagaattcaaacatgtccacatttgacatcttgtctggtgttattggaagatgaaaccatttttaagtggcgagtgttgcttcccggcacggacggtaaaacagacaggttgtatcgtttgttcgtgagctcacaaagcagctagctggcctgctgaacaaagcatgtcgcccactctgagcagcttccgtcttcttctgattcgacttgttttgctggctctcctgataggcagcggcgtccccatgccctcggctcagcaaggcagcgcacgagtccgtgagtatcatctgtatatatttgcaacagatttagctttggcaatcactagagtctagagctacggcgcgcagtactgtttttgttcccccgcccttggattgctgctaatattttctttttgacgcatcgttgcagataatccgcatggtccaccgcagacccatggtactggttttagctacgacattattcgtgctaatggtgcaataggctaacccacgaaactcacctataagccaaataagtagcgaacctatttattttgatctatatggattagcggcttactcacttatacccttgattcgtgctggataaatatgtagatcgtgttgttaccgctctatattatactcctactccctccgttgaaattgtaatgcctggtttttattgattatttcggaaaatcgctccttggctatataatagcaatgcctccaactctgttttaccacaaagttaagtgtaattacaaatttagtatataattgagcagtatgtacatttagtttgccacttatctcatcgtatcccttctattttcgtttccactttcttttccttctgaacttacatatctattactccctccgtcccataatataagggattttgagtttttgcttacagtgtttgaccactcgtcttattcaaaaagttgtgtaattattatttacttttttttacttactttactatccaaaatactttacacacaactattcgttttttatatttgcataaattttttaaataagatgagtggccaaacactacaagcaaaaacttaaaatcccttatattatgggacggagggagtatctattatatattaaaaatcaattaaactttctcaaattaaatgctctcagaccatcacgtggtgctctaataagttagagaaaaataatagaaattatgagaacaaaaagtaaaacatccatccattaatttttatttaaattggtaggtccacgaaaaaaagggcgcggcaaaaaaaagtgataaaaaaagctccctgataaaaaagaaggatgaaaaaaaccggtttcgattctaaacatcgcctgcaaaaagaaaatcgaaaaaaaaaaagaaaacgccgtccctgatatagagccataaggcctgaggcccgaaggcccggcccacggcacggctttttggcccggcccaagcacggcacggaccgacttgggtcgggcccgtgccggcccggcctgaccgccgggctgtgcctgggcctctccaccggcacgctgggttggcccggcacgatgggccggtaggccaggcccggcacacaaagtatagagactaaaaatagacatataaatgttactgtccaaataatagggaccttaaatagacttatttcagctattcatataccacagcccaaagataagggacgtaaaatagactttttagctatatatatgtcacagcccaataggagggagggaaattagacttattctgaggaaatgcacaatggcccatcgtgccttcggaccggcccggcacggcccgagacgtgttgggccgtgcctgggccgtgagtacgacacggcccggtgcgtcggtcgggccgtgccggcccaacatgcctcggcccaggcacggccgggcctaggccgtaccgtgccgggcagtccacatggccatctatagtccctgagaaaacggccaaaaaaaaacaaaaaagacgccggaaaaaaaaaagaggcaaaactccgttcaaagaaaatggctaaaaaaacgcgtctattaaaaagcccacaaatagggcgaaaaaccaaaaaaaaaaagccaaaacaccgtgagaaagaaaagacagctaaaaacgcaaaaagggaaaaaacgccatcccatgaaagcccccaaaagggaaaaaaactgtccgactactatatgttttatagattactagcaaaagtgcccgtgcgttgcaacgggaattgtaaagactaaaaaattgaggaaaagttgagaaatatttacattatgtaattcattgaaatacaaatttcgatattttttaagtaggtaggtgtataattaaattagtttacaagtaaagtaagtgcgagaaataaaatggtatagttaaaattaattttattaaattctccgtgattaattatgctagttggaattttattggaatttgcgtagcttaattgctaattttcataatactaacatccttgcaatatttatttgaatagaaatcttccactctctcgttggggcattttcagcccatttttatacagcccgcagccaagctggcccgctttcctcccttctcctctcctccgcctcaaccgcacacttgtccggcccaaaaataagtctaatgaactccccctacttcatctctcactgccgcgtgggccctaaccgaaagtctaagttaaatttttttgttcgaccggtcgacctgctgcggcccatgaagcgcacgcgacccaatagtgattcggcctaacgcgggatcgatctgagccattcgtttagagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagccggccgttcgctctcgggcgacggccgtcaacgaaatttgcaggtggcccccttgccgccctccgctagggcgattttatactgtgcggggggccgcctgcaaatgggcggcgagggggggcatggaattttgcaggcggaccccttgccgccctccgctagggcgattttctactgtggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataacttgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgacctgcctgtactggtgtgacctctggctgctcctgagtgtgcgcctctggagctcctccaagctgagaggagcctagtacgtcctggtggtctgcaccgtgcaagtcgtcgtcatagaactggctagtaggaccagtcctaccggcgtgagacgaagaggccccagtaccgaagatcccggctgcatatcctgctggacaaggaccatcagttttgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacacattcgtgcaaaagctgaaacaaaaatgaactaatatctgggctgaattgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacctggactgcggtgatatcggcactgatatcccgtgcggcatcagcctatgcaagatggaaataaaaaattcagtagttgtcctatattatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtagagcccaaagtgcgcctgctagctgtccccgtcgagtcaacctgtgaagagaggtaaattatatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtgaccttacttgacattgtgcctgatgaaaacattaactgcgttaacctcgcatttctgtactacgccctaagttacattctctacaatattgtcctctaaatttctaaaagtacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaagtgagcgaaccagcagggcttcgccgctccccttttgctgccctcccctctctctcttttgttttttttggatttttagtgaatataatgaaatttcacagaggagggactgggttttatagggggggcaaaaatcgccctcccccagggcggcaagggggccgcctgcaaaattccatgccccctcgccgcccatttgcaggcggccccccgcacagtgcaaaatcgccctagcagagggcggcaagggggccgcctgcaaaattccatgccccccctcgccgcccatttgcaggcggccccccgcacagtacaaaatcgccctctcggagggcggcaagggggccgactgcaaatttcgttgacggccgtcgcccgaaagcgaacggccgtctgccacgttattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcttcgtttagatggactgctcagatcggctcctaatccattaaaactccggaccgaaccctaatccctaa

SEQ ID NO: 8984 - DNA, 4010 bp, Oryza sativa
tacctctctgcgcccatccccgccgccgccgccttcccgcgcccatcccccaccggcgtcgtctccgcgccccttcccaaccagcgccgcctccgcgcccctccctcaccggcgttgcctctccacgcccctccccaccggcggcgccgctcctcctctccatctcctctcattatctattgattccgatttgtatttgtatttgaatttggattgagattttgtttttgtttggagccgcagcccggatggcgtggggacggccggccggacctcgccgctgccggatctagcggcggcgggggcaggagggggcggcggcccggatgcggcggaggcgggagaggcagctgcccggacggcgtgggggcggcggcggcccggcgtccctgcgtcgacggcggcgacggcggcaccctccccttccggcgtcggcgtttttgtgcttgtgatgttcctgtgttgtcgttgttgttgatgaaatatgatcttgtgatgttcttcttgtagtagtgttttctcttggaatttgtgatgattccgatctgtatttgaattgagattgagattttgtttttaggttggattggatgcgggatttggagaggaggagcgcgtgaggttagagaggagagggacgaaaaaccggtgtgacgaccggaaaaatactaatatttatattagttgtagatatattattatctttatacctattataaaaattaaagatgattttatactcaccttaattttcgtccatcaatcgagttaaacacatataaaacctggatcggactggaaaaaatcatctactggcgatccgtattctcaatcggatgaaaaatgtcttctctagtattataaaaattaaatatgtttttgccgatacttttgtacgtcatcgagttggtttgtaatttcattagcttttagaaatacataaggagtcatgtgagaaatctcttaaaaaaacacttacatattaaagtgagatgatcaaactcctaatcaactcctaatcgcagctcatgatgattttctcatgtgattgaaatcctaagactttacccgttgcaatgcatttttctagttgtatactaaaagtcaattaaactttttcaaattaaacgctctcagaccgtcacgtggtgctctgataaattaagggaataatagaaattatgagaagaaaagtaaaacatccgtccaatgatttttatttaaattgataggtctaatattataaaccgttaatttagattaatcttcaaacggaccgcacaaaacaactacggtctcacctctcctccttccgcgtaggtacgtacatgagcgtacgtacaagaccgaacaagacatccgtttcttctgcttccctcctctcaggaatactcaaatacaaataagtatatagtagtgtgtcttatttctggctaactactttgtaaaggtgaggaaagttaatgcaaaatataaatacactgtgatcatgtgataggtaattatgtatacattcatgtagattatatcgtcatatagctcattccaaatatacgtaactaaattagctatgtaatacttaatatttaaaaataaagtttacaccattatatatttaaccattaactaaattaattatctagttgtgaattaacttacccacaagaggagtacacaggaataagcctctccccattccatttcttaactcgactctcttgagttctacctagtttctaccatactgtatgttatcattttgaatcaagtaaagttgcgttttgttttaatttgggttagctttgttcattgtcgtcgcagtgaccggccaaccttatatcgagcaccttgctcgtgctttctccaggccaggccgtgagagatgggaaccacatcaaaaaatactaaaattacttaagctatctcatttaaaaatgtacccaaaatttatatacgggtcagtgactagggtagattagtctgggaataaaaacaaaacaaaccaaggcccagtctgatttaaattgttgagtggattatagttatagattttctagtgataaattaaatatctattatatactaaaagtcaattaaactttctacgaacgttctcaaaccgccaggtggcatcctaccaacgttcctaactcgctacatcgcattctaataaataacaaaaattcctaagaaattctaaaaaaaaaccaaaacatctgtccatccgttttcattaaaatagttggtcccattatttcaagccaacagatttatctaaaaaatctttccacctccacctccctcctcccacacgtaacatctcttccctttgtacgtagtcacgtaccatgtacaaagaaggttatatatgtacgtgcagcccatatatgtgtcctccttttctctctacaccctattttatagctagaaatttaactaagcatggcgagttaaatggtaatttaatttagaattaaactgataacttaagatcaataaaatccaaaatatttcaagggttaattggatccataccattgcaaatttgcctattccgaaaaatgtcattacaattcgtctattcttaatcgtgccattgaaattttccaaaattaaaaccgtgccactgccatcacgttttccatccatcccctgcattttccgtcttcttccttcattccctcctcaccgccgcacatggtgccgtcgccttcgatcctcaccgacgcaggaggcagcccagagcttggtagcggtgtcaaggtggcggaggacggtggcggcgatggcgccgtccatggagaagaggacaaagccatcaccgccggggaggccgagggtgcgggaggcaggccaaagggaggagcgcggtggcggaggaggatggtcgccgctgtggaggaggtcgcccctgaggccagcggttggatccatgcggcggtggaggagggggaggaggaggagacaggggatttggggatcgggaagaggagggagaggagagtgcgaagctgcattgcgacgccgccagcatggttgggtcgctagtaagctctctctcctcctccgagcttgcctcactacgggagatggcccgcttgacgcctccgtcgtcgccgtacctcttgctgctgccaccgttccaccgatggctacgtggttctcgtcctccacggcgaggtgcgctggaggcatgacgacagagagatggagagagaagatataagatgcagagagaagatggaagagagaaggaagaagatggaaaaagaaggatggaaacgtgacggcaacggcccggttctaattttataaaattttagtggcatggctacaaatagacgaattgtaatgacatttttctgaataggcaaatttgtaatggcatggatccaattaacccttgttaataaatagtcttaacaatcggcacaaataaaataaacttgataacatatattgttccatcatatattacccccacgaacatgcatagatgaattagatcaataataaaaaaacaaaaatatcaaaactcatatcctatccaatcctatatcctataatactatataattgatccccacttagtgtagttattaggaattttcctgagctgtggttaagccacgtcacttcttttattttcagtcattcgatcaaacctcgtgaatggtccaatcgtactccatcacacacacatgcacgtccttttgcctccctccgccaccgatcgaatatgccgccgccgccgggtgcgcttgcttcctctcccacatcgcgcgctgcttccacctaccacccccgcgcgcgccaagacgtgggccctctcctccatcgcccgtggcagtgcgggccctccctccggccgccgcgctcgctcctcctcccatccccagcgcgagccagccgcgagcctgccatcctcgcctcgccgcgctcggttccccatccctcgcgcactctaccgccaaccgcgccgcttctccaaaaccccaccccaccccaac

SEQ ID NO: 8985 - DNA, 2768 bp, Oryza sativa
caccccaccccaacccgcccccccccctcacccacacacacacggcggcaccccaggttgccccacccccagcgcacagtcctgccgcttcgcctccaccccccggtgattctttctccacgcccaccaacgagcagcgcgcgcgccacagaagcgagccgtcaccatcatcagcacatcaatggaatggggatcgccgctgccatagcagggcaagggacggagaaagccagcccagcaggttcccattttctgtctatacatcttcctctgataaccgtcacaattaagttattatttgttaacccaaagttaatatgatgaattcatttatcatgtttattttccttcttatgtactgaggaaacttcataatcagtcccctaattttattttatggacaaatcagtcaataattcatgaatcccattttttcatatgggaattagcattaggccagtcaataggcggaactttttccccctaatttgtatgtatcttaggttactcatgtttgttgcttttagatgtgccgattatctggatacatctataaattacggattggtgactgggcaataagctagcttcgtttcatcataggcctattaactgtatcgaagtattttccagctttgttcttcccattgctccatttatatatttagaacctaacttttggtttatataagttgtatcctgagcttttggttgatataatcatcatgcttgaataagctcctatctctgtaaggacctgaacccatcgcttcgaaagtgggtacatctatgctgcatgctgttgttatgttatctggaatttttgcatggatctttctttcaaacacatatcggtatataatatcccgcggcaacacacggggtatcatctagttactataaagttataacccactaacttttaaagcttagcatgcaaagatgccacatcattatccactaacaagttgacacatcatcatccactagcaatcaatacatttaatattatgcaaacttgttatattatctataatttaaaatttcttacattttagagcttttaaaatgaaagcatgttaaattattatcccacataattcacataatatttcaatatatatcttcattatgttttataatatcttatgtacatacataagttcatcctcacttagttaatgttatctctctcttctctatttgagccatatcacgtcaattgattttagtgcttatgtaagtttatattgttcagctatcttacatattatttttatttattgttatcatactgaactcccacagcaatgtgtggggtttcacctagttacctcatatgttcgtgaataattacttctcgagatcaactctacttattttcagggagaaaattatatttgtactgctaaaatttaatggaccaattaacgccatagacaagtgtcaactctattccataaatggattcaaaactttaaaaaaattatcacttccatcttatctaattatcattccacgaagggcgccaagcatggataacatagtatgctctgctactgtacgaatttgggggggggggagggggcatgcatatgactaagtaaaggtgaccgtagtgagaggctactatttgcaaataaagttcaactaaccttctttctgatgctattctttagctgataatgaattaggcgttaaaattgtgctgcacgctgattttgaggagcacaactatgtagattaaggacacatatttcaaggcataagagaagaaagcctaggtggctacactcggcttcaactattagaggggcatttatatataattttaatggttttatcccatgaattggtaggagcaatacttcaaaatatttatacatatatttaaaaacaagtgagacatgaacaatttagtattaagtagagatgatcttttcttgtattactgacatattaagtttgttttcttgtatggatgtaattccatcataactgataatacaacgataataaataatggtgacaagcaagtttacatatatccggaacaacgttatttctgtttgaatatgaaagatactattgtcatttggtatataaaaatttatggtctagatatttatttttttattaattataagctgatatactgtccttataattaattaatatggtgagataggatttctttagcatcatttttgtaaataataaataagtggttctaattataaggtgaagcatgattttttaacaatcttttataaataagttgcccgcgcatctgcgcgggctttctttctaattcgtaaaaaaaataacaaagaacttatttttagtggtgtaagtaattgattcaataatccggtaaataaggtaaaaaaatagggcatgccccgctaagtatactactggataaatgaaatttgctgggtcacgcaaaaatcacattagtcctggtttgagtaagaaccgtgactaaaaatatctttagtcccggtttgaaaacccacgggtactttttttatcgttaccaaccggaactaaatatcatttgtagttccagttaaaaacatgttagaccctattttaccaaccgggactaacgatgcatctttaatcctggttatttataccaaccgggatcaaaataaaaaaaatcgtgaaaatccctaccccgagtcacgggcgctgccttgtccttatcccctcctcttctcctcctcctaccctcccattttctctcctgcacctactccccc

SEQ ID NO: 8986 - DNA, 9145 bp, Oryza sativa
ccccccaacacacacacacaacactcctccccttcctccccttccccttcacctcaactccccctccccccttcactaacggcgacggcgacagcgagcggcggcctggcggcaggcgggcggcggcctcccctccagcggtggcagggccgcggccaccgaagcggcagagatggcgagatgggaggcagcggacggctggcggcctctcctccgctggaaatggcgggaggggaggcagggcggcggaggcgtccgggaggcggcgcacggccgggcggacggcagcggcgtgttttgtgaattttttttatttttggaatgatttgtaaattttgttgtagattattttagatttggggataattttgtgaattacttgtggattgcggatgattttttggatgggcaattgtggatgatttgtggggatttgagggtgacgataatctttagtcccggattgggtgtcccggtttgcacccggggctaaaaggttgcaaatcgggagtaaaagagccattccacgtttgataagtactgctattccataggagagcaaagcgctgaagagttcaaccagttgaaaaatcctcgcacatcttgactcttcttgtctggcgttatttgacatcagtggcttcccggcacgcacggtaaaacagacaggttgtatcgtttgttcgtgagctcgatcacaaagcaggccagctgcctgctgaacaagcatgtcgcccactctgagcagcttccgtcttcttctgattcgacttgttttggtggctcttctgataggcagcggcctccccatgctctcggctcagcaaggcagcccaggagtccgtgagtatcatctttatatattagcaaaacgattttcaacagatttagctttgccagccaatagagtctagagctactgcccgcagtgtttttgtttccccgcccttggattgctgctaatattttctttttgacaccatcgttgcagataatccgcatggtccaccgcagatccatcatacccgttttatctatcacggtgaggcaggcactgtcatcgggaactaattaaacgcgtagatcgtgttgttacctgttctgctctgtattatactcctactccctcagttgaaattctaatgcgtgatttgacttttgttctgttgattatttcggaaaattactccttggctatataattgcaagggctcaactctgttttaccacaaagttaactgcaattataaatttagcagataattgagcagtatgtacatttaatttgccacttatctcatcgtatccctttgattttactttggtctgccttttctgaacttccatattgtggatcaattaatatacccacatgccacatggtacccataagaggaatacacaggaataaagcctctccccattacctccctcgactctattgtgctcgacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttatagggaaccggtttttttacatgggaaacttcaatggtgcggaaggattatagagatataagccacgaccaccaaatgcagcttcgcagctgaatcagcgaattgaagtgggaaaatctccttctctgaaatttacaatattagcaagagcactaatctataggaccattacataatttgtagaactaatgaactgttttcactaaattacataaaaattcagggactaatataaaattgctgctaaaataaaattaaaaactaaaataaaggggtaaatgggtggtgccgaaatcaataggatttggcccaccaccactacagtgcagccggcccatcaagcccatggggaaaagggcgaaggggggcgtggggggggtagggttaccctaaccgcccagcagtttgagccgccgccgccgcacatgacgccaccaagacagcgctgcctcctccacctcgtctgccgccgccgtctatttcggcgcctcctccttcaccacttttgccgccgcctccctaatccaccgccaattccattttcgccgccaccatctccccctattacaccaccgccggcgcctccatttctgccgcccccaccgccacagcagccgaagtccccgtcgtccgccggcgagactaagccgacggctccctctcctcatcggagtaagaggccgatcgggttcggacgctgtccccccctcccccccactccgttcgggagcgtgtagctcggggagccacatgaacggtgcggaaagtagcggggaggccgagcggcgaacgggaaacggtgccggcggcgactgcatctccagtgggagggagcactactcgccggtgggcgtcaccgtagtccatccatggagcctggacctggacgcagcggggcgccggtgcactcgtggtgtgcgcttgtggtggtggagtcggaggtgcgtcagcgacggcaaatgcggcgccgaggatggtggcggtggccaccaaccctagaatggcgcccgacatggcgatggtggtgactccatcgaatcgagggaggaggtgaagaaggtgatgaaagcggtctcagcgatggaggccgagaacggcatcgaggatgaaatcaaggtagacgtacttaggcgatttccttagtttcttctgtttctttcgcttttcttgaaatcaaaagcgatgtttccttctttcacttcgcgatctccttcgcgagagcgaaagtgctgataacgtgttgaatgtggatagaattgattgagcgagagagattgagagagagaatttaaacacaagaatgtagggaatgaatgagtggatcctttattgataacagtgttacaatatatatgggggagagaggcagcaaccggaggcgcgatggtttgggaaccatcacgtctgttgctagaatcgccgtgaggcgagaagaggtgtggggcatgaccaaccgtcgtgtccctgagttggttgttacactatccatatatatggatgagatcacccaaatatttcagaacactcccccttgatcgaatccagctttgatcattgctcatttagtgttcagatatctgtaaagataatcttagaaataattatagttaaatacatcacgtaaaactcctcaaaaacccagtgggaaaaataaggagagaaccatgatatattattgactatttttagatctctatgagtaaagctcatagtatgatccaaaatagtatagtgtctacagttatcatttagtaaaaacacagtggcgaaaagccaaatgataagacatataagcttatgttgatattacctcgttaaaaactttggatgagaaaacctaaagggtaaaactcatacaaaggaaaaagagtataatatgacgaaaataggttattttccaaaggaagatactccccctgaatcctgcaaatttttaagtcgtctcataccaattccttcgacacatttaaagaatgcggagtatggtagagattttgtgaataaatcagcaagattatcacatgacttagtttgcaagatgtttatctctccatgttgctaaagctcatgaggataaaataatttgggagcaatatgcttagtgatgttgctcttaatataaccagtttccatctgaacaacacaagcggcattattttcatagataatggtaggtgattccaatgaaccaataccacaagaagttatatgtggttaaccattctgcgaagccatacacattcacgtgatgcctcatataatgcaattatttcagaataatttgtggaagtggctactagagtctgtttagaagacttccatgaaatagtagttccaccttgtaaaaatacgaattctgtttgtgatctggcgttgtggggatcagatagatagccagcatcagtatacccaattaaagttgaatcctggttctttttaaagaaaagtccaagatctcttgtgccattaagatatcgaaagacattcttaactccagtccaatggcgtttggtaagagcagcgctgtatcttaccaatagatttaccgagaaagcaatatctggcctcgtactatttgcaaggtacataagtgcaccaatagcactaagatatggaaaatctggtccaagcacatcctcaccataggggttttggaaggatatgacttgtccatattaaatttctacaaaattttctaggtatatgcaccttggtgcacaaggattccagaagataaatgctcaagttgtagacctaagcaaaatttggtttgacccaaatccttcatctcaaattccgtctttaaatgatgacgtgcttcattaatatcttgtgtattgccaataatgttgagatcatcgacatataccgagataatacaaaatcctgtggggtctttttgataatgacgcacgggcaatcatcatttttagtgtatccctttagtgaaaggaattcacttaatcggttgtaccacatcctgaccgattgttttaagccataaagtcacttctgcaacttaacacaatacatgttacgatttaccttctgattcgggatgtcgatgccgtcaggaaccttcatgtaaatatcagaatcaagtgacccataaagatatgcagtcactacgtccatcaactgcataaatagacgattttgtactgccagtgatattcaatatcggaaagttataccactcataactggagagtaagtttcgttgaaatcaacgccaggtttttgcgtaaaaccttgtgctacaagccttgctttatgtctcaccaccacgttgttttcattccattttcggacgaaaacccatttgtatcccacaggaaagataccacgaggagtaggcattacagccgagaatacatctcttttgtaaagtgaggctaatactgcgtcaattgcgtccttccatttgttccagtcagagcacttttggcactcttttatagacctaggttctggatcaacttggaggcaatcagcaatttgttcagaaaaattaatgtcgacaattgtagctcttctatcaaaagattctccagtttcagagtagttgatggcaatttcatcaacccttatagactcatcgtgatctcccgaaacaatgtgtctatggtcttccgaattcctagtcttagcattgtgcaccaccgagctaggttgcagactatcatgatctgcttgatatatagtatcaatttggtgtgtaccaactaaaggttggtttgcatttaccgtctttctttgcttattagcaattgtttctcgctgagtggccatacttcctctctttttagtgagtagaagttgagtggttttatttggtacctccactctttttggcgcattctgagcaggaatgaaagatttagtcacacctttataattagtaaatgcatctggcaggttatttgcaagtctttgcaaatgtataattttctgaacttgtagttcaattttagtaatacgtgggtctgaggctggaataccctaggcatcccaatcaatttcctggcattctttcgggtacttgaagtctccccctaatgccgggaaatgttcctcatcaaagatagagtcagcgaaccgggcagtaaatagatcacctgttaagggttctaaatactttatgatcgacggagatttgaatcccacatagatccccactttcctgtgtgggccatagcagtacgatttgatggtgagatcggtatgtatacagcacatccgaacttacgcaaatgggaaatacttggaggatttccacatactaactgcattggggaagtttcatgatatgcagttggttgtagttggacaaggtcagcagcgtgcagaactgcatgaccccaacatgacgaaggtaatttgcaattcatcaataatggtcgagcaataagcttaattcttttgatcaacgattcagccaaaccattttgtgtgtggacatatggaacagagtgctggacctgaattcccaatgccatacaataatcatcgaaagcatgagatgtaaattcggcagcgttgtccatacggattgattgaatcctatgttcagggtaatttgccttcaaccttataatttgagacattagtttggcaaagacatggtttcgtgtcgatagaagacacacatgagaccatctagtagatgcatcaatcaaaaccataaagtacctgaacggtccagatcttggcacaataaggccacagatatctccttgaacgcgttcaagaaatttaagtggttcggctctaattttgagataagatggtctcaaaatcagtttctcagtagcacatgcagtgcatacgtaatcagaggatttgggaaatttatcagtgatcaaatgatgaccaatagagttgccaataatttttctcatcatcccgatactggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgcacccagcgatagtcaaaactttgccttctctctttttgagagtttgaaagtatttgatctccctaagtatagagtttgtggtactactgtccacaagacataattcctctccaatcggagtgatatccttagacatctatagtaaaagaagaattacttagtgaagaattctttatccacaatatatacatacatacaataatgaaaacataaaatacatagtatgacgtttacatatgttaaaagtacatactctaatgactagcaagtcatacaaccttataatataagggagtttgtacttatctacttattacaaccaatattgtttggcaaacttataggatatcaatataatgtctcaaacacactgagattaaagcagctttatctctaagtgggatgcactgagattacagtaaatctccaagtgggttcgttgagcagtactcgatgagcatgtcatccattgtagaaagtgcagtggtatcttctgggagaagagcgaggttgttctctggttcaataggagcctggtaaaaactttcaacctcaggtctttcttttgtaagattgaagtgagcttcaaatcttagttcctcagaagactttttctcctttagggatttctgatacaggagaaaagatgttgttgggatgcggcaatctttagcaacatgatagtcagatccacacctgttgcaatgcctgttgctattgccactaggttgtggtgccttacccttcccttttcctttccaatcaaccattggatttgcgctgttgttgcatttgcgttttccagtcagattcttagggttattcgaggaatttcccttgaatcctttgagtgcgatactgttggttcagtatcatgtcctctggaaacatagttgatagagttttctctatcttctctgcttccgttggctctttttcgcaaaacttcaacttggagcaaatgttaagaacaacatgattgtattctgccacagtttttaaaatcctgtaggcgtaaatgaatccactcataattagcctcaggccaaatgagttccttttgctgatcataagctttccataggttgagagggctcgtctccaacatgtattcatgtttaagatctttatagatgtagagccttagaagtaaaagggcaatatatagttttctgttctcaactggtagatcccaatcattgggttcctaatttgtatgtgaaatcccactagaagaaaaatttattttgatattggaagcccaaattgggtagttactcccatcgagggcgagttcgtcgaactctatagttgccatgtccctataatcatgataaacattattaatttacagaggtaaattaataaaaagatgatattgtggttgtaatctcaatgcgaaatgtaagacttcatattttgtaatgtttcgaaaaaatgcaggtaatagacctgacaatttgagttagaattcaaaattaggtggcacaatgtggataatctccaagtaattaaacagtgtagtagatctcttaatagtgggcaagttatacttgctgcctaaaacacggtctctaggcaaatatattctggtgaatataccgcagccaatgtttaggactccactaccttgtgctcaaccaaaattccaataatctcattttcaaaacatattctcggaaaaaaacacatgtcggtaatcatcgtgagatgtagacctctgtgagatcggcgagatactcgctgcctaggttacgaccagtgcggccaatttgtagggctccatcgggtaatcatctcaaaatgtagatcacttgttgatgggcgagatactcgctgcctaagttatggtcacgatgaccaaagtataggactccatcgacatgtgattaatttccaagtcaaagtgtgaagtggaacatgcattaaatcatccattaattatgtagtacataattaagagaatttgctaaattaaagtataaaatttataaaattttgtaaattaataaagcaagaaagtagagcatgtcttgaaataatatgcaaaaggcattttattaagacaactaataaatttagtgaaacatggtatttgaaaaaacacctatgttaattaacacataacatcagtagtctataggaccattacataatttgtagaactgatgaactgtttccactaaattaaataaaaatacagggactaatatgaaattgctgctaaaataaaattaaaaactaaaataaaggggtaaaagggtgg

SEQ ID NO: 8987 - DNA, 30046 bp, Oryza sativa
ggtttgagccgccgccgccgcacatgacgctgccgagacggcgccgcctccttcacctcgtctgccgccgccgtccatttcggcgcctcctccttcaccactttcgctgccgtttccaccgccgcctctctcatctaccgccgattccattttcgccgccaccatctccccctgttacaccaccgccggtgcctccatttctgccgcccccaccgccacagcagccgaagtccccgtcgtccgccggcgagactaagccgacggccccctctcctcatcggagtaagagaccagtcgggttcggacgctgttcccccccccccccactccgttcgggagcgtgcagctcgaggagccacatgaacggcgcggaaagtagcggggaggctgagcggcgaacgggaaacggtgccggcggcgactctatctccagtgggagggagcactgctcgccggggggcgtcaccgctgtccatccatggagcctggacctggacgcaacggggcaccggtgcactcgtggcgggcgcttgtggtggtggagtcggaggtgtggcagcgacggcaaatgcggcgccggggatggtggcggtggccaccaaccctagaatggcgcccagcatggcgatggtggtgactccatcgaatcgacggaggaggtggcgaaggcgatgaatgcggtctcggcgatggaggccgagaacggcatcgaggatgaaatcaaggtagacgtacttacgcgatttccttagtttcttctgtttctttcgcttttcttgaaatcaaaagcaatgtttccttctttcacttcgtgatctccttcgcgagagcgaaagtgctaataacgtgttgaatgtggatagaattgattgaacgagagagattgagagagagaatttaacacaagaatgtatcgcgaaagtgctgataacgtgttgaatgtggatagaattgattgaacgagagagattgagagagaatttaacacaagaatgtagggaatgaatgagcggatcctttattgataacagtgttacaatatacagggggagagaggcgacaactggaggcgcgaccgttgctagaatcgccgtgaggcgagaacatgtgtggggcacgaccaaccgttgtgtccctgagttggttgttactctatccatatatatggatgagatcacccaaatatttcataacagtttgacttttgttctgttgattatttcggaaaattactccttggctatataattgcaagggctcaactctgttttaccacaaagttaactgcaattataaatttagcagataattgagcagtatgtacatttaatttgccacttatctcatcgtatcccttcgattttactttggtctgccttttctgaacttccatactgtggatcaattaatatacccacatgccacatggtacccacaagaggaatacacagaaataaagcctctccccattacctccctcgactctattgtgctctacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttctagggaaccggtttttttacatgggaaacttcaatggtggggaaggattatagagatataagccacgaccaccaaatgcagcttcgcagctgaatcagcgaatcgaagtgagaaaatccccttctctgaaatttacaatcttagcaagagcactaacctcttgaaaaaaaattttagtcggtctctctcatcccattcctacatttttcctacgatccaatcaaacaaccgttcctatgttttttcctatattttgtaatcctctgttttatacttgcattcttatcaaaatcctgtgtgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacagtagcccccgagacctttgcagtcaaccatcgtagccttctcaaagataataatccgagtgctttcaaacctttcatgccaagactgtaaagggcgaaaagataaagaatacggtgcatcgaatagatgcacctaattaggtgtagcccccaactatgtgattagttaacaaactaaacatatagttgagaacaaaataatagcacaatcgtgcatcgcatgacaaaagcatacgcggcgcctaaagaggcattctagccgactgctttttagccataataaaaggaatccgagtggttagcactctaaaaggttcacgaatgaactcacttgacaggcatccgaataaaaaactctaaagattacccaccaaatattataaaaattatggtaatgaataagtctaatagcctaggctatgactatttaccataatgaaaacaggcatataacataccaaggaaatgactatgataaaaacaagtcattctaagttaaccctgacagctttcgtagcctaaaaaagcttacaaaaacggcataacacctttctgtcgggcaccttttaatttgcattgcaataattccaaagaattatatgaccgcgtaaaaaggattttatcagcattgggcaacactattgtgcgcataaattgccaaagcaaaaaaaatgcctaagtccctaaggagcacaatgggccacgctgtttaaagtactgggctgaggtactgttcaggcttaggcccatttgcacctccgatacccttaacaataaatcccaagatccaatcgacgcttcgtcttccccgccggaactctcgccattttccccactccctgctacagtacagagctgcgccggcaaactagggttcaccattccactcaaatccaccttcgaaaagttcatcaaaatccttcctgtgatccaccgcctcaatccctcacttctcccaagccatccctcgaatcaaatcagcgcattcggataaaatcaatggcggaagagaaagaaagctttgaaggccaatgggcgccatccgacgtgacagaggagaacctgaaggagatggtggcgcacggcgttctccctgctaaggagatcatcgggtggcgaccagcgtgcggtgaggcttttccgacccccgatacacacgaggttgtagtcttctcccatttcttctatggcggcttcgctcttccgacctcaaaatttttccgcgggatattaagcttctatggaatcagcttgcatcacctaaatccaaattccatagtccacatcgccaatttcgtccatgtttgtgaagccttcttggggattaagccccacttcgctctgtttcgccgaatcttctttctcaagccccaaccgaacaagagtaagccatgtgtagtcggaggggccggatttcagctgagggggactctgagccaaaagtacttctctatgcccttcaagacttcaaacaaagggtggcacgcaaactggttttatattcagaatcctgagcctgctcttcctgagtattcttgtcttcctccggtgtaccaagatacctggaactctcttccgattggggatgaagcagcccaagccttggaattgatggatcgcatgctaaaactcaaagaacaaggcttacaaggagagcagattactcggcacttcatcaaatgccgattggcaccaattaaagaaagatcccgtacagcttttgagtttgacggcaagcatgatcctaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgtatctgaaatcctcaacccgttaccaaaacataatcttgtcttcatgttgagttatctaaccgtggaggcatctcattcaggaatatgtattgatgaagtctgaccccccaatcactcagcgccggtctcctcgccagcacaccgttcagggaggtggagggccgacaatcagatcagacccacaacctcaaacctccaatccgactgggcagacaggttctcgcaagagaaaactggtgcttaacgacgacgaaggcgacgacggcaacaaatctgggaacaaaggcttgaccaataaactcccaaagcataccactcccaggaaaaactggctagccgtccaatgccaaagattagaacatcttccaggtataaacctctcggtatcatttcacttcggcatgcttctctcatgaaaataatactgaatattgaaagaatattttgcaggaaaccatccgacatagatccaactggaaaagatcctgatccggctgtgacagagccaaattcatccaaggattctgagccaactgccgaaagccagccgactggcgcccatacttcaggtgataaggccgatccgagtgaccaacctccgactggaaactagtcggcagcaactgaaactacaacaactcaagagcccccgactggaaaccagtcggatgtaggtccagatcaagaaactcccgaagttgaagcgcagacgacaacttctcgaggaccagaggctggtaacgactcgatgattgggtctccgaataaagaacaaggatcaccttacgttcagctaggaacatcctcaggtaactcatcttctcaagtgatgccgatttgaataactccagcttattcgtctaatgtcttggaaatacatcagaaccaccaggcgatgaagaagaaattctccgcataaaggcggctgatgactctcgtcctcctatcttactcaaatggtgggacgagaactcacaagctgccggcatcgtcataaatcgtcaaaaagaagatgaggaagtgtgccagctgaagaaagcacttggagaagccactcgcattgtgaatgtaaatcttccgggcgactgcctttgatgactttgttttctctttagcagaactaaaccatgaaccatcatgcagagaatccatcttcgtaatgaggccaagaccgcaactttagaaaagctggttcctcatttgggaactcttgaagcagttagggaccagctacacgaggccaaggagcttgccaagaagacagagaaggaattgagggaccaaattgctcagctccaggattcaaacttcgagctgagaggttcatcaaaaggtaatcttctagatctgtcccattaatttacgctgtcataactgtatcctcaaccatttggatttcaaacagcgcaagccaccaggatggcccaaatggagaaacaaattgaagccttgaaaagagacaaggtagaactggctgcacaaagggactcggccttgaaggagattgaaggtactgccagctaacaatctgaacttctctcttttaaatgcagcaaattcttatcataaatatgttttgtagaccgcaaaatcaaatctcaagctcaatttgacgtcctggttggcaagatcaagaggcttgaaggagcaagagatgaagtcgctagtgtcgctacgccactcgtccaagctatgttcctcaataacagtggtccgagtgcactcgacgcaaccgaaatcttcgacaagctgagagttgctccggatgtatatttcaagaatatcaagaaagctggaagcatgggagctagcatggcattggcgatgaccaaatccttgtacccaaggattgaaattgacgccattgatggctttgctgacgggacaagcgaagaagctgctcttgatcttatcagcaatgctcaaaacgcggctgacaaaattgcaagtgacgttgtagatagattccgcaataccgacctgcagccgagtagtaacaactctgatgatgaaaaaactgaatctgactaagtatgaatgtaacaaatggaggctcaacttgtacaatactagtgtatttatgctgtgtttgataattctagccaagtctttgatttcttaaaagcttttatcaagctttgttgagcctaaaacccaaagaagctattaaaaactttcagtcctcgcagactaagtagaaaaatcaagcaaggcaatgatagaccaagtaagcaaattgaattgataaaaaatcacactccattattatgataatagcccccgactgacaacttcaagaagaacacttgatgttgacagtcaagatagggaagtacaatgataagcttaagcgtagaaacgacgaagatgttcaatgttccaagagttgtcgacgagtgtgccgtcttcgcgcttgagtcgataggaacctggtcgggtgacttcagagatgataaatggcccttcccatagaggagataacttgtgccgatctcgtgtagtttgaattttcctcaaaaccaggtcgccgactagaaaggcacgggatcgaacattgcgattatgataacgccgcaacccttgtaagtatcgagccgactgaatcaaagctgcttcgcggacttcttccaatcggtgcaagtcatccactcggtcctcttcatagcgttcttcgcggaaattacgaaagcgcaaagactcgaattcgacttcactcggcaacattgcttctgcctcatagacaaggaaaaaaggtgactggcctgtggcccgactgggtgtagtacgcaaagaccaaagtactgatggcagctgttccacccatttgccggcataaggttttagccggtcaaaaacacgcgctttaatcccttgaagtatcatgccattggctcgctccacctgtccattgctcatgggatgcgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagctttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgggctggtagatgaatttgtctggcgaaaaattggcaaccttcgcacgtgcgcacaattttgtcggcatcggacactgcagtaggccaaaagaaaccctgccggtaagctttgccgacaatggtgcgtgcggcagcatggtttccgcatatcccagaatgtatgtctttcagcaattgtctcccttcctctaaagatacgcagcgttgcaggatccctgaagggcttttcttgtacaattcagcttcatgcataacataaagtttgctccgccttgaaatccgctcggcttcatctttgtcttgggggagttcttgagaggtcaaaaatcgtatgaggggctctcgccagtcggcttcaatcatagctacgtcatgagtgcccgcaacttgagtagtatctttgtgaggtactgtcggcgcataaaggtgttcaacgaaaacatcagagggcgccacctcgcgcttggatccaaagttggcaagtctgtcggcggcttcattattgtgtcgaagaacgtgactgagctcgagtccatcgaacttgtcttccaatttgcgtacctcctgtcgatatgccatcatattgtcgtcaaggcaggaccactctttcataacttggttgacaaccagctgtgaatcgcctcgaactattagacgctttatccctagggaaattgcaatccgcagtccatgaaggagcgcctcatactcggcgacgttgtgggatgccgaaaaatgtatccaaagcacgtagcttaatctttctccagttggggaaattaaaaccactcctgctccagtgcccgaaagtcgttttgatccgtcaaaatgcatggtccagtgctccatcttctccgcgggggtatcctcctggcactcggtccattcggcgacaaaatcagccaacgcttgggacttgattgaaattcggggcttgaatgatatgtccaaagacatcaactccaaagcccacttagcgatccgcccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcgcgctcaacgaccaagactgtgctcacaacctgggaggtggctgatacatacagcaacaacggctcctgcgggtgtagtgaggctaagattggtggttcggtgaggagtttcttgaaatcttcgaaagccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcacttttcagggtttaatttcatcttgaaagcgcggatgctcgcgaaggtttcttctagatccgaaatcaaatcatccttttgcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaacgaagtcttcaagcagtcggattcctttagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgaaggacttctttgatgaagcctgccgctaacagcttggttaatttctccttgatcgcgtccttcctgtcttgtgcgaatcggcggagtcgttgtttgataggtttagcatcttctttgacatgtaaggagtgctcaatcacctctctaggaataccgggcatatcagatggtttccacgcaaagatatttttattgttctgaagaaaggtgatgagcgcgctttcctatttacaatctaactcggcgcctattacagcagttttagtagaatcagaaggatctaggggaatctttttagtcttggcttcgctttctccattttttgaaatcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgctcggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcaggctgaacagcattaatctcccgttcggtcaacttttgcttccttttagactcataagccagggggccgccgaaaatatggttgagctccttgcggtggtcttgaaatcctgcctgggtgtcgccgtcgtccttcttcctcgacgtgctttgttcttcatcggagttcttccgtgtagtcttggtgtattgctccgcaaactgcttgtagacgaaacaatctttgggcacgtggttggagttaggatggtgcgggcattgagagttcatgatcttgtcgaacgtgttgacgcgcgaacgctgtcgagaagaatgagtggcggttgcaacaagttcctcaggcttacgcttgcggtccttatggttgttacttccacctcctcccgtagccggcgtacccttgtttggcttccaactgggacccgactgctttgatgcggtgacggcgtcttcagctttggcgtactcgttggctttttcaaacataagcttgactgtcctgggaggcttacgcccgaacttgccgaccaattcttcgtggcgaatccctttggtgaacgcggcgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttgaaagttggcgatgaagtggtcgcgtaattcggcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggcaccatcgtacttctctattccagtcggcttaaagccagctggccaatccactcgacgcaggtcgtcggtgaaggctgctactccgtcaaggtcgtcgtcgtggcggtccggcgaatgatgatggcctcgagctgctcggcgctgtatgattgtatcgcgaagatcgacggggcggcgacgaggtggtgagcgaggccgttccactcggcgctccctataatggtcgggaggtgagtgaacggaccgctcgtcgtgacccctgctcctgcgattggatcctgcgccggtggtgctgaggcttggatgacggtagtcatgagatcggaagtgagggactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgttgaggggtacggaaaaccggtgtcccttcaacatcttgttggccgatgaaatcacgcgctcggcgccctgcttccaaggctcgctgccgtcgatcctcagcctccttcgcggtccgctcacgctcctgctgctcacgccgtagccgttcttgttcttgtgcttgactctcctcctccagtcggcgacgctcaatttcgcgacgtgcttcggtttcccgggcttggcgttgctcctccgtctcgttatcggccatgaagacgccgaagtagagaggggtgtagttgtcatctaggcttccgtcgaagtcgtcgagatccagatcgttgtagcgagagctaaactcgtcgtagtccacgatgtcggtgggacgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggaggtgctgtcgcgatggagacggccgctaaatcgtcggggagcttcatcaggattggtgggtaagccccatcatcttgatctggtgacgttggagaagatgtgatctcgcctgagtggtttgaagccgactcgattgagatggtcttgaagtaacttccagccgcgtttgggagtccaaacgggactgaaatccggttctctcccgactggtccgactccgagtcaaggagagagatcttgccgaagttgttggtgacgaagtcgaggctgccgaaccgaaacgtctgcccgggtgggaagacgaggtcgtcgatgccggagacggatcccattgcactgatcggcgaaaagcttgacgcaccccctacctggcgcgccaactgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacactgtgttttttctattcctccgttttttgaaccctgcgatttaaagagatcctaagatgtcacatctgtgcatacaatattacaaaacgatccagacccacaaacatcggattggatagggtccataaggggagggctaatggccgggtgatcgctcgcccatggcaatcgggcacccccccccctccctcccctaacacgcacgtgcctccccgttgctcccttcctactgcaccatgaatttcaaaccattaaaaaagaacaagttagaaaagaataaaatataatataaaaatctagaatccttaaaaatatattcatgtgactttatacttataaatatatacacagtaaacttcgtatgtaaacaaattatgtatagaaatactctatataaaaatatttgaacccaaattcgaatttgagtcgcgtatataaactttgaccaataaattttaggtgtataaacttcagatgtataactttaggtatataaacttaactaaaaagaaaaactatatggtgccaaaaagaaaaggtaagtggtgaaaaaagaactatcgtctggctcgattgattgctaattagcgatctcgggtccatccaccgaacggtccgacacatagatgaattgttccggaacgattctgtaatatctttgtcgggtgattttttgtttggtatttgacgtttttctgttcgttggattgcactatgattcgtgctggaacagtgcgggatgaggatgaggcccgtgtttggacatgcctcgtggtagtcaacgtgactcgatctctgtgcgaaatttttgattttgcgcgccatgtatgtagagtgatttttttctattatatttgatgttttcttagctgtaggatcatacgtcaagattagtgcaaaaaattacagtcctatataactaaaatcgttaataaattcagctgatatgatatgcaagtgtactgtaattttggtaaaaatattatgtatgtaaatatgtatttgttatttcctttaaaatataaaattacagtcctatataactaaaattatatttatttgtaggtttagttgatataacatgtaagtgtacttttagtagatgggttggtgattattttttcaatgtaaagatctaacaaataaaatatatgcaatatatataattaatatatgttgatacatgtgcactcttctaatcaagtgatcaaatgagcctaattcaactatttaaagtcaatatgatttggatccaaaaatatgtcgcgcgatatatagctagtaccgctgaacctatcttattagtcaaaacattttcaacgatgtggatgagaaaagggcagcaatttgttactgatgcggtgatgccgatatgatatttgtccatcttaattgcttataagctgtatatctagaatcatgtgacaccatcgtttcgcttattaaccgaataagcaaaacaacttatttgcaaacagaaaatattttgtaaataaaacttttagggataattgctcatttaaccctattttagaatctaactaccaataaatttctagtttgcttatttaaccatgcttttaaaaaataaagttaccgtttatccctattttcacaacgatgttagggtttcgtttagaaaaagaaaaaaattgtattattttcagattgaccaaaataaccttaagaactcaaccctatccattcacttccaacctcatccactcattccttatctctttcaggtggcacgcaggggagggagggagcggtggtggtggcggcggcgcgggtagagagggagcggcggcggtgcaccgaggaagggagcagcggcgctaggtgttgcgcggagggcggaacggtggcggtggctgctcactgccgctgggcacggaggggggcgcatggagcaggagctcggcggcgcaggtcgaagagggtggtgcagctcgccgctgggcgcggcacagcgcaggagctcgacggcatgggaactcgccatcgctcggtgcaaagggaggggcatggccagcgatgcggtgaggaggcgcatggagagaagacctcgacgactcgacgcaaagcacttgggcgctgctcacggcgcaagaaagggggtggcgtcctccttctccctttgcggcggtggagtagagagggggcggaggtggtcccgcgacgctgtagatctgaccatcggcgtggtggatggaggcggcgagccgtcggtcgtggttgcaggcgatatgcacaccaacgacaacaccatatggggattcgaggagatgtagatgtacttctgcttgtgttgaacatgtattggtgcttttgtttgacatgttttttttgtggacacaaatttgtaccatgtatatttttttgggcaatttaatattcactaattggtttaaattcacaaggccataaatgaaattttcgtctggagttaacactgtcatgttgtcttcacggaatatggttaggcctcatcttcgtttctacgaaagagggtcaaacaagcaaagtcaaaagatcaaggctaaattggtagttagttttaaagtagggtcaaaagcgcaattaccctaaacttttatatacatgttcttagcaatgtaaaagcaaaggctgaaaaataaattacgatgaaaaaaatcctaaaataaactcgaaatttaatattgaaaatttaaattttaacttataagcataagcataagccaaaagttaaggttgatgtacgtcagcagtagcgcgcaactcgttttttcacttatcagcatttctacttaactagctgccttacttcccacgaagccgtataatttcacggaccacgaacgcataaagaaacagaagtcctagactttgatattttgaatcgaccggcaagtgtatatagagccaagaagtcatcttcacaaaggatcagtaaggtggcgtttggatcgagggacttaactttagtccctatatttagacactaatttagagtattaaatatagactacttacaaaactaattatataaataaaagctaattcgtgagacaatttttttaagcctaattaatccataattagagaatgtttactgtagcatcacataggctaattatagattaattaggctcaatagattcgtctcgcgaattagtccaagattatggatgggttttattaatagtctacatttaatatttataattaatatctaaacatccgatgtgatagggacttaaaagtttcagttccttctaaacagggtctaaattagcccttgtaagtctataggcccaaacctatcttgaatgctgacagtgacgcgagaggaactatacaactacgatcatgctcgaaagtgctagcgtcatgtcgtagtatatcttaccgtacagcaatctaaacattgacgagtctagaaccacgacgttttttttaaaaaaaaaaagtttctcaaaatgagtctagaaccacgaccaaagaaggtccacatttgttggaattaatatacgggtctttttctgtttaaatattaattatttgaaaagtcacaaaacctcatctccttaggtgatatgcatgcatggagatgtttagtaccacattacctattttagaagagggagatatccttataaggaaggacgctctcctaggcacttgagccatatgtggtggagagaacaagactaacatgcacgtgctcgctcacttggtcaaccaggccaggctatatacgttgtgtggagatcgtgcaggcgtcctgataggttgttgggaaattcggttgcctcctcctcacaacacacgcgaaaagcaatttaggatttgcctcctcctctatactggctaatccaggttgttggaaaatttgtttttggaaacgtagtttttgaaaacacatcaaataatctagtgcgtggagcggcatggtgtccggataagttatgcgcaacttatcaggttcggttacgtgatgtggagatcgtgcacatgtcgtaatatctttatataaaccgagtcaccgcctccttacaacacacgcgaaaagcaatataggatttgcctcctcttctgtactgtattgtcgctcgtagtctattctgtcccgatcgctagcgtgcaccgactatcgggagagtagatttccggaacattcgtcttcgatgccctgcatcgagagaaggcggtaataaggattctaggaagtgcttcgcgtgactgcttgctgttcgtccaccacgggtcgtcttactcttcattcgtatgctacgtgccatcgtcaacatctgctaccgcgagttcttcatgcggtgtttgctgctcctcatcaacccgctccacagcagaaccagagtcctcgatacgtgttcaccatgtttcatctatttgatcagttcatgatttactgtctagtttacatgtttagatttcatgatgtggttctgctagtatacatgttcaatgtctttatttattgatggaataatttaaatctacatgtgcgtgcttatatattcaacacatttctcaacagctaacacaaatacgaacttggtggcttcttttcaattacttgatgaagacaatagattatagttcttgacgagacattcaacattgtagttgaaatattttttcctttgagatcgtttaggagtcaaatatttgttacaagctcccagatctgttttgaaaaaaaaaacaaagtttttaagttttcaaatgatctcggatagaaatatgttctatttcaaagttgtatagctcgacgtgatctaaaaatttgaaacgtgaatttacattggttctccgcggttactatgttgtaacaattaatgatcggcaaatatcgtaccaacggccggccatgaacgaacgagaaaacaaaaggcctagacttggtcttgtggatcaactggcaagtgtatatagccaagaagtcttcttcagtagggtatatgatcagtcatcccttgtaagcgtacaggtccaaacctatctcgaatgcagacaaattaacagctcaacggaagcaaaactttgctactgcgattatgatgctcgaaggcaccaacgccatgtcctaatatatcttaccgtatatagtaatctaaacacgtgtgtagaactacaaccaaagaacgtccaagtttccaaacaactgatacaaatattgacgaataagaatatcacatcacacatacaacatccgtgggatttgtcattgagtcaaaaacaagaggtcggaacagaataatgttgcaaacatacaaaagtatcatcttttcattacagccataccctagcgtacaccaaacggatacaaatatcacttggaaagaaaatacatggtacttgaccagtattcgagagagcgaggacactgtgtggatgaaagtgaccaaattgtcgaagggtgtgtttagttctttgggtgcaaagtttttgaagtatacggatacacatttgaagtattaaacgtagactaataacaaaacaaattacagaattccgcctgtaaattactagacgaatttatttagcctaattaatctgtcaatagcaaatatttaccatagcatcacattctcaaatcatggcataattaggctcaaaagatttatctcgcaatttacatgcaaactattcaattggttttttaaaaagatttaactgtaatgaatttaatggtgcaatcaaataaatattttataaaaaaaatgttttgaggtttaaaatcatttgtgaataacaagtcttgggcgtcacattggacaaagtgaaaggtatacccaacgtagccgcaagcagcagagccacctaaatcggacggtgtagatggcacccaatattttcccccaaatcggacacccggcatggaattctttccggattaatgcaaatgtgatgatgtctgcagtgacaaaaccactgcttaatttttttcacaggtcataacctttttcatttcatatgcaaccccgaaataaaaaccatcattaaaaatggccgtggccatctcagaatcataaatcgcatgtaaaaaaattacatatgggtaaaaaaacacgtgtaaaaatacgtctatcttcatggacagttttcctaagaaaccatctgtgaagatcatgatttctatatagacggttgtcttaatgaaggcccgtaaaaattgatttttgaggatggttctcttataaccgcctttggaaacatgggaaatattatttaaaaaacattcataactccactatatgaagttggatgatgaaaaattttatctgagagaattgtagctaccgatgagatctacaacttttttgttgaacaaatttacattagtttagggtccaaaaattaattcgttacaagatctcatatctatttttaaaaataaaattttgagtttctcaattgaccccagcgggacccttgttacatatggagtcttctgacagaagatctcagattgtttaggtgactatataatttttacattgtctgagatatattttacgaatggttcttttatgaagtcaaaactttaaaaattatagaaaaatcattttaagtccaattgtggtaaaacaaagttctttgactaacatcaactttcgtaacatatcactcttataaagacttcatgacataagtaaacaatcatactaattaaagaaacagtttaagaaatatagactcgatcatatttaagaaaatactgtaaggattatagggaactttgtttcaactcaatcagacttaaaattgaattttctataacgtttgaaaattagacattttcaaaataataagagaaaaatgttttttttccgtatggacttctttaagggatctccctttaaataatttttataggcggctctcataaggaaaggcctgtaaaaatatgttttataggtggttctatcataaaactgcccttaaaaggggaggagagcactactaaaatatgacttttcataacatatgaagtatgatggtgacaatctttctatgagaatctaattgtactgactgcggactgtggagttgtggactccctccaacaaatagttgtttataatctgaatctcaaatatttctaaatatatctaaatatttcagatattatttctctacattgtgtattatttcaatactatttatttctttattttcaaaccgaattttacattgtattttttttgcatgtagtattatttaaaaaatatttatttattataaatccaatatttttcaaatatctaaatcgtatttcaacatggactcttctctaaaaactatttattttttaatctgaaatttacatatttctgaattttatttttctacatggactattcttttcatattatttttaatttcgatttcaaataattctaattcatctttctacttggactcttttattataatattttttattcagaattttagactttaagttatatttctacatgagcttttttttctgtttaatttgagaatttctatgccatgatagagaatgtggtggcttatttttctattaatttattaagataatagactataatcctcaacgagatctttaactttctagttgaaagttttgtttttcatttgagatcgtttagggtcccaatattcgttacaagctatcatatctatttataataacatttttttagttttactaatgacctttggatggagacatcttctatatgaaagttaaagagctgggagcaatctaaaagtttgtcttcaaaatttgtaacatgaattttgtcacttttttttgcagttactctgcgtggtaaccatgctaccgttagggttggtaaatcctctcgaattcctaatacttaacatgcaaagataccacatcatcatccactaacacttatcatatttaagcatcatgtaagcatgctatattatctataatttaatagtttattaaattttagagaactaaaatgtaagcatgccaaatcatccaacataattcacgtaatatttcaatatatctctccatcatttgcctatatatatttcatcctcacctagttcatgttatttttgttttctctcgttaagtcatatctcatcaattgtttatagtcctaagatgattaatctatggttcaaattatctctcttattttcttatctcattaagccatatcatctcaatttgttcaccccttagatgtatgatctaaattatcttcttcttttggtctctcataaaaaccacatcatcttacttttacatgaaccatcattctaatactatttaaatttaaatcacatcaatttatataacttatgtgtatgtaagcttatgttgtttaagctatcttacacattatttttactagaaaaatgtctgtgcattgcaacgggtgacgactattttgatcttattattgttatacggtttaattaagataaaatttactgtgtaattcgcttaaaatcatgagttgtaattagagtccgatcatctcaagttagcatgtgagttttttttaaaatgatttcttatacgactcttatgtacttatgtatttgcagaagcaaacgaacttaataaacgactcaaatacggatatgtattttcaaaagtgaacgaacttgaaaccgactcatacacagataatataccaaagcattggcaaaaatatcttcaatttttataatagtagagatttattcttatcattgtaaactcctgtagtaacgcgcggagtttcatgtagttaatagcatgctaagaacggatgagagaaaacaaaatatttatacttgcgcgctgggaattgactggcaagtgtataaggatgaagtcttcttcagtttggtcggtgagtcgtcccttgtaagtctacaggtccaaaacctatctcaaatgcagacagtttagcagctcgacaaaagcaaaactctgctactgcgattatgatgctcgaaggcaccagcgccaggcccaaatatatatttcttttttttaaaaaaaattgcctaaatcttatcatatagcactctaaatattgacgtgtctaggactactcccgtcccataataaagtaagtcacaaataaaataaataataattctaatatttttttaaataggacgaataattaaacagtgtagaaaaaaaaatcaaaatcgttaatattatgggacggagggagtacaacaaaagaacgccattcccagggactgatacaaatttcgacgaataagaatcacatcacacatacaatatctgcaggatttgtcggtgagtcagaaacaggaggtcggaacagaatgttgcaagcttacaaaagtactcgatccgtatcatctttgcattacactcacaccctagcgtacaccaaacggctaaggccttgtttagttcacacataaaaaatttataccatatcacgtttgaacacctgcataaagtatttaatataggttaaaaaataactaattgcacatattgcggataatttacgggacgaatcttttaagcctaattgctccatgatttcacactgtggtactacagtaaatatttgctaatggtagattaattaggcttataaattcatctcacggtttactgtcggattctataattagtttttttattagtgcccgaacaccctatacaatactcggtgtgacacgctaaaactttacacccctggatctaaacaccccctaaacatagcacttagaaagtgaataaatgttacgtgtaccagccggcattggggagagggcacttgatttggatagaagagtgatcaaattatcttttttttgagagaaagaaatttaccaaattatcaaagccgtgagaagcatcaacttttccgatacgcgaaggcacagtgccatgtcttggtatatcttatcgttttgcaatctagacattgacgcgtcaagagaacaaccaccgaagaaccggttcgtatttttcaacaactaatgcgaatatatatggataattagcacatcacacttatagccagcgtacaaattgtcggactcagaatgaggttggaacagaaggttgtaacttgcaacccgtacaaaagtgtcagctttacatttacgcgtgccccagcgtacagcaaacggctagagataagaactttgaaagagaatacatatagattaaagttataaattgtccaagctgcaaggaacatcaatttttgtgatgcacaaaggcactggtggcttgtcaaagtatacgtaccttgccgtatcggaattaatctagacattgacacatcacgaactatgactgaagaacgcgtccgcatttctcatcagctgctgcaaatattgatagagaggaatcacacatcagacatacaacctctaatggatttgtcggatagtcagaacaagaggtcaaaacagttgcaaccttacagaagtgtcaaattcacaatgttgcaacctcacaaaagtgtcctctttacattactcataccacaatgtacaccaaacagctagagataagcacttcgtatttggactactcagtagccggtggaggactcgatgtggttaaaagtgatcaaattgttaaagctgcaaggatgactccctacaggcatgagaaacttgcaaggaatgtatcatgatactcttccaggcaaagcaagtgacaccaaagattctcctagcggagataagaggaggctcttggagagggaatattggagcattgcctcttcttttaatttattttgatcatagaaactttctaaatttaagagagggaatatggactcgattatatggactgagtaggtctaaagggaaatttaatatcctctcactcctacgcactacccttcagcactatccactcgaactaccccgatgcaggattttaggaatcgaggtacgatgttaaaagtaactacttcatttcatattaaataagtcactttggttctgtcctaagtcaaacctattcaaatttgatcatgtttatagaaaaatatagaaatatctacaataacaaattagtctcattaaatttatttactatgtcaaactggaagatgtttgactaagcacaaatccaaagtgacttataatatgaaagaaagcgagtattgctcaataaaaatgatgcaggcctgtgtaagaagaactaatatgaacatagctgaaagtaaagtgaatatggtgtacaataaattactaaactataaagtactcaattgaaattcctttctgaaaaagggacattatgtatttaccatgaatatgtagaaaaaagtcattttcaaataatgtaatcaataaattgttcaagtattattatgttcatgatatttcttcatttatttcaaataaaaatcaattgcaatatttaggacaatgtccgtttgcaaaaatcaatttctatagacggtccttctaataggaccacctgcgaaaataatgatcgccagcgaaaataatgaaaatagttattttcgcaagcggtcctgttaggaggcttgcctggcaccaggccagcggttggcctgtccccactccctcttcttttatctcctctcttatctacttaaaaaatctcctcacccccctttcctcctcccttctatcctctcatcacccctcctccagtgccccctttttcatcccttcctccactgcccgtagtctccaggaatgacgtcgcgacgacagtggtgatgggagcggcggtggctagggcgatgacagcgggtggatccaatgccatcagacgagcaacgacgacgatggctcatcctccgctccctctccctctctcttactctctcctcctctcatcatccccttcctctcctactgtacaagccggcaaaggcacgcgaggaggttggtagattgcagcgacgatagcgaggggtccagcggcacgggaggaagccggcaaaggaggcacgcatccacggcggcagcggcgtgcttcgacaacatcacctcctcagggcatctctgccacctcgggagcagtaggccccgtcagggatccggcgttgccggccttctcccttgtggattcggcggcagcggccttcttcctcacggatctggcgctgccggccttctccctcacggatctgggggcgacagcctcacgaggggtggatctaccaccattggcctccctcgtaggtctggtgacgaaaacgagagcggcaagccacctagcagcggatccagctgccccggtccagggaggggcagatcctcaaccgccgtcctcgggtgtagcggggtctcaacgacaaccattgcagctaaggcagatttgagctagggttttgacattttctttttctttttttgcaattatcatttttgcatgcggactgcattactgaccgcatgctaaagttacttttcgcatgtagttgtgtttctcattacgaaaattactgattttgattgagaaatatatcaacttgttagcaaaactgaacttttttggtatatagaaaaaatgcctgtgcgttccaatgggtaaactaaaattataacaaatataaatatattagatgagtagggtttaggttttcatgatatgaactctttaagaaaatatattcctaaagatagaaagaaagttctcataaactgcaagggcattatcgtgcgcaatgaatgaagtgcatgcagcccaagagtgctttggcccggcgatggaggcctgctcaacgctggatcggtatgagccattcgttttaacggacgacttggatcggttcagaataagtcgaaaccgacggtgcccaaaaaccctaaccctagtttcacatcttcccctcccctcccatcaccgccggccacctgtccccaccggtggtgcctctccccctcaactcccctatccccataggcatcaccactccctctccgccgctccccatcccccttccctcccctcaccccactatcgactcatttcctcctcgttggggtgctaccgccaccccgctcctcactagatctggtctgaggctcatcaggtctggccttgggaggcggcgacgggcggcaatggcacggctcaatcgagccaccatcggcagccactctgtgccccctccttgctggatctggccttgggaggcggtggtggcagctcgaaggcagcagcggcgacttaagctcgacgatggcaaactcatgccgctcgtgtctccggcgtccggcgaggtccgatggctggatttttgttcgatttgggtattttcttcaattgtcattcttcaatcactacaaaaaaccgtaattttcttggcggtcaaaaaccaccaaggttaattattccgtcggccgaccgccaactctagaaagctaggaatgttacaatttcttggcgcttaaccgtaaggaaatgccttctgggcggtcgaaccgccaagcaaattaagaagattgcccactttcgaaagcgccaagaaaagtaaccttgtcggtttggaccgacaagaatatacctttacttggcaacaatgaaactttctagacttggcggccaagagaagtaaccttttcggtcataatcgcaaagaatatgtacaaacttggcagccgttttttggccaccaaagaaatcacttcgccaccaagaaaattgcggattcttgtagtgaattcttgtatttgggatttaattcgaggaaattttgtgaccaattttcgtatgttgtttctcctggtgtaacacgaactagtttaaattttgtgttatttaatgcggactctggataatttttacccgcgttggactcaggatgttacgaaaaaaaaaggtgaggatggacggaaattttcaccagaattcttgcgtatctttttatacgggtataggtttctaaagacaagaactatttattgtcaaagaacatatttacttagatgggtttttttgtgttacatactgcttaaatgcaagatcaaattcaatctaacatgaagtaaaatatatattttgcaataatttatgtgtcaaattgaacatttgatgggaaattaaattgtaacctttaaaaacttttatttctatttaattagaccgcgttcatgcaataacgttaatttgggactagattagtatcctcaatcctcagtagcgaccaggcaaaatgaggacgcagtctatcgagacggtgacactgcaggttgaggttctataaaaccgaccagcagcctagagaagaagaggacaatgagcaagtgagcaactggctaggttacctggttagctagtaacaactcaaacattgtaagcgcatagaggagtctggtgctctactcaactctgaaacaatcaactgcaccagtgtactaattaaatatattactgtacttaagacatggctatcgcgtcgtcgtcgttttcacttgctgctatcctcctcatcatcatcatgtactgctgccccacgggtttggtggaggcagctcgcaaggggccggctgctgccggcggcggcgacgacagcgcgatgagggagaggtacgagaagtgggcggcggaccatgggcgcacgtacaaggactccctggagaaggcgcggcgattcgaggtattcaggaccaacgccctgttcatcgattcgtttaatgctgcaggaggcaagaagagcccccggctgacgaccaacaagttcgccgacctgacaaacgaagagttcgcggagtactacggtaggccgtttagcacgcctgtaattggaggtagtggcttcatgtacgggaacgtgaggacctcagacgtgccagccaacataaactggagggatagaggcgctgtcacccaagtcaagaaccaaaaggattgtggtgagctttaattattcagttcattcattcctttctttttttatatatatatgtatatcttctttttcctcctgtgtcatctcttaattaaactcaagtaactcgtaaaactaatcataataaaattaatgatcggaaaaattgcttacggatcaccagtagtactatttctatgttagatatctactagcaaatatgattttccatatattgattaactacttttttttttctttttgtgtcgtcgtatgtataaacagcgagctgttgggcgttctcagcggtggcagcggtggaaggcatccaccagatcaggagtcacaatctggttgccctctcgacgcagcaactgttggactgctccaccgggaggaacaaccatggctgcaaccgcggcgacatggacgaagcgttccgctacatcaccagcaacggcggcatcgccgccgagtcagactacccctacgaagaccgcgcgctgggcacctgccgcgcctcagggaaaccggtggcggcctccatcagaggcttccagtatgtccctccgaacaacgagaccgccctcctgctggccgtcgcccaccagcctgtgtccgtggcactcgacggcgtgggcaaggtgtcccagttcttcagcagcggagtgtttggcgcgatgcaaaatgagacgtgcaccactgacctcaaccatgccatgacggcggtggggtacggcaccgacgagcacggcaccaagtactggctaatgaagaactcgtggggaaccgactggggcgagggaggatatatgaagatcgcgcgggatgtcgcgtccaacaccggcctttgcggcctcgccatgcaaccctcttaccccgttgcctaataaactaaagagacataaattgagccgataaccgtgttagcgtctggtgaaaaagtagtacggcgtggtgtaatatgcgattcatgtgataaattattatcagtgtttgttatattttactatgccgttttcatgacagtattacttttagaaagtacatatatgtgtgctgtaaagaaatactttgatgacaataagtcactactacggacaagagttttttggacgcccggcacttttggttccaggcaggccataactcgaagtgcacagaaaaaatgaggggaccggcgccggactatcgcccgcacggaaaaatgcattttcccgtgcgggcgtcctaacccgaccgcacaggataatccttattatcccgtgcagtcgactttagaggaccgcacgaaaaaatcaattttcgcgtgcggactttttaagtgaaccgtacggaaaaatactctctctcttctctctcacccatttcaaattttttacacactctccctcttcttttttattctctctccccatttagtctcctcgatctcctcccctcccctctcctctttcttcctctttttctcatcctcacccctctctctctatggctgtatttagatccagagtttggatccaaacttcagttttttttcatcacatcaacctgtcatacacacacaacttttcagtcacatcatctccaatttcaaccaaaatccaaacttcgcgctgaactaaacacagctatttctctctgcgcgcacgcagcatctttacttcacatctttcctttcacaagaagcatcagccgcatcttctccatttctttttctcctctgcttttgaatgaactcgagaagcatcagccgcatctctactacccttgctctgtgtgctccaagtccaagcagcagctagctagtgtggcggtggagtcacggggatagggtggtggccgccggctgtgtggcgatggtggggggtggtggtcgtcgtggaggcaggcgcggacgatggcgggggccacgacaacgacgagcaggcggcgccgcgtgcac

SEQ ID NO: 8988 - DNA, 3190 bp, Oryza sativa
ccgtgcggtccgcccgcccgcacgcacaaaatatcgattttcccaaacgaggagctgcacgcagcccgagcgaccgcatgggataatagatccaaccacccggaaaaatgagtattgtagtagtgagttttttcatactttctccgtttcacattatgaaatattttatattttaatagatttatacatagatccatatatgtatttcatatatgtggacatgccgaatttaaaccatccatgtgaccaccacgtgattttgaatagtgagatccatacacacaaaaatagccactcaaatctcaatgtgtccatgatcagaactttacaccatttaatacaaaatccgcaaatctcgaataatgagcaaacgaaatattgatgggactcagcgtgccagtcaacttcagcctgatacatgtgcccgtcaaaccacacgaaggcggcaaccaactgtgttatacatctcgggaaacttactcaaattgctaagctcaataacatctcaattgctcaaaatccatactcgtgttagactacttcccaggataaggactagtctcatgctgtcatcgaaagcaatgataaataggaaataagacatatacaagaactaaaattcaaattacatatactttagacatacataggccaaccgggttcgcggaagcttacatgcccaacccacgagtaagccaactaagggtaaacccctagggtgtgtttggataatgggaaatggagggtgggattgagattgggaaatgaatgaagggttaggattaaatggaagagagagaatgaatggttaggatttaaagatgccttttgatgtgtgggaaatgatttccccatcccattagccaaacgctgccctaatggaatcaaatacaaaacaacaacgattcccgaccactcaaaataaactaagtcacctgcaaaacaaatttaaatatacatggcaagagttcacaaacaagttaatatactggcaaggccacaattaaacctaaataaatacaagctctaagcaaagaatggttgtttgtggtctcatattttcagcataaaagcaagttttagttcacaaacagtttgcacggaggttttataaagcatttgaaggacatgtacataatgtaaaacattgtgatcaacttaaataattttgtcaacataattatcatctccatgcttgcaccatccttccatgatagcaagtcatcataatcaacatcatatttatcataagtcatggatcccaatcctatatccattttcaaacatatttgaaaacatagaactatacttatggcacacatactatgtcgctcataaccatgagcacaactaatcgattaattttagactctaaaaaatttgtacagcattaaccacatgatgtgaatcgctctaatttgtcttgtacccatcagtaccaccacactctatatgttcaatgtggtttagaggtcacaaagtagtctttacattacttaattcctagccttgcaccagcacagcaagtgtggatccaccctaggaatgacctagagtcgttaggtggcgtgcccacgccttaaacctaacatcgcggctacgaacacgtccgttcccccaggaggcactataccattgaattggacaaacttagatgcccaaactaccccaataaaatacaagtaaataggtagttcccgcttagactaattcattctttcctggcctaccaaaatacaaggccatcccataactagcaaacgtggatgcacattaaacaatagtttaatagtaggtgactattgacgaataatccgtgtttggccgatggtgccagatatgtgttagcgcgaactaagtcgatgaatacaatgacttgggagatcttcttagctccagtacaggtcctaaaatgagatgcgagagtgccagtcagtttgatccttcaactaaccagatgtatgaattgaagatcaaagagtcgatcgtcagatactagtccttattggacacaacttaaacttctttaaagataaaaggaaaaaacataagtcccgattgaacactaaacacactttcctaacaactgactcttattaacgttcgagagagatgaaggcaacgacgaggtcgagagatgcgagatataagggagggataacgaggcaagcgagacatgaacgggcgctcaggagttgattttttttactccgcgctgtttttttttttttttgcacgtggttgctccaaatttgtgtcaggtaaataaagaaaccaacatctgtagctttttttatttgtgtcagttttttaagaaaactggtgtttatttatactatattgtaaaaaaataaaaaattgaagatttttgtgctgaaattttggtgccggtgtttgagttggttataagttgcccgtatcttattcgatgtgagtttaaaataactattatacaccttctagtccaaacaaaccggcccataccatcccgccttctcatcccgcatgcctccactcagcgtcatttacccctctcccgattaatatcttttttttccttccctttttttttctttttctctatttctttaatccgggacatcctgatccttccaatctcctttttctccttttcctgcttttttctcttccaaatttctctcctcataaatattttttaaaaaattataattatttaaggtgtgtatgtggcaacattgttactttacaaatgcttcaattttcagtaattttttcactaattgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatctagttgtctcatgcccctagagggagctccctgccctccttatataggttggggggcagggttataagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtac

SEQ ID NO: 8989 - DNA, 9293 bp, Oryza sativa
aatcaaaggcgatgacgaaatccaccaatcatgaagatgaagaaaatacttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcatttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagtttcttgtcgttgaatagttattgcttgattgaagatatgtgttgaagatgtccaagtagaaatcatgaatgttggagagccacttgttgtagtaaaataatacggcatcgcatgccgagatgtcgagattcacaaagacgtcatggttggtgaagtagcaaaacttgtgaagtagcagcaatagagtttgctggtaccgaagataataaagatgaagtcgctccaccatgatgacaaagttgcgttgccgtgatgaagtgaacacgagtcggcggcaacggaagcaaaccggtagtgaagacgcgcagttgtgaagataaaagcaccagtcggcggcggcataaccagtcggcgacggaagacgatgatttccatcagtagtggtagctgtataaacaagacgtagaggcgagggcactagtcagcagtagacgagacgaccggcgatgaagaagataaagccaatcaacactggcggaatcatgcagccatggaaatgaataaactagtcggcagcagatgttgtaacaccctagcctaagacataataggattgataggatactcatgccaacaagttgcaacttcttttccggaagcccatctccaaagaactctaaagttaagcgtgcttggcttagagaaatttagggatgggtgaccgaccgggaagtcttcccgggtgcgcatgagtgaggacaaagtgcgcagaaaagactggtgttggtttgtgagggcagtctatgtcctatttaagctgctagatgtaagcgggcccggcctcgtgcaggcgggacgttacagtatggtatcagaaccgactctcacggtttcacgggcgcgtgtgtcgcagttgcgctggcatggtgcgcatggctagtgtggacccggtgtggtcacacagcatggcacatgcgctggcactggacatgggtgtgtcgcagttgcgcacgcatggtgtgcatggctggtgtggacccggtatggtcacacagcatgacacatgcgctggcactggacacacggacgtggccaagagagggagttcctggattggggttgatcgacgaggacgtcgatctctttagggggtgaggatgtaacaccctagcctaagacataataggattgataggatactcatgccaacaagttgcaactttttttccggaagcccatctccaaagaactctaaagttaagcgtgcttggcttagagaaatttagggatgggtgaccgaccgggaagtcttcccgggtgcgcatgagagggagttcctggattggggttgatcgacgaggacgtcgatctctttagggggtgaggatgtaacaccctagcctaagacataataggattgataggatactcatgccaacaagttgcaacttcttttccggaagcccatctccaaagaactctaaagttaagcgtgcttggcttagagaaatttagggatgggtgaccgaccgggaagtcttcccaggtgcgcatgagtgaggacaaagtgcgcagaaaagactggtgttggtttgtgagggcagtctatgtcctatttaagctgctagatgtaagcgggcccggcctcgtgcaggcgggacgttacagatgtagacagcttgcgttgaagatgataacgcctattagcggtgacggcgacgtggctagccgtgaagaagatagcatcagttggcgtcataacaggccaaccgtgcaggcggtgacaccagtcggcggcggatgcggcggccggtcggtgaagacgtagacgcccaacaatggcggcataataagccagccgtgcaggcggaaacaccagtcggcggcggacgaggcggccggtcggtgaagatgtagacgcccaacaacggcggcataataggccaaccgtgcaggcggaaacaccagtcggcggcggacgaggcggccggtcggtgaagacgtagacgcccaacaacggtggtgtgaccaaacaaccgtataggcgaagacaccagtcggcggcgaacgaggcggccggtcggtgaagacgtagacgcccaacaacggtggtgtgaccaaacaaccgtataggcgaagacaccagtcggcggcgatgacggcaagccggtggtgatgttctgactgatccattcctggagcgtaagagataagcttaaagccatgaatcccttttgtgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcctccgactcactactcaatggaagaccaattggtgtagtgaggcagaggaaaaggaaaaatatcatataaagaataaaataaatgatgacttagctttataatattccccttggtgatggcagaggtggccaatgtgggaacaaagtcgtccattaataacaatgaagacaccagtcggcggcgacgaaggctgtcgacggtgaaagcgaagatgcccactaatggcggcataataggccagccctgtaggcggagataccaatcggcggcggcgaagacaagccggtcggtgaagacgtggacgcccatgaacggtggtgtgaccaaccaaccgtataggcgaggacaccagtcagcggcgacggaggcacgccgagggtgaggtcgtagacgcccaacaaacggcggcataataggccagccatgtaggcggaaacatcagtcggcggcgatggaggcggccggtcggtgaaagtgaagacgcccatcagcagcggcgaacggtgaggcgcagccgggtccgcatggcggagccccccgggctcgagtgtgcatgccttggacgtagccgggccaagctcctgtggtactcggactcggtggtgtggaggcagccgatcgtgaacttgttgaaggggtcgacagtgtcagcggatgtagccagccacacaggcgtagaggcccggcagcaatgagcggccaactcgtggacaaatcaagtcgacattctgcagcacggcgacagcctgaccaccacggcgtctcggtagcacatgtaatcaatcaaagaattaatctgatcaacggcagcaaggaattaattaaagataaatgttcaaatatcaatgcgaggtgattaatgggtggcttgaggaggatgcgtgttgctgcatggtcctgttgcatagtcatgtccatgctggtgacgtgccatcgtctcatttgtcggccatgttgccatccaaagccttgttgatgacgacgttttgtgcgccatggtagcgatcgatgatggcgcgggcacagtcccctgcgcaggtctggcagtagatgtagaagccatggaaaatcgggcaatcctcgtcgacgttgaagcggcagagggaacagatccacaactccgggaggacggcggggagggaggcgacgtagtcgtcggagcggaggaggcggaggtcgcagtcgcgggcggcgttggtgtccatcagcacgacgcaggacggcaggaagacatcggcgtggctgcagccgtctcctatgcatccgattagatcggttttgacatgcttcgtgtttgtagatccatcttgcaacaccatggcatcctcgttgggtagattggaccagtaggcttggtggtggacgaggacgaccatcaaatccgtcgaaccgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatctagttgtctcatgcccctagagggagctccctgccctccttatataggttggggggcagggttataagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtacccataatctccacactaattgaataattaaaattttaatcgatgttccatgtggtatagtaaaatacatgcgtcaacttacggaagagacacctgattgatttgtgaggctatggaaaggtgtacaggaaggattcttcgtgtgatgacgcatgaagcgagcggaactacgtcaatgctatatatgatttttttaactttagtttttcattgttttgtttgtcttgtttttgtttgtcatttaaattaacaaagtttttatcaatgtgaaaattatcttcacctgttacaatgcacatatattttttagtatattgtatgtgcctatttctatgcatcaagtcaggtgttttactcgcgcctattcctcttctatttactagatgaaaccctgcacaatgatgctggagtttttttatgatattagaagaaataatagctacacttgtataattttcaactctaatcaactattaagaaaagctataaataattaagatagtgaggtttataacaatttaaataaaggtggtttgatattgttgtggaaatacataacatactttcagtacgtagcattctcagattaatctttgcatatagataactgatggaagtacctagtaaattgaaattgcttttgcttaaaaataatcgggtgggtctactgcgtatacatgcatttagattgaacccacatgtaaccaattcatttccatgttgaaccaataacctccaaaatggcattggctcggttcagttacatgcatgtgattactgaaaaatctagaagaattaagagagatttaggaggagtggcattaaccatggtacatggactctgatcataaacgcactgctcaacatctcactcggggaccttctcatccaacgattcatatgcaatctcatccaccgatcgaacggctaagaattagcgatgacgtggaacactaaggtttcagctttggatcttaacttcataggaaaaagagattccacgtggtaaaaccaatggtgtaatcagtctctcctgttagattgcacacacgttctttgaactaatcagattggacgaccccgacactagttcataaataatttttttgacgtcctagattctagacgggacgtaagtggccccatttggaaaaactaggcgaacagcgccgggcggtcgcccgcataggaaaatacattatcccgtgcgggtgtcttaatctaaccgcacgggataaacttaagagaaccgcccggagaaatcgattttcgtatgtagacctcttaagcggaccgcaggggaaaatacctctcattttttccctcacccactagaaatttttcgcatcctctcttccttttggctctcacccactttaaatttttgcactattccagcacgaatcgtagtgcaatccaacaaacagaaaagcgtcaaataccaaacaaaaaatcacccgacaaagatatagcaaaatcgaatttatttaccctttaagtgacgggcccttctactaaaaaacttggcccaaaatatttggcaggcctggttccagtcaattccccatgggtgggccgggaatttgaacttgaatggctcatcaccattcaccaatgccctcaatccgacagcatacacaccacaactgagagcaagcaaacggcagcagtccacagtacagccaagccgccgtaatcagcaggagctagattggccatccaaaaagagtaacaggagaccacaaacccaggaaaaatgtcccaagcggaaattaacatgtagaagatgttagaatttcaccctaaatgagcacttttaagaatgcagtaatacctaaacaacaacgagacgcaccccacgtaggtattagggatgagaagagagacaaagcttgtagcttccaccaaagtaacgcctgctgcctgtccctatacttacatatacatacattgctgaagtcacaaccaatggtttgacatccgtctcacatgtgcttgaatagatccagaatataattagcacgactattaccgattgctcgaacagcaggacagggttaaacctaaagctaataatagataccacataatagtcagcctggcataaatgtattgcacaaaacaccaccaggtcgaaaggtgtacataccattcgaaatttggtatataacttttggtatggcatgaactctctgcttcaaagttgggagtttctccaatataatcaatggatgatagatggcatcagttactaagttttaaggtagagagaactattatgtcttctggtgcaccgatggttgatcttgcaatttgtttgagttatctggctcgactttcagggagcctggttcgtctatggccatcgcacttgcatcggtaggctgcagttgtcaaagagcaaaacatgaaaaggcagccgttgttaccacagagatccatgacagttcacttacgtgcaagtctaccttttgcaagattacaagtttgcacaaataaaagagcacttacaacagtttgtttcgaggaaccaactccatcagccgcaggttctgtgcccttggtgttctctgcagcgaccctattaccatcctgcaacatacaaataacaaggcaaactattaccaacagagaatgattaagttgaagattaagttttcactgatgaagatgaagatgaggattaagttgacgtacgtaaaacgagaaaaccattagcacatgattaattaaattttaattattacaaacttgacaaatggatatatttgatattttaaagcaacttatatatagaaagttttcacaggaacacaccgtttagtagtttgaaaagcgtcctaacagaaaccaaggtaaaatctgaatcttaatcagaaaagaacaaggacatctgaagagaaaattccttatttgacatctgaaattaacaagtttccttattcgacatctaaattagatgcttcccttatattaccgagcaatttttcacatccctcataagccactacggacgccaccgttaaaaattgccattagcagagtttgtcagtagtgtaagcaaatggtaaaatgcccctgagcccacttgtcagcatcatctcttatctattatttttcctcatctctacaaatctcgctcctcccaccagccttggataccgtattgagctgccaccgcacttaacatccgtcatgctacactccacctcctgctcgccatgccatggtggattgtgactcaactctggtgccccttcctccagatgaggtcaaccatggtaagggcgatgaagttgtgcagagcatgttgcagcagggttgtgtgccggcacttgtgctgcccgaccctgggtgtagctcctcctggtaggcctgaaatgacaaacttcactgatttggggctcatggaagaacaggatatgaatctccgaatctttggatacatgccctctttgcggtctccaatgtgtgagctgagctaaccacttcctcacagcttgtccatatcttgcaggtccaactacatttcgaaattacaccactcttttttttttctctggtgtttgaaaaacttaagctgtgtggtaatattttttttcctattttgtcatgcattttttttctatattggcattgccaccgagacagcattgctctgtggaggcagtaggcagttgttgcctagatgcaatgatcctgttcggtgcttgtgtagcacccggaagagcacacattgggcctgctaggtaggccaacatgcagcgctttttactgtacagcacagcccgagcagaacagcggcagcaccgcagtggatggtcatcaagcagaactgtaagcgtgtcccgctgcagccactgtagctgctgcggtgttctaccaaacaagaccattgacgagatggataatttttttatttgattccatacgagggaataacactttttggtgccaataaaggattcactat

SEQ ID NO: 8990 - DNA, 9520 bp, Oryza sativa
acaaaagttgtaccagtggattcatattcggaagtgcttccacatgaattggttttgttgccactaacaatatattgtaagagaagttaatggtcaaactgtcaaattatacttttgaagcctatgcaaatcacttatcaaatagaattactattagaaataagtcccaaccgggtgcaaatgtgcatcagaacatttgagaaatctgaattaaatatctgactctcaagaatcaaacaatgctggatcctatatagcttcattcatcttacaaccttaactaaaattaagggctaaggttgaaaaactaataccaacacccgaggaccataaaagaaaccatgatacagacaaacgaatatggtactgatgcattatccagaaaaatgaaattagattttcatgttgtatagtcacatcataatagttgtcctttacttcgctatgatgattcagctcttccaatccttagtgtttaatttgaaaagttgagtatataaatttcagaactgtcgctacagcaaggattaaaattcaaaatattcaacatcacaacacatcaactcacaattgatgtctttcgcagtccacggctatttaatatcaatatgctctctgaagatgcaacaaccattcagaaaggaacaaacagcagaatacactattcatgaaagaaagtatagctgcttacacacctttgagcacacattaaccataacaactgtcaccaccagcacataacattacttcaatgagttttaatagaaaaatacctgatctgcggcatctgtttcagcagactctctcttaactctcacattctgaatactgctcctcctaaaagacaaaaggatatacatcagaccatgtcatatgattctaactgctagaatcccctgaacggttacagaactgaatagaaacaaataccttcctgagtcatccaaaggtttgacatcatccatttccacatcagaatcagcatggtgcctttcatcaggatcctcttggtcttcatcttgctgcacgagacacatagatgtaactaagcgaaaatccttcctctcactttcgaaactacatccataatcaatatgggcatgccactgggcatcttacaacacttgtaaagtttcaaagctataaactgagacacatcagacaactggtccttatgctaggaattagtaatttaaattatatgcattcagcttgaaaattcaaagtcgatttgaacattattaacagaatgtgaagtgccagcattagagcacacatgacagattacttcaagcatgaaaaaatctgcatagataatccataccataatataaagcttttgaccataaaacaaaaaaaacgaacttttcaaaattcaatcatgtaaaaataactaaccacctgtcaatttggcattcctgatatttccggagctgacatttacaattcatacaaattgtgaaatattattatttacagcaactactagaaagacgccttatactcctttatccttgaagctgaggaattctacaggacaaaaaagaaccataatgccaataatttctcactcacctcaggtagctcagcctcagggggtcgctcttgaaattggacgctaggagcatgtcgaagttttgaaagattatcaagaagtcttgatcttatatcatccaactgctggcgtgtgtttttgttctccatgttacttggtgcaacatgaagtgtataatctggaccaaagtactcaaaatactcatttggaggcatcttgtcagtgagctcatgaccaagtgcaactcctgtctgcataaacataaggagaaaaataagaccatacgggaaaataatgattacaataaaagaaacatgcgtctaaaagcattagaagctcaaagtatttcataaaattctcagacaatcattggttatatactgttagatttcagtgattaaaagtacaataattatcaaacaatccatagtagttcatcacagagtgagttgtgcttattagaatagctataacagtttgaaatgattaacagaggtttttttacataagtacttatagatgtgagtcgcttagtcaaaacagttgtccaaggtgctacatacacatgtcaggcatagtgccggcgctaaaatggatgctagaagaactatgccatttcatacatctttaaagttaataaattagtgaaggctcttcaaacaaaaacaacagagaaatgtatgtccaggaaatgcccctgatacatacctcatagcaccaacaccgcgcaacatttcttatggtatacccaccaccaccaagcagcaacagcgggacattgaaggacctcatgaatctcacgcattccgcgtggcccctgattgacaggttgaagcaacccaacctatcacccgacagagagtccgcaccgcactggagcaccaccgcgccagggcgaaaaacctccatcaccttccccatgatcggcttgaacaacgactggtagctctcgtcgtcgataccgtcgtccaacgggacattcagagagtaatacttcccctttgagtgcccaatatcgcgaatgtccccggtccccgggaaataatccccaaacttgtggaacgagaccgtcatcaccctgtccgtcgtgtagaacgcctcctccacaccatccccatggtggatatcgatatccacatagagaacacgctgcaatacaaaaacaattagcacacccaaaaccctaattccgcaagattattaggctctccagcgcgagagaacctggtggtatttgaggagctcgaggatggcgaggacgatgtcgttgacgtagcagaatcccgaggcctcgcacttcttggcgtggtggaggccgccggcccagttgatggcgatgtcgtggccgtggttgagcttgacggcgccgccgacggatcccccggcgtaggtctggcagaagctgtagaggccgtcgaagacggggcagtcctcgccgacgttgaagcgcttgagcgcccggatctggtcctgctgggtctccggcgtgacggagcggaggaaggcgacgtagtcgtcggcgtggaagcggcagaggtcgcggtcgcgcgccgggtggggcttgagcacctgcatctggtcgaggaggccgtagtgggcgagcagcgcgtgggtcatccggatgcggtgcggcttcatcgggtgcccctgcccgtagtagtagttccccacctccgcgtcgtagaagtagcacacccgccgcttggccccgtcggcccccgccgtcggcagcgagttccccccgcctccggcggaggcgtccatggcggcggcggcggcggcggcgaggaggaggagattttttttttatctcttttttttttcttttcccctctttgccctctccttgggtttgggtttgggctcgcgggcggcgttttgagtttggaggggaggggaggaatagccgagatgggatcgtgggccgttggatcgtggagagacgcgacgtgggccgttcgatgctttcgtggtgcgaatgggagagcgtcggtcgggtgtagtagaaagttcccgagcaaacctgggaaactctggaagctttagaccccgttcatttcctctggaaaaggatggattaagttttggattttcgtgacacgcttttcaaaccactaaacggtatgtttcgtgcaaaaactttctatatgaaaattattataaaatatcagattaacccacttttcaagtttgtaataattaaaacttaattaatcgcacgttattaccacctcgttttacgtgaaacacttaattttcatcttcatcttcatctttaggagattcagacaccaccttatactccaaaacttaggtaatcacaaacctcaaattccaaacgagattttggttgagtggtgttctttgaggaggggttaggaatccctctcctccgtataaaaggaaagacggattaacattgattaattagatattagcttaaaaaattaaaaataaattaatatatttttaaaacaacttttttatagaaatttaaaaaaaaacaaatcgcttagtagtatgaaaaaacgtgcgcgcggaaaacgataaagtaaaggtcgcaaaccttgaattaagaacacatccttaaagttttactccatccatctacttttgatagtcatatttccaaatctgaaaaatttatttttgataggcatatttcaatccaacaacctatcatcttaatgactttctcggatttaatgcatgactctctattcttccacacatgattggctacatgagcattgagaaatgtaaatattaataaatcgcttgtttacaaggaatgactagtaccatgtttaaatgaatgataagtagaattgcttatccttggtctgtgtgccaagatgaaatattactatcaaaagtagatggagggagtatttcaattcaaaaaattgtaaaaggattttattttttgaagagatacattttttaaggggggaagggattttattctttcggaaaacattcattgttgcaccgtttgaaacaaaggaatgtctgaatagtactcactaatgtttgaggtcatttcctccgctctgtgttccataggaaaacaaaatcccatcacaactttgtgcaacttgtattgtacaaactagagagaaatatttcctccatcccaaaataaaccaacatcgtacttgaatgtgacaagtataaggttggtttatttttacacggatgaagtaggtcttggtaccctatatttactgtccattagagggaaagaaattcctttatcccaaaaaagtcatctaaatgttcatgcctctgcattttatttcttatgtttcagaattgctttcttgtttctgctctatattctgttgggttcgaaacgggcctaaaaagtttgccttttgctacagtttagaatcaaagtagaaagtgggacaaatgaagttaagacaaaaaaaaaggtaggaagactccaaaacttcaaccagcatcactccgttcgctctcaaaccacaaactccttcctcccaaataatcctatatatatatatatatatatatatatatatatatatatatatataaagttcattccacctaagtgtagttaatgttaattctctcttctcttatgaaaccacatcacctcaattatttttaatctttggatgattcatcaagggtgtaaattgcatctcttcctcttaaaatgcataccatagaacccaatcatttatatcctttgaatgattgtataaaatatataagcacatgaaaaaaaaatcttatggtaggttagaaagaaaattttaaaactcatatatactctattatcacacaattctcccacagcaacacgcgaggtgcccatctagtaataacattgaaggacgtgaaagttatacactccttcgttcccaattaatcaatatatttgtcaatgtcaagaagaaggcataccctctatacacaggtttgtggacggcaataccatattatacgagagaaggtattctttaattaaggaaatacaacagataaaaagaaattatcttaggtatcccttaattaaggacatacgacaaaaaaaagaaattatctttccggaatagaagatgccagagttctatttggggaatataaggtcttctcgggcttgtatcatgctttatctcttcgagttccacttaagatgatctatgctatatatatacaggtccccctcatctagggggacattgagttacaagtcatagcaaaagacatattgagaaacaatccggaggaagccagaccatatttggcgaatagatctcgtcgagtcgttctcgacagcttctagtcagcggattagtctagtcatcctattccccattgtaatccttgtatttacatccatatatccatataaactgtagtagggttattactcatcttgaaggcccgaatcaatataaatccttgtcccatgttccgcaaatccgacctcacgtacatcctagttccaacgatccccatattctatgaatagcatatgcaggtataacccggtgacaatattatagaagtacatcaagacccagggaaaccaataactctcttgctactattcactttcacacattgaccagtgtctatttttcatatatttacgaaggctaaaatgatctcatactattaaaggtgtattatgatctaataaataccagcatgaaacttttattcattttactctaaacatttaagagtaaattgtggtcaaagtttaaatagtaaagtgaaaataatcaattatttagaaacgggggtgtaaatggttctagcagccatgcacgtagtagagcttaacaaaaccgattgaaaaataaatcatactctctcaattccaaaatataaggcacatccacctttaacccaaagactaagaaataattattatcatcatgtagtttggatcatcctaataaatataatgcatgcatccaataggattagataacatgagagtgaaggattaaaaaagtaataatttaatgaagaagatgtcatagttaattgcatgtttgtatgcatgccttatattatggaacacctaaaaaaagttgcgtcttatattatggaatggacaatggagggtgtacatcacaaaacctcttcacacccctgatcctaaaagccaacctgatcatcacttccatggcatggcatattcacagagtgacatggatgggcacagaagcaacaaagaagcaagtaacaaagcaatgcgatatctctatttaccttgtaagctagcagagctgtagctgcattacctttcaactagcaatcatccagttctttcatattgaagaaaacagaaaagagaataagggatgcccaaatggaacgtttgcaatcaacggtttcagacttgagacaaagatagtgactgactgacaacatggtcgttctcatttggacactacatttccagtcagccgcaggtcgcctgctgagttatcctcaaatagtatgctacactgtcacactgacgttttagtcaagttgataaaacttggagaaaatgatgcaacacatatgtacatcatttgtgcttgtgaaccgtgagaggtcatataaagaggaattactgcgagtattacacgagaatcaggtttctaagtcacagcctaataggaaatcattatatcgaaaaaggattgataatagaaaaactgataatgagcatgcaacaaaatatggacttgtttgacggtgagttcagagttctgagatggcaatctctctttcaatgccatttccgaatttgccgtgtcagttactcagccaataagcttataaaggcatgcaaagaggatcaccgaatcatattattcaccaagcatcaaaggtcacaattggcagtggtttacacgtaagtcctgtccttgtcatgctttaccacgactttgagtcttccatcacagcctgcgagcaccatttgaaggttcatgtacttcggtttcacaacaagttatgcacttgaaactcagaagctatttaagacaggtgagttcgccttacctgagatgcaatacattatacccattgtctcttgatcatcctgggttcaatggagctaggaccctgcaaatgcacaacaggtgcatcctgggcagtaagctttcttcttgcagctgctttgctatctaacgccccaagcaccaccgatgcctccatgctcaaagctccaactgcaaacactgcctccaacagctcagatcgccaagtgctcctctcattcaagtcactcataacaaaagacccctctggagcgctcacctcatggggaaacaggtcactgcaccactgcagatggcaaggtgtgatgtgcgggaagcgtgggcgtcgtcgtggtcgcgccatcgccatcgaccttaacaatctcgggctggctggtagcatctccccttccatttctaatcttacgtacctcaggaagctccacttgccacagaaccagtttggtgggcacatcccacatgaactcggccttctcgacgatcttaagtttctgaactttgtgaattgtgctaaaatcagtacggtgtattccaggagagcactagcatatacaatggtatatgggcctcatgggccaacagtaaaataagtctaagactacatcgctatacacatatctaacagcccccttcaaactcaaggtggatttggagaatgatttggaggatctatcacattgagtttgagaatgtaaagacggtgttgctctctagtttgagccttggtaaagaagtcagcaacttgaagttcagatggcacatatcgaagagaaattgttgactgctgacaatgagagcgtgtgaatgatgcatccactccaatatgcttagttaactcatgctttacaggatcattggcaatttgtatagctcctgtgttatcacaaagaagaggtgttggatccttgcattctacaccaagatcagataataaccaacgaagccaaacaatctcagaagtggtagtagcaagtgcgcgaagttcagattcagtactggatcttgacacagcagtttgcttcttggacttccaagcaatgagagaagtaccaaggaaaatacaatatccagtaattgatcgacgatccattggatcactcgcccaggttgagtcagaatatgcatggaggtgaagctgactcgagcgtgcatagaatagttgtcgagatgcagtccctctcaagtaacggagcacacgaagcaaatggctataatgaacagaggtaggtgcactgacaaactgactaagcacatgaacaatgtgagcaatatctggtctggttatagtgagataaacaaggcttccaacaatttgacgatatcgagagggatcctcaagcaaaacaccttcagtagaacgaagttgaacatgtagctccattggagtagtggcagtcttggtatcagtaagaccagagcgtgttataagatcatcaatatatcgatgctgagaaaggtagtagccatcctctgtattagtgacctctatccccaaaaagtagctaagagggcctaaatcagacatcatgaattgctcacttagacattgcttcacaaaagcaatatactctaagtcatcccctgtgattagcatgtcatcaacataaagcaacaatagagtccgtccatggtcagaaacatgaatgaataaagccggatcatgatcacttggagagaatccagcagcacaaacaacggagctaaaacgctcaaaccaagcacgaggtgcttgctttaaaccataaagagcacgattgagacgaaaaacataatttgcaggggcatcaacaccaggaggcggtttcatgtaaacctcctcctttaggtcaccatgaagaaaagcattcttcacatccatctgagatatggtccaggaacgagcagctgccacggccacaagagtacgaacagtggtcatgtgagc

SEQ ID NO: 8991 - DNA, 9488 bp, Oryza sativa
atgttcttgctgaaaaccgcgagcaactaagcgagctttgtagcgctcaatagagccatcagagcgagtcttcaccttaaacacccacttgcaagtaattggaatggcatgacaaggaagaggaacaatatcccaggttcttgttcgctctaaggcagcaagctcctctgtcatagccaattgccactcaggaatggcagcagcctcttgatatgtactaggctcctgaacaccatcaattgctgcacacatatagcgaggatgaggcattatcttgctgcgatctcgaagaccatatcgtggtgtagcagactgtggtgatgacacaagtggatcatcaatgagcggagcaacgggtggatcatcagattgagcattaatggtactagttggaacatctgaaggaagacaagagggaggctgagactcatgtggagttcgaggtcgacgactatagtggaaaggaaaaggtgacatctctgaccttggtgttagagtggatgatggtatatccaaagagggtgaaggaatggaagatggagaaggtgtctcactgatggtagttaggtcttgagaaggaataggtggaagatggagaaaagaaatggactcctgaggagatgaggaggacgagattttagagtagaaatatggacgatcctcaatgaaagtgacatctcgagatatgcgaatacgacgagaagaggggtcataacaacgataccctttatgttcaatactatagccaagaaaaacacactcaactgattgagctgacaacttggtgcgctctcgagatgccaaaagaacatagcaagtacaaccaaaaacacgaagatgatcatagcatggggaagatccaaatagaacctctcctggacactttccttgaaggcgagatgatggctgaatattgatgagataaacagcagtggaaacagcttcagcccaaaaatgagaaggtacaaatgatgcaatcaatagagtgcgtgcagtctcaatgatatgccggtgcttgcgctcagcaacaccattttgaggatgggcaccagggcaagagagctgaggaagagtaccctcggaagaaagaagttgtcgaaaagcagctgagaggtactcccctcctgaatcagaacgaaaaatacgaatagtagcagaaaactgagtatggatcatgcgaataaaggattggtatatggataaaagttgtgaacggtgtttcatgaagtaaatccaagtgtatctcgaataatcatctataaatatgacataatatttgtgtccacccttagaagcaaatggggcagggccccatacatcagaatgaacaaggtcaaaaggacaactagtcctagaattactaatagggtaaggaagttgtatctgttttccaagtttacaacccgtacaatcaaaagtagtatcaatagagacatgacctagaacaccctgacgaattaaagttgaaaggcgggacccacaaagatgccccaatctatgatgccattgtggaaaagttgtagaagatgcataacccaaggctgtggaactagtggtggtggagccaaaagatgaaggtggaagactcaagtgatcgagaacatagagcttcccaggagaactactatggcgatggccagtaccaacgagtgctcttgtctgacgatcctgcacgaagcaagaggtattatcaaaacccacaaaatagttcatgtctgtgagttgtccaacagaaatgagattgatggaaagttgtggcacaagagaaacatttggtacagtgagttgtgaagtggaaagagtgccctggtgagtaactaaacaggatgtgccattagctgtctgaacacatgtaccattgataactggttgacaggatgcaagctgagacacatctgatgtcatatgaaaagaggctcctgagtctaacacccatgactgagaagtacctggtgcaggggccaaagaagctgatccattaggttgataagcattcatgtagggctgattggttgaagttgcactaactgaagctgcagtcacagcgggagcagcaagtgtaactgaagtactaggggcacggcgagatgcaccacgcttggccctaaactcagccaacaattcaggatgtagcttgaagcatttctcaacacggtgaccagacctcttgcagtgggagcaaacaatctgagtggaagaagttgctaaggacccatgctggaaagcatgatcaccagacaaggaggttcccatcaatgaagaagcaaggacagtgtgttgcggtgttgtggcgttgggaagtgactgtagacgagtttcctcggcaattaagtctgcgagagcctcagccatggtaggaagagtagaccgaccaagaagctgcaccctaataggttcaaagtctaaccgaagacgcatcacaaaatcaaacataaggctctgctcctcatatttctccttgcatatacactgtctgcacccacctccagcctttggcaccatagaatccaattgtctagacaatgaggtgaaggcattatgaaactcctcaatggtcatgtcgccctgttcaaggctttgcaagctcttgcgaagagaaaagcggagagctgcactgctctgttgatagcgttgttgaagatactcccacatcttcttagcagaagaaagatcaataaaattcattctaatggggacctcagcgctcatgcacaagaaggccatcacacgctcatcattacgccgccaagctgcaattttcttctcatcttccttctcatgaggtggatcatcattcaagtgagaggccacaccatacgacctgagttgcatacgagcagaggaagcccactcacggtaattttgtccattgagttttatatccaaaggcaaaagaatgacattcccaagtggatctgatgccatggttgcaatctgaaaggctgagctgctgctgcacttgaaacgctgctactgcactgctgcactgggctgccgctgctgcaattagtggctgcaattaggtattgtaatcagcagcaggagatccaacacatggcagatttgttggaaagagtcctggcggcaagtgcgacagcaaaggatggaggctgcgggtcctgcagactgcagctagccgacaccactgcagctagcacaattggataatgcaacctcgagcaggagaaaaagaagcaggagaaaaagcagtcaagcagatccagcaggagaaaaagatgctccagccagaagagaagagggtcgatccccaaaatcaagtagcagatccagcaggagaaaaagatgctccagccagaagagaagagggtcgatccccaaaatcaagtagcagatccagcaggagaaaaagatgctccagccagaagagaagagggtcgatccccaaaatcaagtgaccacgaaaaacagaacacacagcagaaaacttccactgggagaagagatgagggaggacactcgccggagaccaagaccggtgaagagctcgccggcggcggacatcgacgggaatcgcaagagcaacctagctctgataccatgtgaattgtgctaaaatcagtacggtgtattccaggagagcactagcatatacaatggtatatgggcctcatgggccaacagtaaaataagtctaagactacatcgctatacacatatctaacaaacttgagtatcaactctctcgagggagaaattccgacatctctgtctcaatgctcgcgtcttcaaaccattagtttgtggtacaataacctccaaggcagaattccatccaatcttagccactgttcataactccgaaccattgaggtctttgctaattatctagagggagagatacccagtgagcttggttcactccaatgtcttgagctcctcaatctttacaataataatctcacaggaagcatcccttcttacatagggaatttaaaaaacttaatcttgattgatataagtgataatggcctcactggatccatccctcctgaaattggcaaccttcaaaatttgcagttcatggactttggaaagaacaaactttcaggatccattccagcatctttaggtaacctattctccctaaattggttggatcttggaaacaacagtctcgttggaaccatcccgccatcacttggtggactcccttatctcagtacttttattttagcaaggaacaaacttgtagggaacatccctccatcattagggaacctttcttccctcacagagttaaactttgcaaggaattatcttactggaatcatcccccattccttaggcaatatttatggtctgcatagtctccgtcttacggagaacatgctcacaggcaccattccttcgtccctaggcaaacttattaatcttgtttatattggtttgcagttcaacaaccttataggggagatccctctattgctatttaacctctcatctcttcagaagctggatctgcaaaataataagttaagtggcagcttgcagaattattttggagataagttccctctactccagggacttgccttgaatgacaacaaatttcatggtcccattcctttatccctttccaactgttcaatgcttgaactaattcaactagatagtaactcattctcaggaacaattccttcaaatctcggaaacctcaagagattgtccaaactgcgtctcgattacaataaattagaggcaaactacaactctgactgggatttcttgaatgccttgacaaactgcacccaactataagttctgcagttaagtttcaataggcttaggggtgtgctaccacactcactttctaatctttcaatcagcttagaacaccttgcgattctcaacaatgaagtaggaggaaatatacctgaaggaattgggaggctttctaatttgatggcactttacatgggtcctaatctcctcactggttccatacctgcttctctcggaaaactatcaaaattgaatgtgatatcactagctcaaaatagactatcaggagagatcccaccaactcttggaaatctcacacagttgagtgaactctatctatctatgaatgcatttactggggaaataccttcagctcttggaaaatgccctttaggtgtattagctcttgcttacaacaaacttagtggaaatataccaaaagaaattttctcgtctagtagactaagatccattagcttgctgagcaacatgttagtagggcccatgccttcggagcttggtctattgaaaaatttgcaaggtcttgatttctcacaaaacaagctaactggtgagattcccatctcaattggaggatgccagagtttggaattccttcttgtttcacaaaatttccttcatggttcaattccttctacaatgaacaagttgacaggccttcaagagctagatctttcaagcaacaacatttcggggatcattccagtgtttcttggcagctttattggtctcacgtatctgaacctctccttcaacaacttgataggtgaagttccagatgatgggatatttcgtaatgcaactgcattctcaattgttggaaatgtgggcctatgtgggggcattccagtattaagtttgccatcatgtacaaaccaacaagcaagagagcataaattcccaaaactagctgtagccatgtcagtgtccataacatgcttgtttcttgtcatcggcataggtttgatctccgttttatgtaagaaacataaatccagcagtggaccgacatctaccagagctgtcaggaatcaactgccaagagtttcttatactgagctatctatgggaacaaatgggttctcctcttcaaatctcattggtgaaggaagatttggttcagtgtacaaggcaaatatgagtttcgatcaatatagtgttgttgcagtaaaggtactcaagctccaagagaggggagcatcacatagttttcttgcggaatgtgaggcattaagatacctacggcatcgcaatcttgtgaagatattaacagcttgctcatcaattgatcctagggggcatgattttaaagcacttatctttgagtatctaccaaatggaagccttgaaaaatggttgcatactcatatagatgagcaaagtgatcaaagtgtcctaaatatttaccagaagctaagcattgccaccgatgtaggatctgcagtggagtatcttcatgattacaagccagttccaatagttcattgtgatcttaagcctagcaatattcttctagacagtgatatgatggctcatgtgggtgactttggactggcaaggttcacaaatcaaggagataacaatgcatctcaagtctcatccagctgggccgcatttagagggaccattggatatgctgctccaggtgcgcatttatcacttgccaaaaatatacttcttgccttgttaccatttaaaatatatgagacatttacgataccttgtaaataattaatttacttaggtaatgacccattgagcttatgcttgtgctgcattcacattttcagaatatggaattggcaatgaagttactacaagtggagatgtttatagctatgggataatcttactagaaatgtttacaggaagaaggcctaccgaacaaaattttgaggagaatactaaccttcacaggtttgttgaggaagcgctgcctgatagtgtagaggatgttgtggaccagaatctcatattaccaagggaagacacagagatggatcacaacacactcctaaacaaggaagcagcacttgcatgcataacttctattttgagggttggtatcctctgttcaaaacaattgcctacagaacgggtgcaaatacgagatgctgtaatagaacttcacaaaatcaaagaaaaattctttccatgaagaatccatttatgaagaagggaaagtccagtaccagaaaatgcatgtgagcaagcagagtagtaggcagacggagttcataaagcttacttcttaagtagcaaaatagtctggtactagatacatagtccaaaagtggagtttgaataattgaccatttaggcatcaaggcttgtcatattatcttgaatttcacttcatatgtaaatcatgtaatgcataccagtattatcttcctaaagcaataaaccatgttgtatcggtactttgacttcaaggatgtgaacttactaagaaaatgatcaatttttcgtgttggcagtacagtgaataatacaaaaccaaagagctactgcactggtagtggtacctgatagtgtcttggagtgctagcactgtaggtctggcatatgttgatctttctcctttgtattgtgtttgtgtccggtgtatgccatcagtcatgggattgtattactgcattagcacagaaaaccaacaaaattgatccccaaacccaagcaggctgcacttttttctgaaaaaaaaaagaaagaaaaagaagaaaaataaaaaggattgcaggctacgcccgtacgaagcatgtcagcatgacaattgacaatgacaagtgcatcagcatcctaaccatacccttgtgacacacgcagcaaagcttcgggagggctacaggcgctgcagctgcccgagccctgggaacaaagaaaggctcggcatttcatcgaacatcttgtgtgcgaccatgagataaaagtagcagagagaccaccctgccgtgagctaatggcagtgagaggaaaggttgcagacaacggctggtgggatgagacggccctgaccttttataaaaaaaaatcacctacggtctactgattgatttggtggaagtggaccaagtcgcgtgagctcgcgtgggtctccggatccgggctccggcgaggcggcgatcggttttcagccagcgccgctgcattggagagaggaaccgcagcttacgacttctgtagttgatttttatggggaattagctaaaaaaaactatcgagtgtttttttttggaaacattcaaatctaagtatatacttcttccgtttcacaatgtaagtcgttctaacatttctcacattcatattgatgttaatgaatttaaatagatatatatgtctagattcattaccatcaatatgaatgtagaaaatactagaatgaattacattgtgaaacggagtgagtaattcactagaaatatactataataaaaataacttgtatatatgtattaaaataatatatgcaactttatatctaatttatatagagataacaatatagttatagggtagttacactatagttacactataattattaattatagttgtaactacaatgtaactagaatataacttagatgtaactacaatgtaactagcatgtaacaaatctgccataaacatgtgatgatggaactagcttataaaaagagggtctacatccgatagcaaaatatctcagcacaaatgttaacgcggaatcaacagtgaaaataatcgatagttttcactgtcgacagtcagctagcagttccatttttatggtacaagtctacgtgaggagtggggtggttttgcattaaaactgagcatgtggatcgtggatgggtatatgtaacaaaatgatttatgagtggaatttcaaacttcaaatttcatatggatagtttttgtgctttcagggcatgttcattttgatgctattccaaaaaattgccaaaaaaatatctacatttagtttattgtcaaattttatcaatacataagaaatcatgtcaatattacaatcttgccaaaatttggtaaggtttattttggctaccatctgaacaggtccttaaatattactcactcatttttttaataaatgatgcagttgatttttgacgtgatatttaaccacttgttctatttaaaaatatataaatattatttattttgttatgataaatacttttaaatgtttttgtttttctacaacgtttgactatgttatcattaaaagactttagtatgacttttacttttaacatttgtaataatgtacatatatttttaatgaaccaatggtcaaatgttattataaaaaagtcaatgacattgcacattaaaagagattttcaataaggtagcatcaattaaaaagttacaacaaattatttaaactcttaaggtacactacacatgcctttgaatgtaaggtatacttgaacaaatttatagacagaaccccttacatttagtgtcggaaagaatacaccattaataaaaatgggttaattggattcatgcctctataaatatgacaaataagaaaaatgtcaccattattcatgaaatcgggtagatgctactgtaaattagaatcatgccacactactacaaaagtgatttttctatacgaggcctcatcatttttccatgcggaccataactagtggcgtctgcaaaaatcgagggtcatttttccatacagctgcttgagtggcccg

SEQ ID NO: 8992 - DNA, 10387 bp, Oryza sativa
  unsure (1)..(10387): unsure at all n locations
aaattcaaattcaaactgttcaaataaagtcatagggaataatgacaaatgcaaaagttgcagatcttgataagttatacaattttgttgttgacaacttttctatttgaaatcatttactatgtaaaaaaattatttgaatttattatattataaagttcaaattttatatagttcaataaaactcggatggagaaatgaccaaaagaaaattggtagatctcaacaagttctacaactttgtttttggcaacttttttatttgagttcatttagtattaaaaaatttgattccaagttctcatatttttaaattattttttaataactattttcgcatgcggctccttaagtggtccacatgcaaaaataccaccccaattttttcatcttcctccactcttttttccctcccaccacttcaaaatttttctacctcatctcatctctctccctctattaatttattactctcccctctctctccctctctctttctctcctctctctccctctctccctctccctctctcagagcggccaggcggcggatggcaatggcgtcggcgcgggtggcggatctggcggtgccgccctcgggagggccggatccaccgccatagggagcagctacagcagcggcggcgggcggcggcttggcagcctcggctcggtggcctgccatcccctcctcaccgacgacgatgagacggcccttcctcttcctcaacgccgccgcggcaggggtggcttggccgcctcgggtggcgccgcactgcgcggatccggtgcccccgacgacggcgagcggggggggcgacggatcccccgcaagcacgacgccgggtgactagggcaacgcatccggtgccgccgccgacggatccggcgggggcgacgacagtgggcggcgggggagacggatccggcggggacgacgatggcgggcggcgggggagacggaagcggcggcggcgacgacggcgggcggctggggcgacgacggcggacggcggggggcaacggatccgcttccggcgacggcgtgcggcgtggacggtgggctagggtttgggattttttggatttttattttttttgggggttttggattttatttttttttgtttgctgaatttattttcgcatgctgccctggccgcatgcaaagatttgcattttcgcagacgatttggcgcatgcgaagatcgctccggcccgttcgcaaaaatggtttttttgtagtagtgccacttcatcacgatttccgtcctctccgtcacattttccgcagtctccgtcttcatcttttcgtcgtcctcgtctcgacggcggatgggcagctggaggacggcagcacggcggcggatgcaggagtcatccgcatccctagtccccgcatgagacattgcagcattcattgatttctccggaggaagaagaaacaaagagtaggaaggaagcatgccctcgccggcggcggccgcggccgcgctcgcgaccgtccttgccggcggcggcggcgcccgcacccgccaagcgaccgtcctcgccggcagccgcgcccctccgcgacctccccgcgagcgtcctcaccagcagcagctgcgcccgcgcccgcgcccgcgagcgctccgtgacaggtggcggccgcgcccgctcctcgcgctcgcgactgtcctcgccggcggcggcctcatcctctcaccgctcgccagcgcctcatcgtcctcgccgctcgtcttctcactgtgcagacgtgagccgctcgccttctcactctgcagacgtgagtgaggaggatgacgtgagagaggacggaaatagtgataggagtgtcatggtttcaatttaaaaaaattttagtggaatccagccaataacgcgaatagtagtgatattcttctgatttaccacgtttacaatcttatggatccaattaacctaataaaaatactgctcaaaattttgcataacacacaaatttaatagcatcgctttgtgaaattgatggtataaggacatccataatatagcgcttcagcaagtagtaagtattaaatatcttattgtttgcatatgaaaaacatcatgagagctgcaaaagggtcactaacaagacatggcctggtacaaaggtgggctactttcatctcatttttaatcgcaccaaggctgatgataggctaggttggacgttgtcccatcttattttctctccacgcatacgtgtccgttctactagttccgctaccaaacaatggacccaccattgtttcctggtcagcaataaacattaccggtgcactaacggatttttgctcccatagactttagctgtactgaagaattcttaaggtagctagccacttttaccgtacactatatttccaacattccctcgtgatcactttctcaatatgacgggaaataagttggtaatgattttttggtgtaacagggatagggaaaacaaagctatcaattgacatagctgataaaataaaaatgtgttacgacatggatatcagcacaaactctgataaccaaaattctattagagcatctctaacagcctctctaaatcggactctccaaacacccatataaccaactttttatttgatttagctagtcaaactaaatgctcacttcaacagattcaatattaatcatctccaaaataataacagacccatgtgtcagcctctactactcttctttctctctctctcccccttcttccttctctttccttcttttcccctttccttccttcccgttcccttccttgatgccgatggcggcggctcgcggtggctcaatgatgcggggaggcgggaggcgagacgtcgtcaagatcccctcaggttgccagatctagaagggggcggtgacggagctcggcggtggcggctcgcgacgacaatctcgatgacgacccggggcaacgacgacctcgacgatgctcggggcggagcttggcggcggcggcagctcgcgacgacctcgacgactgatctagaggagggaagggggggggcatctcacgacgacctcgacggcggatctagaggggggcggcggcggcttgcgatggcgacctcgacgacgacccggggcaacgacgaccttgacgatgcctagccgctgcgcctgctgcggccaccgtttggcgagtcccctcgggctggccaaatctagccagccgccgagcgagtttggccatccggttagctagtctgttgaacattgtttttgtgcttgaatggccaaaatttgacttggagagactgtagagagcctgttagagatgctattagagtatcgatgcaatatatcttatcaccttattgggtctatgataagcattgcatgtgatttttatgtatcatttttctcgatcttttgcatcaaccatagcaacctatattttaaggcatgcccatataccaatagtcattggtcggtcgctaattcaggatttggttttgctgataaaacttgatcggtccctcatatatgggatctctttggacatacataattaaagtgtttcttaattaattaatatctcatatgctatgataataacataataataacatagttgatgatggattggtcgaggagactaggaagtatatatgttaactaccctaaagtacagtcatccacccccttaaaaaaccactcccttcccattcttaaaaaaccgctcaaaaggaaatctttaactacttaaaaaatgatgtcccttctttaaaaacccgtctccctctccttaataaaatattacaaaaaaaattaactcatgataaaaaccagcataaaaaactgaatcatatcatacttctttctcttgatccctttgcaatacacggatatgtaactaattataataaaatgtctgttaatgggtgaaaatagcacggcatcatacttcattattggaaaaactatacatatctcaccgtaaaaacaaatttatacaaattctctcttgttcttcatctctctcattttcggcttttccgcggtgtctttaggccctatttagatctcctgccaaaattttacactctgtcacatcgaatgtttggacacatgtatgaaatattaaatatagacggaaaaataactaattacacagatcgtgtaaattgcgagacgaatcttttaagcctaattgcaccattatttgacaatgtggtgctacagtaaacatttgctaatgacggattaattaggcttaataaattcgtctcgcagtttacatgcggattctgtaatttgttttgttattagactacgtttaatacttcaaatgtatatcgtatatccgatgtgacacgccaaaactttacacctctgtatctaaacatagtcttactaacagttaatctaatgtagtttttttccccgcaaaaaaaatcaaaatcaactgtagtttctgcacccacaaaaaattcttccaaccttcccctctcccgttcagtcaagtgtccacccagttcttgcatgacggccaagaatagccagagcctctaagcaccagccgatcaaggaatacatgcacaaacactactagaaaaagccactgcaattctctagctcacagctccagagacacaggatcaaaaccacaggcgtgtggctcgcctccctcctcgcttcaccgctccctaacaatgggcaccgtcgatgcatcccaagctatatatatactcatctgatccatttcctcctcgcacaggccgagcaatggagctcatcgtcctaccttcacacagctgaaaaaattccctcatatacaagataaaggtaggaggagggccgggagctcgacggatttcgatcaattgtggtttttttttgtggtaaccgtataagagaggagattttgtttaacgtagctagatcatatctgagttgagttttagcaatggaggtgctgatccggtggagcaagctgccggcggccggctccttggtgctgtacgccgtcttcttattgctgtcggcggcagccacatcggaggccaacatcggggagtacgatgagtactggcagaagcgcaagctcatggctgatgccgccgccgaggctacctacaagcgtgaccccttcgaggtcaccaacagcttcaaccgcgccgtccacaggcacgccgatcgttcgttcaatcaatcaatcgtgagaatagctcagttggttagaacatatgatagtaacgtgtgcgtgcagatcggaggaggagagcgggaggagggagctggcgatgacgaagaggaagaagttcgcggggccgtgcaaggcgacgaacccgatcgaccggtgctggaggtgccgcgccgactgggtgacggacaggaagcggctggcgcggtgcgcgcaggggttcggccggaacaccaccggagggctggccgggaagttctacctggtgacggacggcaccgacgacgacgtggagaacccgcgcccggggacgctccggtggggtgtcatccaggacgagccactgtggatcatcttcgccaaggacatgatcatcaacctcaaggaggagatgatgatcaacagcgacaagacgatcgacgggcggggagcgcaggtgcggatcaccaatggcgcgcaggtgacggtgcagaactccaacaacgtgatcatccacaacatccacatccacgacatcttgcaaggcaagggcgggatgatccgcgactcgccggagcacttcggcttccgcacccagtccgacggcgacggcatcagcatcttcggctccaccaacgtctggctcgaccacctctccctctccaactgccaggacggcctcatcgacgtcatcgccaagtccaccggagtcaccatctccaactgccacctcaccaaccacaacgacgtcatgctcttcggctccagcgactccttcagcgaggaccagatcatgcagatcaccgtcgctttcaaccacttcggccgcggcctcgtccaaagaatgcccaggtcacataataatactaccagtagagaacaccatacataaaatattaataataataatattatattattatatatataacatcattcattattatttatcatgtattgtgcagatgccgatggggatttttccacgtggtgaacaacgactacacgcactggctcatgtatgccatcggagggagcaagaacccgacgatcatcagccaggggaacaggtacatcgcgccgccaaacctagcggcgaagcggatcacgaagcagctcggggcgacggaggaggagtggaagaactgggtgtggcactctgaggaggacctgttcatggagggggcctacttcaccacgtccggtggcccgatccagaagcagttcagcaacaaggatctgatcaagcccaagcccggatcctacgtcacgaggctcacccgcttcgctggctccatcccatgcgtggccggcaagccgtgctagagcgcggtggccggcccccaccggatccacggctagccggagatgattcttattttgtagttgtgtgagcttattttttcttctacacatacgtacttactcaagaaatcttgatctgtggccggccgggttctggtcaatgtgatcctataggttctacatataaaaaagttgtattaattaaaagcatttttggaagcggtggcgatgcaaatttagagggcgatagggcgaggagcatgcatgtttgtgcgtataggtctacttgttgatggtgatcacgaaagagccaatgcattgtcatgatagaggacatgcgcatttatgcagaaggccctagggcaggaattatttttttttcattgattgttttaaatgtattgtactgaaactacattgttgtttcattaactgcacgcatctccaatgcaaagtgctaatgtaaggtgtttaatatatagtgctaatgtaaagtgcaatgaagcatctcactactatagaagatgacttcagtgtcgggtcgtaacccctcatcagtgttggaaatcaaaccggcacgaggtcatgagtgccgggttaagaaccggcattggtgaggactcatcggtgccacttgttggctacaaataacgtgtgcaatgatttgtaaatacgtgatattttcaacacaaatatataaaatataagtacatcccaacaaccattcattcaaatttgatttgaaaccagaaagactctagcttagataccatactagcaatccacaccgcaatttctaagaaatcatgctacaccgtgaaataattaatattacacaaaagaattgaaaatatgtgagcaatgggattaatcgactatccgtgatcctgccttgcgaggggcgacacgcaagagctgtgcggaacaatgcaaccagaaatgaaggttgtaatattccctgaaagtgcatctagccctttaagtgggttttggtggattaatgacaaaccagttaagtgactaataatcttgtgaagaagtgtgtgcaggtgttagtccaaaatgaatggagacatccaaatctaattaatggaatttggagcgagaacttgaacagttattttaaatttcttttgtgttttatctcttgagttctaggaccttcgtattatcaagagggttctcaacagatgctcaatgtctacaagtgctcatagtcattctctggaagagagacacatgtttcgcacatgcacactgggttgtgccacctttttctatctgccaggagttctcaaagagatgcctggaaacctccgggcctaagtgttgaccggaagttctccgggggctagcccagaacttcgggctctgtttaagtttgaatttgagagcaacgtctagttgatgtcgcacgagtaactatatattccagcctctcccacctttgttgcctggcaattccactttagttttcttgtccttagactctcatatgatgttattcttggagggcaacctcctagatggataaatttcgcccgcgagcatccatgtcattgtggattgaccagggaaaagtttgtgaaggttttcctcgcctccgcaaggaaaagaggtagtttgagtgaaaattatgagctgagccttcggaagttgtcttggtagggtaatccacattcgtggtgttctctaggtatccaagttgggaatctttgtggtcatttgaaatctagagaagtacatatataggaatggtggattgaaaatcggagacttcttcctagggttttggttggtgagacaaggggttaatagagacccaactctttggagctcctcaatggagattaggattcttgtaatccgagcttcgggtgaaaaatcctgtgtctatcctcttgtgcagtttatgtttctcctttgatttactgctttgaattgttcattaatcattactgtcttttgcgcctttgtaagtcttggnnnnnnnnnnnnnnnnnnnngtgagtctcgaggagcgagaacccgaaaatttctggaaagaatcgtggaagttccaggtagccctcactgtcttcgggtaagagatgctaggaagttccaaaccctatatattaacctctttaatggaagaaaattgttcaatcaatcaatcatgaggatagctcagttggttagaacatatgataacgtttgtgtgcagatcagaggagttgagcgggagaaggaagctggcgatgacgaagaggaagaagttcgcggggccatgcaaggcgacttatccgatcgaccggtgctagaggtgccgcaccgactgggcgacggacaggaagcggctggcgctgtgcgcacaagggttcggcttaaacaccaccggagggttggccgggaagttctacctagtgacggacggcaccgacgatgacgcggtgaatccgccccggggacgctccgttggggtgtgatccaggacgagccactgtggatcatctttgccaaggagatgatcatcaacctcaaggaggggatgatgatcaatagcgacaagacaatcgacaggcggggagcgcatgtgcggatcaccaatggcgtgcaggtgacggtgcagaactccaacaacgtgatcatccacaacatccacatccacgacatcgtgctcggcaagttggggatgatccgcgactcgctggagcagttcggcttccgcacccagtccgacagcgatgacatcaacatcttcggctccaccaacgtctagctcgaccacctctccctctccaactgcaaggacggcctcatcgacgtcatcgccaagtccaccggagtcaccatgcatctccaactaccacctcaccaaccacaacgacatcaggctcttcagctccagtgactccttcagcgaggaccagatcatgcagatcactgtcgccttcaaccagtttggctgcagcctcgtctaaggaatgcccaggtcacataataatactaccagtagagatcaccgtacataaaaaatattattatatatatgtatataacatcatttattactatttatcatgtgttgtgcagatgccgatggggatatttccacgtggtgaacaatgactacacgcactggctgatgtacgccatcggagggagcaagaacccgacgatcattagccaggggaaccggtacactgctccaccgaacctgacggcaaagcagatcacgaagcatctcggtgcggcggaggaggagtggaagaactgggtgtacatggcacttggaggaggacctgttcatggaggggacctacttcaccacgtccggcgatgcgacccagaagcagttcagcaacaaggacctgatcaagcccaagcctggatcctacgtcgcgaggctcacgcgcttcgccggcttcatcccgtgcactcccggcaagaagtgctagaccgcgcgcggcgggcggctagccggagagacgattcttatttgtagttgtgtgagcttaattttttttcttctacatatacgtatacttattcaagaaatcttgatctgtggccgggttctggtcaatgtgatcctataggttctatatataaaaaaaagttgtattaactaaatgcatttttggaagcggtggcaatgcaaatttagagaccgggcgatagggggaggagcatatatatgcatgtttgtgcgtataggtctacttgttgatggagatcacggaagaaaccaatgcattgtcatgatagaggacatgcacatttatgcagaaggccctagggctggaattaatttttttttatttattgttttaaatgtatcgtgaaactatattgttgtttgattaactgcaggcatctcaaatgcaaagtgctatatagtgtagctacatagtactacctccgtattttaatgtatga

SEQ ID NO: 8993 - DNA, 5667 bp, Oryza sativa
  unsure (1)..(5667): unsure at all n locations
cgtcatacattaaaatatggaggtagtactacactaattagcaatgaagcatctcaatactacagaaaagggctaaagtgtcaggtcataatccttcatcaatgccagaaatcaaaccggcacagatcatcagtgtcgggttaagaaccgacaatgatgaggactcataagtgccggttcaaggctacaaaacaacgtgtacagtgattttgtaaacacgtgatattttttacagaaatatataaaaaaatataactcaagcctaacaaccattcattcaaatttgatttgaaactagaaagactctagcttagataccagccaagcaatccacacagcaatttttaagaaatcatactacaccgtgaaataattaacattacacaaaagaattgaaaatatgtgcgcaatgggatcaattgactatccgtaatcttgccttgtgagtggcgacacgcaagagctgcgcggaacaatgcaaccagaagtaaaggttggaatattccctgaaaagtgcatctagccctctaagtgggttttggtggattattgacaaaccagttaagggaccaataatattgtgaagaagtatgtgcatgtgttagtcccaaatgaatggagatccccaaatctaatggaacgtggagcaggaacttgaagagttattttaaatttcttttatgttttgtctctcgagttctaggatcttcgtattatcaagaggggttctcaacagatgcctggtgtctacaagtgctcatagacattctctagaagagagacacatgtttcacacacacatacgggttgggccacctttttgtatctgcccagaagttctcctgggaggtgctaggaaaacctctggccgctatttttctccgttgcgcctaagtgttggccggaagttctccgggagccaacccaggattctcaagccctgtgttaagtttgaattgtgagtaacggctagctgatgtcacacgagtacctatatattccggcctcccccacctttgttggctggaaaatccactttcattttcttgtcccctagcctctcccatgatgttcttgctttccgcaattagttcttaaactctactccttgatttgagagttgacgaggaagataggagatgtggtgagtgttaggagattgtgagcgcttgaagatcttctcgggtttgatgctttgggcttgtttctcttggagggcaacctcctagacggataggtttcgcccgcgtgcatccaagtcattgtggattgaccggggaaagtttgtgaaggttttcctcgcctccgcaaggagaagaggtaatttgagtgaaaattccgagcggagctttcggaggttgtcttggtagagcaatccatattcgtggtgttctctaggtgtccaagttgggaatctttttggtcatttgaaacctagagaagcaactagggatgttggattgaaaattggagatttcttcttagggttttgcctggtgagacaaggtgttaattgagacctagatctttggagctcctcaatggagagtaggattcttataatctgaacttggggaaaaaaatctcgtgtctcccctcttgtgcaatttatttctcttttgatttactgctttgaattgttcattactatcctttgtacctctgcaagtcttgggtttccttgagaatcaagactcgagtcccgagaagcgagaaccccggatgtttctagaaagaaccccggaagttccagggagcccttattgtcttcgggtgagagctgctagaaagtttcggtccctataatttaaccgtttcaattgaagaaaatttcatgaaagcctattaacccacctataggctacaccttaggctttcattcctgtccttagcagtttcatgccatgcacagatcttgttgcgcagtgagtcaaaaaccatccttgaccagtacacttttgatatctgaccaaggtcactagcaatgtattcattcatgccaataatatagaagctagtggtggccatcaaaagcttgttcactacgatcatgatgaagaaacatacaagctcagggccattaggcctctctttgatcttggaaatcaacccgtcgaccgttactttgggattactaccaccaatgttgagcttatccaatagattcctgacatgtgggccccacatgtagatggggaagaagatggaaaacgtgatggcaatggcatggttctaattttgtaaaatttgagtggcacgactatgaatagacgaatggaaatgaataggcacatttgcaatggcacggatcaaattaacccttagacaaaacatgtgactattttatacaattgcatcagtgattatagcaaaacatgggagtgggacgttgattatttaccttagtgagctagtggcgaccgtggtgttgtagctctttgcgacaaatcttggcctacaacttctctcggcatatccataacattctccgacatcttcaactaaaaaaggcagtgaaaatatatcaccgtggtgatttttttagtaactaatcaaaatgtatgataagatgaatagcgatgaatttgataaaggagaaaaagccaaacatgtccttcctatgcattacacacatacatgtgttggtgttggtcctgttggagtgacctgagtagcaccccaaggttctgagttcaaatcttcgtatgagcgaatttcagattggcttatttaagggctaagtttcctgtttgaaaggctaagttcctaattttaaaaaggttgcatatatccagttgaatgtagaggccggaaaaatactcttctctaaaagaaatgcattacacacatacatgaatgattctagctaaattgaggatgatgtttagttggtggcgacaatggcgctcgccgtgctgcagctcctcgggggcaaatccatggtatcaccaacaccaatgtgtgcatctagggatgtagttcaatgaaagttaggaaattacttatcaatttaattcaataagtaataattactccctccatactcgtaaaggaagtcgtttaggacagcgacacggactccaaaacacaactttgacttcttttttctataaaaatatttattgaaaagttatatatgtacacttttatgaaaatatttttcaagacaaatctattcatataatttttatattttcaaactcaacaacttgagagttattcatgatttatacttccaaggtttgacttaaacattgtcctaaacgactcccttcgtgagtatggaaggagtaataagtaatcatggcatggagcagcattgaatcagagtaagctctgttttctgtgtagcatgcattcatttgatttgaaccttaacattcagaaattactaaatctcacaatgaagcatattgagtttttagagaatgtctactgccattacatgaatacggttcacaagctaaggaagctaaatgtcgatgcataaaactaaaactaagaagtcctaagcaacagagaccatggagaaattaagtactggaatttcgtcccttcatctccagcaatttcataagcaaagtacatgatagatacacgaatgggaagatcagtagatcctaaatgaatagcagcagaatagaatcaagagtaaagtgcacgggcggtccttaaacttgtaggggtatgtcatttaggtctctaaactctcaaaatgcatatccaagttccagaacttgtcatagtgtgtcatataggtcccaaatcgccacaacccttcaggatcctacgtagcgttgatgtggcatgccacacgtacatgatatggcattattttgacggacaaatggaacccatttaattttttcttttgtctttttcttcttctttttttcccctttcttctcctttctctgtgacccatgcagaaaaaaggaaaaaaaagaagaatgagaagaaaacaaaaaagaaaaagaaaagaagaagaaaaaagagaaaagaacacgtcacgtccatgtggcattgccacatcagcgccatgtaggatcctagagatgatgtgtcaatttaggatctagatgatacactttgacaagttctgggatctggatatacattttgagagtttacgaacatatatgacacaaccctacaagtttaaggtttgccaatacacttttctctagaatcaaaatgaatgaccatgctttggcactagctaaacatttgtactatatttaggctgtgtttgctccagcgtgttcccaaccgcacggataacggaacggtccattagcacataattaattaagtattatctatttttttaaaaaaatggatcaacgtgatttttttaagcaactttcgtatagaaacatttttaaaaaacacaccgtttaacagtttaaaaaacgtgcgcgcggaaaacgaggagattgagttgggaaatctgggctaagaacacagccttaaggctaccacaaactctatcaaggcttgtagtgacaaccagtggttccaacaaaacatgggattgattattttaccttcgcaagctggtggagaccaggacgttgcagttcttctcggcaaatccgtgcatcaccaacactaacacatgcacatgaagctatacaattgttcttatccctcatctgactgtcgtcgccgttgccgttaccttgaccgctacgccaccagtgtatacatgacaattgcccatttgactgtaggatacctccatgagaagaaaaagaagattgggggacaaaaggagaagatgatggagaggaacatgtgagatggagccaagagacagaggaggacgattgagccgtgcttcctcgctcctctagctagctggcagcttgctcaaccaaccactggccgccataggagaggggacatggagaaaatgaaaggattagggttttccagagtggggtttgtacttttatactcaatggaggtaaccatgagcttgtgtttggaccttggactaagatgaaaatttgaattggaccaaaattttttttgttaagggcttttatcttaggttacaccgaaataggcaacttaaagtcgaatatacatatagggttgtcagaaaagctcgaagcatttgagcttgccaagctcgactcgagcttcacacgagccgagcccgagcctgttgtgagattcacaagccttaacgagctgagctcgaatagctcgtcgagctcagcactcatgcatggtagtgttagtcagtaccgtagacccttttgttacttagcttgaactttttttatttgtctaaatgctatgctacccaagacatgtcacaacgaaggcacatgtatgctcaaagtgcctacatgtagtacctaccatgtagcctatattcctgccttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8994 - DNA, 701 bp, Oryza sativa
gctcatgaactcagattctcattctgtcatgcatctacatggagattgctgtactgatatttgtgagaagataggttgatcttgcatgcaaactgccaacacactgcaggtagggttaagttactgccagcttcagttgtgaaattataatatcatcacttcaaaagttcagagaaatggactgcaatttccctgatttttagcacatctgcgtggacattggagaccactgactgaatggattggtccagctgtcctatttttgcgctgtcctcatttggaggagaatctatcatgctgtttcatcggaactcatcgaataggaatggagttgaatatgttgtgcatgattcattgtcctgacacctaatagataaaaagtgctctctgtgttgaaattaattggatagatggatgatgaaggtagctagctagccacattgctgcagcataatatatatcgcagtccactttaggatgagcaactagctagctttcttctctgattgatgatggcgaggtgtcaccctcctaggctcctatccgaaactgcttgaaaccatcagtaactggtttgctctgaagaaaaagcgattaagaaatatcagggatacaaatatccaagcactagatgctaaggttggaattcatggatatttgtaggtttcacccttttcagaaaaagagctgatgaactactg

SEQ ID NO: 8995 - DNA, 16190 bp, Oryza sativa
cacattataaattatcttcaagccagtgttctattaatgaagatgacaaagattacaaatcgcatgttccatatgccagtgctgttggcaatcttatgcatggtatgatttccatttgcgcagatttagctcatgaagttagtgtggttagcacattcatgcataatcctggcaaagaacattgaaatgttgttaagtggattcttcgttatttaaaaggtacttctaattttggcttaatgtttgatatgaataaggtgaagatagatgatgttgtttggtttgttcttaataaaaggtctatttccggatattctctttgtgtggttctgctgtaagttggaaagcttcaattcagtctgttactgctctttccaccatagaagcagaatatatttctactactgaaggtgtctaggaagctatttggttgtgaggtcttattcctgaagttggtattcagtaggatgttaatattgtttattatgatagacagggtgctatttgtttgaccaagaatcatatgtttcatgccaagaccaagcacattgatattaagcaccattttattcgtgatattgttgctcaagggcaagtttttatgaggaagatacatactgatgacaatcccgtagatatgcttacaaagttactctcagtaactaagttcaattattgcctatacttagtaggtatttgtggtacttagcagcccttcagggttttggagacattttcttctacaacatatcctatatacctatacaaatcatccccaccactagaaattctctgcttcctggtgcttccacgtcatcattttttcctcatcattttttcctaaccgttggatctaatctaattgatccacaccccatcccggcatcccgcatccgcgtacgtcttccttcccccgcgtctcgctccgccggccccaccgcattgctactctctcacgcgagcgcacccacatcggctccctctcccgcatctctctccgccgcccccactgcatctccctcccagcgattccttgcccaatcactcctccctgtctccttggctcggccccgcctcccttggactcccgcagctgccatggaatccaaatcgatccactacgatgcagtgtctttatcacttttcatccccacggcacaccatgcagtgtcattgtgtcgcttcttctcctaacccctgcaacaaatcgatggggccatggtggcgactcgagttcggcctagcgcggcgcggctcagggatttgggtcgcttcttttctttcatccgccgtaaaagccacctggaagacgaactgcgaggaaaaaaccgtcaccaccatcaataatgggcttaattccatttattccctccctacaattcatcctccgtttagatgaacctcaagcaccatcccctccagctcagaaggcagcgtcaacagtcgggaaatcctctttctgtattttcatattttgctaatttcaatttgtgcttgcctgcaacgcagggggttccgggctactggtctctcttgcctcgcctctttggagtaggttacagcatcgacgattggacggcataattaacgaagcaagagacgagcaggtggtggagagcggaggaggcatgcatgctatggtcgatgggcttcttgcgcgagacagacgaagcaaagtgcgaggtatgaagcgggttttctttgctacgctcttacggctattgaagcttaggcaaacttagcaggctttcaacgaaattatgactatcagacagtcaggctgtaaaatatatatattctcttttgccctacactcctactgtacaacacacatccttctccacatcgattatgtttggattttactattggtaaggtaagcaacccaacatatcgatctactgagggatagcaaaccgtaaagataatcaaactatgttttcattaaacatgcgcttggcattttgccttgctgtaggtttctgtcatttgattttctactgtattgacacctgaaatgtgctgctctccttctttcaggtcatgttactaccgtgcaaacaactactttgttgcctaaataggtgtgttttctttttttggataaatatagcattcatatatttctatgtgaagttaattagttttattcaactaaaataggatagctaaatgtacattcaaagagatcatcatggttgtctctgaaggtagagagaatcccttatatgccactctaaattaaccagctcccttatatgccacttcaaattggcttctctcttttatgccaccggttcaagtttctcctcccttttatgccattgccgtcagtccaccgtcagttgaccgttaacttcattgtaaaaagacgcatttgccctttagaattagtatacaaccaataataggtattttagtactaatatagctactagatacaacatatgaaaattgatttttttctgcatcacatgcaattttagccattaccatcacaaataaattttcaatgtaagcatgaaacatgcagttttccaataatatttttaatataaagagcatttttcactgattctgacaaaattttcttcactcaaaaaggatttaaaataaattagttatgaatttttgaagtttacacattttttagttgagagggcatattggtcatttacgaaaaaaactaacctttgactaacagtcaactaacactatagtggtgggagtggcataaaatgttggaaaaacttgaactagtggtatataagggggaagccaatttttagtggcatacaagggaactggtcaaattctagtggcatataagggattctctccaaaaaagaaggtaactcgaacaattttttattctagttatcgatttactttcgctgagcattgtgaatccatccctctttgttgcaccattttgttttgtagctaggtgcttttacataatcaaccatgccaggatgtatacatgtgtgttttgcttcctttcttctttcttttagttaacaatcttatgttacattcctagaaattattttgtcatttagaaagttctgctgcaacgcgcagggtatcatctagtttatagggtttttgagtcaaggaaaggttgttggataatgactcaaatatatttagtcctagggtcttgttcaatatgtgtctaaatatatgggccacccttctacatgtaaccctgaaccatcatagttgattttgtcttctatggttattttctctctatattagagggatgttttcacataaaattatgtatctcttttgcatctattttccctatcaataacattggagcgattggagaggataatggtgtggagatgtatatgaatcgaactaggacatttaattatttgccacttttaagatgtgccaattaatgatttgccactcgctgtgtatgatgtgtgggccctcatgtatctatctcatgtgtctatgatatgttggtcaagtggcaaatcctatataaccactcgtaagagtggaaaatatttaattattttgaatccaccgagcataattccacgaacaagagtaaaattccaattttcatttgcttggtaaatcaactaatatgcaagaggataaattggacaaagtggctgaactaaaagaaggataggaggataagaaaagggagagggagtggacgtggtgtgggtggagggtgcgatgcagtgcagtacaaagggcgatgtgatgtggtgtgcatggttgatcacccgattgagatccaatggctaggataaaatgaggtgacgtggaagcacgagaaagtagaaagttgctattaactacactaagtgcgaatgacttgtatacccgcatatcatctcccatcaacttaatttttctccatgcgttttataggttgtattacaaatccatcaaacttatgcatgctgatctataacaaaaagacaaaatttgctacaggacattgaaaaaccatggcctttgctgagggatatcgtaagaacatgaatttgcttagggacactcaaaaaatgtggtaatttattggtagacaacatacacattattttatgactttttgctattttggagggagaattttcacaacatgggagatttgcccctaggaccaattagtacaaagagttttgttttctttacaaatcaagtccctggtgctttgatggagtggagcccgtgtgtcattgtctcgaggagggagagagcagtagctgaggcagagccttgccggctggcactccttcacggcgacgctgacagtgaatggcagctccttggacgatgcggccaaatagagaaagatgtgcaggcttcttgcgaacccgacggtggtcgtcttttagccggaggtggccagaattgacgacggtgctagtccggtcgagccaaggagcttatagttcgatgctaccaagatgtttgtagagacgtagagacgctacattcatgaggaattgagagacggaatcgaagatggcagcggttggccagagtttgggaagacgatgacgatctcatgattcacgacatctcatgtcaattgcttgggtcggagggctcctagggtctcggcgatgacgatggcgcgatggatggcccgaccatgcgccatggtgcccagaatgtggagatggtcttgactgtgacacagagagctcgctccggagtcacgtcggcatgacggctttcttgtcgatccgctgcatgacagagggtgaggtcaaaagttaaaacattcgacatgatgaggtgaataaggaacagggaagagatgatggagagcacggcttgacgactagcggcaacacctccttctgggcggccgacttgggaagaagaaatacgagggtaaaatagacaatttacgtggtttctccctcctcacataagtaaatattatattttaatgcttattgtgtcctttagcaaattaccgtgttttatgagtattctcggacaaattcacgttcttacgatgtccctcagcaaatatcacatttttggagtgttctgtcgtaaatttttcctaactaaaatatatccgctttcatctccaacgtttttgtataagtatttttactgcatgtatttttgtgagggttatattaataacacagtatgaactgttcactctgaagtgggattatcacctactggtggagtaatgaagtttcatgtgttgtagaactctttattactatgtcttcttattagtatgctgtaaaacttttagagcaattggtttggacattggttggactggcggtgtgcggcggcaatgggcaggtagcaaggcagtgggggcaccaccggagctgtgaggatggaggccgacaatgggcagggttggcagcaacctgagcgagggaggccatatggtaactgtgcggtcggtgacaacaattccgacagcatacgggaatgacactaccgctggattatggagaaagagacggaggatggcagggatgaggaaaaggctgaggattatatggttttgtgggcctcacctgcgccgttgactccttttggcaagccgacaagccaagagtagcatcgtcgtgcagggaggagtcagcagcaacccatcatacatgtgtgcataggtgaaacggggttgaggagggaagaagtgataaggggagagagaaagagtccacccaattcttgcaatcctaaatggtcaaaaaaaattgatttttttttggggggggggggcaactgagaattagacactcccaaaaattaattaggaaaactgagccacccctgtaggacgacccagccaaacttgccgctctccatgatcaccgttcctttgagatgcatggggccaccttaggaaggggatgtttaggtcatttaattgtcagagcatgatgattatgtgtcgatgtcctcctattctgcatttaaccactcaagatccagagtactgttgccagacttaacacatctcgggcgcgatttgatccatattccttaatttattgggtccttgattatcacgatcacttatggtcgatcatgagacgtgggtgattgtgcagcacaaataattattttaagggattgtatagattatattaattttggacttgttcggcgggaaggaggcggtggtgatgtatatcagcggttgtgatacatcatgcatgtgtgcgtgcttgaaacagggataagaagtgtagaagagatagggcgagatagaaatagtctacacgaacctcgatgcaattctaggcgtttaaaaagtgacagtcttttaggcaaaacttagacaatctaaaaagttaattaggaaaacagttactttttaaacgactctccacaatcgacattcctttgagatgcacgaggcccactatcgtaggttgaggaagtttaggccatttaattgtcagggcatgattatgtgttgatatcttcctattctgcatttaatcactgaagatccaaaacattatattaccagacttaagatttcttgggcgcgatttgatcaatattatttattaggtccttgattctcacgagtcacgaccacttacgaagttatgatcgatcaagagatgattgtgcagggaagattaatatttgagtgagtcaattttggactacatgtctacattaatagcttgacgatcaagaacgaaataagaaaaatatgctctatgatttgatcgatcgatctcgaattatacgttatgatatgtaaacaccagagaaaattgggatcgggatatgcaatctagtactagatattatttaattacatactctagtatgaaaactatcgtgcaaatcgggatactcttgagctggccggaatatttttcctggaatgcaaaaataattacgaattacagatcaatgccgtgcgcccgtgcagatgcaatggatatatatatcggccacgttgctgcttcttctaatataataaggcaatctcgttgcctactttgcacgatgtgagctaatcacacgaagtggacaacaagttcgtcatgtgatttgttgtctttctcctttgtgctttgtgcatcgaatggcatcccacaattatccaaaaaaatttacaaaaagcatttcactgagcttttgtacgtacgttatttatactacctccgtttttatgtaataaatacataagcctgttaacatttcgatattacatttgtcttcctaaataaaactaacatttatatttggtgttgaacttttttaataattaaatgtacttggaccattatatacttttgcacatttccattaaagtttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagaaaaaaaagaccgagaataacgtatttggcccaattaagtatatacatatgtaatgcgtaatatacctacatgtgttgaattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggagcagctgctgccgctgttgttgacagccgcctgtgcacacagcacgcggaaggccctgctgcggtcctcgccatcggcactgcaaacccggcaaatatcgtctatcaagatgggtttgccgactactactttggtctaaccaagagcgagcatcttattgagctgaaggacaaaatgaagaggatatgtaagtagaacaatcctttcatttcgatcgttgcattgatcatcattatcgttagttgtttttcataaactctaatgagaataaattatgcaagcgcttaaatttttaggacactcctgccataattcattataaaccatacaaatatttatactatactacgtagaaagaagagtgaaatgatgttggagttcagccaaattttctttatttcgcgtgtgggatgcaatgtggatgcatggggtgtggttgcatcccaaaatttttgaaaaaaaatctactatatacagtatatacttggtacatatacgcagtatgctcaatacgaggcccacttaaggtcatccaggactatatgctccatttgaatttctacattatttatgtcattgtatttgtactcgctatatttaagtgttttgctagtatatttttttcactttatctcttatcttgaatcataacagtaaagttttgcatctccatctctgaaatcctggatccaccactaatacctcgttaaatatgatagtttgtcatataatgtccctcctgctcatcaggctaccatctcgcacccatgccactgtactcgtatagatttaaagactacgcttttaacaaaaatacaagagatctacagagtagtcatagcaataaatccgtggatcttaataaatttgtactgaaaaatagcacttacttgtctatatgttggcaccgggaattgagtcttagtggatagagttatgcacccacaagtacatcattagaccatgtttgaacgaaacatatgtgctaatccaatctttcagaacattaaactcatgattatcttcctaaaaataggacatatataaaccatttttgttttattacggaaaatgcttgcataatatcatatattcttgttttgtaaatattcggcatcttaattgaaatgtctcatgttattcttataatctcttagtgctatgtactaattgtaagagatgtgggtgcatccttttccatttcaggtcacagatcgggaatagagaaacgctacatccaccttgatgacaagctcatctgtgagcacccggagatcatcgacaaacacatgccctcccttgaaactcgtgtagacatcgtctctactgaggtcccgaagctcgccgagtcagccacacggaaggccatcgccgagtggggccgtccggccattgacattacgcacctcatcttcagcacctactccgggtgcagtgctcctagcgctgacctcaagctggcatcactactcggcctcaacccttctgtttctcgcaccatccttagcctccacggttgctctggaggcggtagggcacttcaacttgccaaggagctcaccgagaacaaccgtgatgcacgcgttctcgtagcctgtgccgagctgacgctaatatgcttctcaaacccagatgaaagcaaaattgtcggccatggactgtttggggatggtgccggagcaatcattgtcggcgctggcccactggtcgatgaagagcgcccactattcgagatggtcctcgcctcgcaaacaacgataccaagtactgagcatgcacttggcatgcagaccaccgccagtggcatagatttccacctctctatccaggtgccaacactgatcaaggacaacatccggcagtgcttgcttgacacattccgatcggttggaaacatggatcctaattggaatgacctcttctgggcagtgcaccctggtggccgtgcgatccttgacaacatagaaggcgagcttcagctgcaaccagcaaagcttgcggcaagccgccatgtgttgaacgagtatgggaatatgagcggcacgacgatcgcgtttgttcttgatgacttgcgtcgccgtcgggagaaggaaggagatcagcatcaacaacttgagtggggagtaatgctagcctttggaccaggtatcacaatagaggcaatggtgctgcgtaacccactctcatgaagtcttaaggaaaattaattgccactatcttatgcttgtctggtatcttattacggtatatgttaattaatcaatgcatgacactaaatcaattctgcatgcttaagtggaattatgacctaccggtgatgtattgatgttgtggagttcctatctaatgtttattgctgttttttctgtatttggaacaaaatttgtaataccctgtgtataattgaaaaagcatattgcttatatgagttgcttcaatccgagtttggatcaattgagatgtatctttcaagaaaacacttgaataagatcaagtcagtattttgcaagtgaaaaaatgttccaaaacaagataaaaagatgcaatcaatttcaacttaatctttagtaattaagattgtttttcttctcaaatatacatgagatgttgtgtatcattgcattaatggaagaacggaggcgtaagatgcaaatacaaataatcagaaaagacaaaaagtgagaaaacaaaacacgagcaaaagaagaacaaagtgcctaaccgaggctctcccaacaacctgaatcatgggccttcttaaccgggatctataatcaacgaaattcccctaggctcaataggtgagcctcgtcactcgctagaactagtcgagaagatgattggagcagcctcgttgaaaacacaggcgtttcgatgcttccaaatagaacatgccctaagaatgatcatattatttatacccttccttatagcccgttttaccaaattcttgtgtcttagctagggagatcgatctgctttcagaaccggcggcgcgttcatcttctcgtcgttcgatctgatcagcgagaacaattctgacaccggtgtgttcttcgatagatccatctgatcggcggcagcatacgcgcttcatcccacggcgagttctttgatgaatctggttggtggcggcaggcgtgcgtcctcctgtcgtctcatcgagttaatcggctcgacgtgattgagttttcggcgcagcaatccgaagcggagttcttttttgctaccacgcatccaccgaaaaagcagcagcgcatagctgcacggctctggaggaggaagaaaaatcaattgaagatactgctcgcttcgtgtttatgtgaagttccaaattcctgttggatttttgtacgtccacaaagactttatatcagggaatttcttttcttttggaatctattatatatattttttgatctggaattgtttctccaacatgtcatgtatcaaatttgacattgagaagtttgatggcaagattagtttttgcatatggcaggttcaaatgaaagttgttcctacacaagttgatgttcggaagcgaatatgattgatcaaggggaagataggctgtgttatctgtgtgaatggtaccgtatacaggttcttaagaaggaatcacaaataccgttccaaagcagcatatttcgacaacactgaatagcttgatgatccaccaggaccatgcaagggtgatagagtgttccaaatgacgaaaaatctcaaagtttttttttgagaaggcaaaaaagaaggaaaccaagcggaagcgaaatgcggaaggaccaagcgttctattcaatagatatatagatacatcattttatcggtgtcatgcacctagagaaaaatgtgttctatagaaccattgggactttagtagccataccaagcaagacaaatgatggactgaagtcacataatgtaacagcccgtcctccagaaccgcgtagcctagaccatccaatgggcgggcccacttacacataccactcccgtacacgtttatcctcgctttgtataaaagtgttaaccctggagtgatatggttggagggacaagcccactcttgctaaactagcaagatggtactaaatatacgcacacaggtcttattggccacacatgccatgtcctaattataccaggatgtcacacaccctcctcaaaggacccgacatccccgttggcccaatttacccatatagtcacacacaggcatataggtaaatgtctaggaacacaccccctcttaatgcttagtgcagtccgccttacatagagcccacatgtgccatatacccgcacactgacccatacaagcaaccgcgagggtcggaactgataccattttgtaatggcccgccctccagaatcgtgtagcccagctcgtccaacgggcggtcccacttacagataccactccacttacactttcgtcattgcttcgtgtaatagggttaaccagggagtgatatggttgaagggacaagcaaaactagcaaggtggtactaaacatgctcacacagctatcatgtactccttccaaaaatctgagacctatttcattctttggtttttctcaaaatctaagtcctatttgtagtcactatgtactaaattgaattgttgatcagaaaccaataagtcattctaataattattggttgcatgctcattggttttgccatatggtgagtgagttaattgcttcttggtattgatgcaaaaagaaataggtctcatatttttggaaggagggagtaccacataggccatatcttaattgggccaggttgtcacatgtaaggaccttgtgaatacgcagataacagaagagcttcacctgcggatgaaggtaatggaagagttgtaacatcccgcctctcctaggccaggcctacttacatctggtagcttatcttggacatagactaccctcacagaccaacacaagtcttttctgcatactttgtcctcactcgtgtgcacccgggaagaattttccggtcggtcacccatcccaaaattgctctacgccaagcacgcttaacctctgagttatttggagatcggttaaggaaaataagttgcaacctgatggtatgagtattctattaatcctattaagccctaggccaggatgtcacaagagtgcacctttcgctgacttattacaccttgacaaattatgagaaaatggcattgtacaaatccctacacgaggtgagagtccctaccggtttctcctcaaacataaagcggctagtgtcgatgaaggatttatagcttttgggctacatttctcatgactgtcatgtaatgctcataatattcattgctattgcaatcaaagtaatcaaactagtacacgtaaagatggttgtcacaaaactgtgttatttcttcaatgcaatctcacataaagtaattgaccttgaagagttaggtcatctccgtgttttcgctatagagaccttgtgcaagcttgagatgtgtttccctctgtcatttttcaatatgatgcaacacctcatggttcatatcgtgcctcagatacttgtgcttgggcccttgtaccttcatcagatgtggacattcgaacagtatatgtccaatctaaaaaggctatgtacggaaccgtgcccacccagagggttcgatgatagagggatacactaccaagaaagtcattgagtgttgcattggttacttgcaagatgggaaagcaattggtttactagtacctcgacataaaggtaggttatctgaaagagggacaaaaaggaaaaaagaatcctcgacaatgactacaaagcagtgaaagatgctcatttcattgtcctgtaacagcttgtgatagtggagctgtacatagagcagcacctaaaggaattacaagcaagaaatgtcaggcgctctgaagcatggatcatgaaatggcacaaatctgactttaccgaatggttaaaggacctcggccgaccatatggtgatagcacgaaggaaaaaactatgaaaagtttggctgacgggcattcaagagtgtacacctcatggtgagcgtatatctgaatgggtacacattttataccaaagcaagagacaaaaggagtgcatctcaaaataatggcgttcaagtataggaaatcgacacaacaggtcaaaagagcacatactatgaattcatagaagaaatttgggaacgggactacgaacccaatatgcagattccaccgtttcggtgtcaatgagtgaaacacccagctggcgtgtttgtggacaaatttagacggacaattgctgaccttgacaacgtaagccacaagaataacccattggtacttgccgatcgagccacccaagttttttacgtgactaaccccatctcagttgaagaaacacatagttatttccggaaaacaaaggattttgggagttggtgatgttgaagatgttgaggcatacaatcaatacgagaacatgacactattcatggattttggaaactacattaagcttgtagaagaaacaattagtgaatcgccgaagccgtacatgaggaataaaggagtaaggaagaatgtgaacggctaataaatgtagtcgctgttcaatataaatatgaatcaatgaatatttacatatgaatgtgtgacatgatggacgatgaattttttatggatggtgaattttatattatttgttctcatggtttttggtgtttaaaaaaagagaaaagaactaaaatttataaaataagaaaataatgatatattagttactgatggtgacatcatggagactctgatagaaaaacctgtggtttacgttttggggtgagggttgggctgggtgggggcactactagagccacagggatggaggctggcagtcggcatggttggtagtaggggcgagggaggctgtgtagttaggaggaggcgattggcggtggtgattttgaaagctatggcagtgcgccactgctgttcaatcaagaaggaagagagggagggacgtgggattggggaacgggaaggaggcttgtctggtgggcctcgctggcaccgttgaccccttccggccatccggcgagccaggggtggtacgttcggcgggaaggtggcggcgatgatgtatatcagcggtaatccatcctgcatgtgtgcgtgcttgaaatagggacaagaagagcaaaagagatagggtgagatagaaatactctacacaaatgtcgatacaattctaggcgtttaaaaagtgactgtcttttaggcaaaaatcaattaggaaaactgttattttttaaatgactctccacgatcgccattccttcgagatgcacgaggcccactaccttaggaagaggaagtttatatcatttaattgtcagggcatgattatgtgtcaatatcttagtattctgcatttaatcaataaaggtctagaacattatattagcagacttaccacttcttgggcgcgatttgatcaaatattatttattgggaacttgattcgaccacttatgaagttatgatcggtcatgagatgctgtgtggattgtgcagagaagattaatatttgagtgactgaattttggactacatgtctacattaatagcttgacgatcaagaacgaaataagaaaaatatgctctatgatttgatcgatcgacctcgagttatacgttatgatatgcaaactccagagaaaattggaatcaggatatgcaatctagtattagatattatttaattacatactctagtatacaaactatcgtgcaaatcgggatactcttgagctggccgg

SEQ ID NO: 8996 - DNA, 14230 bp, Oryza sativa
ttgcacatttccattaaaatttttaataatataaatgatcaaatatcaccttaaaaatcaacatcatcaaatattttaaaaccgagagagtagtttggaacgcacgtttaaattacagttcatttaaacctgaaatgttggcagttattattgaaccttgcaataaaatagtagttgcaaaacttaagacgtgattatccattttacagtacattgctgatacaatcgtttttatggacagccactttgaaaaggcaaataatacttatcccagtctcgagaaagttacccggactaaaaacatatcaattttcattttcaaataagtgttttttgtttcagtaaagcaaagcaacaatgaactcatgattttaaggctagctattcactcaataattattgccgataaagttcatcacaacaaaacaaaatagtgtcgggaggagtagatgtgttgagaaaagaagaccgagaataaagtattaggcccaaataagtatatacgtatgtaatatgtaatatgaaaaagtatatatacatccctaaactttatattgaagtctgtctagcacattgcactttaaaatcgaacatccaaccccctgaactttgccataccatccatattaccgttaaggtggttttggatgatggttttgcatattttagaagcttaaactgttgagttgtgatccaaatttatttacacttaataaaggctagattctgccgtagtgaagcggaggcccgtcgccggtaggcttggttcagagccttttagggttccaccttttacggtacggatcgtaataccttttagggttctacctcatatatatatatatatatctctgctaagccgccgtgcggcattgtaacctcacccaatatagtgaagatattttactggctagcgcccgtggctttttctctcctgctttgggagggttttccacgttaaatctcatgtcttctgtgattgatctgtattgttctttatcgtttatttgcctatcgtttcctaacataaatgacaattttgaataactaatgtaacatatttacgtatcatcagttataaatcatcaatttatcattatatagtgatatcatgatattattatattggtgcttgtttgttagtgagagcaaataaaaggcaaaaagaatgatttaagtcaaaatttttgtatatatgtccaaagtatatgacatgtgatcaaactcatccaacttatatacaaattagattaaaaaaaccactatgcaaaaccatcttagggggttacatcaacggtattctaaagtttagggggttgaacgtccagttttaaagttcagggtgctagacggaattccatcagaagtatagggggttattaggattggaaaaagtttacatgtgttgaattattttcggacaacttttgagtattcacttgaatacccacgaatctccctgtgtccacccctgaagcaagcaaaccaggaagaacaataccaacagcatgggtacacattttggcctccctgtaaactctataactcaaacaagaaatcggcagttctaaattattaaattagaaactgacctaatatatatatttctccaaaaatgaattggacaaattaaaacttccataaatttaattttatcattaaaatgagattttgttcagatttaagcatgataatctgcttgtaagttatatgatgttatatggaccatgtgatgattttttaaatattcttttaagtgatttactaatgcaaacatagttgggggtttccttgggctaggttgtccaaaaactagtataaagccacacaaccagaagctagaatatccatccataaacgcatcatactgccacctccctcaactagttgcaaaagcacacgttcttccggtcatcagccatgcctggaacagctactgccgctgttgttgacagccgcctgtgcacacagcacgcagaaggccctgctgcggtcctcgccatcggcactgcaaaccccgcaaatatcgtctatcaagatgggtttgccgattactacttcggtctaaccaagagcgagtatcttactgagctgaaggataaaatgaagagaatatgtaagcagatcaatccttccactttgatcgttgcactgatcatcattatctctagttatttttcataaactctaatgagaataaattatgcatgcacttaaattttcaggacactcctgccatagttcattgtaatgatgttggagttcggtcaaattgaaatatgtcctgccattataacctcggagagctatgtactaaatgtaagagatgtgggtgcttccttttccatttcaggtcacagataaggaatagagaaacgctacatccaccttgatgaaaagctcatctgtgagcacccggagatcattgacaaacacatgccctcccttgaaactcgcgtagacatcgtcaccactgagatcccgaagcttgccgagtccgccgcacgtaaggccatcgccaagtggggccgtccagccactgacattacccacctcatcttcagcacctattccgggtgcaatgctccaagcgctgacctcaagctggcatcactactcggcctcaacccttcagtctcttgcaccatcctcagcctccacggttgctctggaggcggtagggcactccaacttgccaaggagctcgccgagaacaaccgtgaggcacgcgttcctgtagcctgcgccgagctgacgctaatatgcttctcaaacccagatgaaagaaaaatcgtcggtcatggactgtttggggatggtgccggagcaatcattgtcggcactggcccattggtcaatgcagagcgtccactattcgagatgatcgttgcctcgcaaacaacgataccaggttatgagcaagcacttggcatgcagaccaccggtagcggcatagatttccacctctctatccaggtgccaacactgatcaagaacaacatccgacagtgcttgcttgacacattccaatcggttggaaacgtggatcctaattgaaatgacctcttctgggcagtgcaccctggtggccgtgcgatccttgacaacatagaaggcgagcttcagctgcagccagcaaagcttgcggcaagccgccatgtgttgagtgagtatgggaatatgagtggcacgacgatagcgttcgttcttgatgacttgcgtcgccgtcgggagaaggaaggagatgagcatcaacaacctgagtggggagtaatgctagcctttggaccgggaatcacaatagaggcaatggtgctacgtaacccactctcatgaagtcttaaggagaattaattgtcactatcttatacttctccagtatcttattacagtatatggtaattaattaatgcatgacactaaatcaattgttcatgcttcagtgggattatgacctacttggtgatgtattgatgttgtggagttcctatataatgtttgtgaagatatttgagttgtcaattgctcaactctagtacatgttgtaattaaactctttatttctttcatatgccctctgattgttaagttttttttttgttttgtaataaaatttgtaataccttgtgtataattaaaacaccatattgcttatatggtttgcttcaatcattttgatcaattgagagtatttttaaagaaaacatttgaataagatgaagtcaacactgtaagaaaatgatattttacaagtgaaaaactgttcaaaaacaagataaaaagaggcaatcaatatcaacttaatatttactaattaagattatttttcttctcgaatatgcatgagagttatgtagcattgcattaatggaagaacggaggaatacgatgcaaatacaaagattcagaaaacacgaaaagagagaaaacataacacgagcaaaagaagaacaaagtgcctcaccaaggttctcctaccaacctgaatcacaggccttcttaactgggatccataatcaacggaagtccctatggccccgcctaaactccataggtgagcctcgtcactcgcaagaactactcaagccaaaatgcttgaggcagcctcgttgaaaacataattgttttgatgcttccaaatagtccatgcaccaagaatgatcagattatttatacccttccttatagccccttttaccaaattgttggccctgctccacctatcggagaagtgggaacaggggttccctttcccccaaggtgctcggggcgctatgcgccccaccaagccttacaagatctacatctttaaggtttcaagaagagtatggagacctacaatatctacatcttcaaggtgcagaagcaggcactggtgtgtactagtgtctcgtcgaaagtcatgcccatcatgaactccttatttatcaatatttttgagaagctcatctaatataccaacgaaatatactttcggcaatgcaaatgcgcccgaatatgtagggttgccccgaggacttggcctgccttgaggacaaggggtgacccaaacatggcggccaaccggtgacaagattgtaatccctcaagaacccgaggactccccgctcaatcaatggagaggttcaccacattaaggaaagctactcgggtccagaaatcacatttaaaccaccactttacattaattatgatggtcctattgatctaaagtgctgtcatccacaagcgacttatgagattgatctcatcgggagtggatcgggcaatatggaactcggattattggttctgtgagcttcaggaatatcacgaattcggctctggcttcctccagattgtttctcaatgtggatttgtctacggcttctcaatgtggccctccttgaacacagtggccatgtgacgggctatagtttaggcccgttagagatgagagtcatccgtgacgggcttttgtgttggcccaattgagatgcgtcatccgtgatggccggatgcctgattgagatattttctcacatcacggacctttgcttagtgacgagggccctgcccgaaagagatgatgatttaagcccgttagagatagccgatcccgttctagtgattttatgtggagtacaatgatgcaaataaatattaaaaataatatgtaatttaaaatatataagtcattaaagggttaaaaaagacatacaccatatgctaaagaggatttatatatgggatagagtggtctccggttagaactaaagcactatagtgcactatctagtcacgtcctatcctaaatggtaaaaaaaagtgacagaacttcttattttggggcatctgaattagacacttccaaaaaattaattaggaaaactagaggcacccctgaaggtcgtgccagccgaacttgccactctccatgatcaccgttcctttgagatgcatgaggccaccttaggaaagggatgtttagctcatttaattgtcatggcatgatgattatatgtgtctatgtcctcctattctgcatttaatcactcaagatccacaatgttaccagacttaacacatctcgggcgcgatttgatccatgttacttaatttatttattgggtcattgattctcatgatcacttatgatcgattatgagacgcggggtgattgtgcaaagcagataattattttaagaatgtataaattacattaattttggactaagtacattaatagcttcacgatcaaaaactaaatatgaaaatatgctctatgattcagtcgaccgatctcgcgttatacatagtgatatgtaatctccagagaaattggggtcggtatatgtattctagaattagatattatttaatggcatattctaatttaaaaactatcgtgcaaatcgggacacttttgagcaggctgggatattttcttgtaaaatccaaatacagaaaaataattagtacgaattacataccaatgccatgcgctgcaggtgcaattgaaatatcatgatatggcaatatcggccacgttgcagcgtcttctaatataataagtgtttattgcctactttgcacgatcttggagctaatcacacgaagtggacaacaagttcgtcgtccagataccacattagctgctttgttatctttctttgtgtgcatcgcatggcagatctcgagacaataatcgtcttcttaaataaatctatacgagtatcatgaaagtacattaaccattatattacttatatttttcatatttacattaaaacttttcataagacaaatgatcaagcataatattaaaaattaacagcattatattaacatttcaaaacagagtgagtgagtagtttggaacgcacataagtaactagtattaattttaaacaactattaattttaaactttgaaaattattatagaaccggcgaaacaagatagtattagtaaaattaaaggcatagtatcactttttgggttatccatcttacagtacattgctgatacaattgtttttttaccgccactttgaaaaggcaattaatatttatctaaatctttggagaattatcaaaactaaaaagatcaatattcaagtaagacattaatatgtttcggtaaagcaacgccagtaacagacacgggacttcaagactagatattcactcaacaaatactgataaaattcaatagaacagaacaaaataatgtcagaagtagattctgagaaaaaagactgagaataaaatattagacccaattaagcatacacatatataatgtaaatgcatatattgaattattttcagtgaacttttgagtgtctgctccagaagcaaaggaccaggaacaacaataccaacagcattttgaccataagatgggtagatatgttggcattcctacacatttatgtaaactctataattcaaatgaccaggaacaataccaggagcattttgactgtaagatagatatatatgttagcaatcttcacattttctgtaaactctacaacgcaaactagaaatgggtcgaggccagttcagaattacaaaattagtacctgcactaaaatatatatttctccaaaaacgatttggacaagtcatacaaaaatttaattttatgatcaaatgtgattttgttcagatttaagcatgatattctgcttgtaagttatatgatattatatggagcatgttttgattttttttaaatattcttttaagtcatttactaatgcaaacatagttgggggctagcttgcgccaggttgtcgaaaaactagtataaagccacacagccagaagctagaatatccatccataaacacatcatacagccatctccttcaactagttgcaaaagcacacgttcttccagttccatcagccatgcctggaacagctactgccgctgttgttgacagccgcccgtgcacacagcacgcggaaggccctgctgcggtcctcgccatcggcactgcaaaccccacaaatatcgtctatcaagatgggtttaccgactactacttcggtctaaccgagagcgagcatcttactgagctgaaggacaaaatgaagagaatatgtaagcagatcgatccttccactttgatcgttgcactgatcatcattttcactagttattttttcataaactctgatgagaataagttatgcaagcgcttaaattttcaggacactcctgccatagttcattataaaccatacaaatatttatactatgtagaaagaagagtataatgatgttggagttcagtcaaattttatatacctcgtgtgtctgatgcaatgtggatgcacggggtgacgttgcatcccaaaattttggaaaaaaatctactatacacacagtatatacttggcatatgtacgcagtatgctcaatacgaggcccacttaaggtcatccatgactattgatctgctccacttgaatttctacgttatttatgtcattgtatttgtactagctatttatgtactgttttgctagtatatttttttcactttatctgttatcttcaatcataacactaaagttttgcatcccatctcagaaatcctggatccaccactaatacctcgttaaatatgatagtgtgtcatatactgtctctcctgctcatcagactaccatctcgcacccatgcctctgtactcatatagatttcaacagtctacgcttttaacaaaaatacaagagatctacagagtagtcatagtaacaaatccatggatcttaataaatttgtatagaaaaatagcactcacatgtctatatgttggcaccaggaattgagtcttagtggatagagttatgtccccacgttacgagaaaatcataagatcatgtttgaacaaaacatatgatgtgctaatccaatctttcagaaaattaaacacatgttcatcttcctaaatataggacatatataaaccaattttttgtcttgttatggaaaatgcttgcaaaatctcatattttttttgtatttattcggcaacttaattgaaatatgtcctatcattcttataacctcagagtgctatgtactaattgtaagagatgtgggtgcttccttttccatttcaggtcacaggtcaggaatagagaaacgctacatccaccttgatgaaaagctcatccgtgagcacccggagatcatcgacaaacacatgccctcccttgaaactcgtgtagacatcgtcaccactgagatcccaaagctcgctgagtccgccgcacggaaggccatcgccgagtggggccgtcctgccattgatattacccacctcatcttcagcacctactccgggtgcagtgctcctagcgctgacctcaagctggcatcactactcgggctcaacccttctgtctctcgcaccatcctcagcctccacggttgctctggaggcggtagggccctccaacttgccaaggagcttgccgagaacaaccgcgatgcacgcgttctcatagcctgcgccgagctgacgctgatatgcttctcaaacccagatgaaagcaaaatcgtcggccatggactatttggggatggtgccggagcaatcattgtcggcgctgacccattggtcgatggagaacgcccgctgtttgagatggtccttgcctcgcaaacaacgataccaggtactgagcatgcacttggcatgcagaccaccagcaatggcatagatttccacctctctatccaggtgccgacgctaatcaaggacaacatccgacaatgcttgctcaacacattccgatcggttggaaacatggatcctaattggaatgacctcttctgggcggtgcaccctggtggccgtgcaatccttgacaacatagaaggtgagcttcagctgcaaccagcaaagcttgcggcaagccgccatgtgcttagcgagtacgggaatatgagtggcacgacgatcgcgtttgttcttgatgagttgcgttgtcgtcgggagaaggaaggagatgagcatcaacaacctgagtggggagtaatgctagcctttggaccaggtatcacaatagaggcaatggtgttgcgtaacccactctcatgaagtcttgatgaaaattaatggccacaatcttatgcttctccggtattttattacagtgtatggtaactaattaatgcatgacagtaaatcaattgttcatgcttaagtgggattatgtcctagcggtgatgtattgatgttgtggagttcctttctaatgtttgtgaagatatttgagctgtcaactactcaactctagtacatgttgtaagtaaactctttattgctttcatatgccctctgattgttaagttttttggatttgtaacaaaatttgtaataccctatgtataattaaaacaccatattgcttatacggttttcttcagcccgaggtttgatcaattgagatgcatttttaaagaaaatacttgaataagatgaagtccgcacggtaagaaaatggtattttgcatgtgaaaaactgttgaaaaataagataaaaagaggcaatcaatatcaacttaatatttcctaattaagattatttttcttctagaatatgcatgagagttgtgtatcattgtattaatggaagaccggaggcgtaagatgcaaatacaaagaatccgaaaacacaaaaggagaaaaaacaaaacacgagcaaaagaagaacaaagtgcctcaccaaggttctcccaacaacctgaatcatgagccttcttaattgggatcgattatcaatgaaagtccccttggcctcgcctaaactctataggagggccttctcactcacaagaactagtcaagccaaattgcttggggcagcctcgttgaacgcaatcgtttcaatgcttccatatagtccatgcaccaagaatgatcagattatttatacatttccctatagccactttttaccaaattgttggcccagctccacctgtcggagaagtggaaacaagggttccctttccccctaggtgctcatggcgctgtgggccccaccaagcactacaagatctacaccttcaaggtttcaagaagaatatggagacttcaaagtatataagcgggcattggtgtgtaccagtgtctcgtctaaagtcatgcctatcatgaactccttctttatcgatatcttcaagaagctcgtccaatataccaacgaaatctactttcggcaatggcaccgtgcctgagtgtgtaggggtgccccaaggacttgcccaccctatggacacggggtgacccgacacacggcagccaaccggttacaagcttttaatccctcagggcccgaggacgctccgttcaatcaatgaagaggttcaccccattaaggacagctgctcgggtctgatgctcacatttaaaccaccactttacattaattgtgaggtgaactcatacacaacttgggagacgtggtagcacatgcaaccccttgcatgcccacgttaccccggagaacacaaggcgtgcgacatggcgcgtccacagcaaccatccccaagttccacccctgttggctacggtcgcttatgggtagcccgtggacaattggaacgaagacttttgattcatctctccacttgttagttggtaggcatggctttcacatctggtcagctggcttggagggactactacaagactaagcatattaagtttagaggagtaggccccactcgtacatgcatgcaatggcattgtggactccccttcatgtgtaaaatgaggatccgtgccatagagaaaagggttcacactctcatctaaattagattagccaaacatccagtgatcaagtaacttctcctcacacttcttcttttcccgcatcactttgtgattcccttcaacatccatagtccacacacagaagtaaggtattatgcacccgtgcgtcttgaacctatgtactcgcttggaaatttggagcaaaagactttcacatctcaatgttctaatctcaaattcaaacaattccattgtaatgttggacaatctaaaagaacaaaaaccactttccattcaaaatggaacttctggctaatcctgagagaacacatcctaaagctactacactatagaagtacattttggaaaaaaaaaaggtgtagtatcatatgggtgaaatttggagacgataataaaaaaaattcatgctgctaccacaaaaagatatagaagtaacaagatttctcaccttcatctccatgatgggattgtgatttcctcacatgcagacaaagcacttgctttcttagcacttttaaaaataaaatgggcacctcaaagcaaaatcaaatgattaagcaaaatcaaatcattatcaatttgcaggagttatttacaccttaggagggactctctacctggcttctatgatgaaatgctcgaaatcatcaattcaatgccttgagatagagatcatgggcctgatggtttcaatgggatgttcctcgaaaaatgctggcaaattatctctgatgatatctattccttgcagattcagttttgttttggcattatatctgtgggcagtcttaatagttcactagatgaataccacgccgcgttgctgcggaaaattaagttacataatatgtacaaataaaatatatttttattatcaaaactaaaacaatttgatacaattttgagcctaaaaataattgagattgcatgtttttatgagagatgaaagacgagacaatttagatcatagatctatcatccaaatgctagaaataattggggtgatatgacttaatgggagaagagagaaatagcattaactatacttagtgtggaagaactatataagtatataggattcgtcactctaattcctaagaagccaaccctggaaacaacaaatgattagttaagattcttaaaaactagttaagcatattagatacatacaatattattaatatgtcatgataattactagcaaataatgcaaaatttataaataatatatatcacagaacgtgcacaaacgaactggctgatagtgttcagctaccaagtttagtgaccacaaaatagcaatatcattatcgaaaataaacaccgccagagaaagcatttgtaaccccggtttgtaacccctttagtcctgggtagcaaaccggggctacgaatccgggactaaagatcgctgtctttagtcccggttcaaatacctgggactaaaggttttttttttctactttaatattgatttcaaaccgtcctcattcataaaatcatccacaaattcaataacaaaatcatccacatttacaaaaacatcacaaaatcatccacaaatttacatcacaaaatcattcaaaaaaaacatctaaaaatcatccactgttcttctactttttctactccacgacggccgcgcttgccaactacccagagggcaccaccgtgctgcgggagctcatccagaactccgacgacgcgggagtgttccacgtccgcctctgcctcgaccgccgcatgcatggcgcaggctacgctgccgctggccgccctccgcaatggcagggcccccgcgcggccacgccgccacgcccgccgccacccccggctccggtgccgggcgccgcgcaccgccaccgccaccggctgcccgcccgctgccgatgttagggtagagggaaaggggaagccgggaagggcaggaggggaggaaaagatagaggatgtgagggagagaaagagatagattaacataaggatgagaggaggagggaatctctgaaatttttctctctccccctctcatgcgcgccttttgttttctctagcccgcacacgatttttttaatctttagtcccggttgtgacaccaccagactaaaatattggggggggctgacacgtcctgacaatgaatgaaccgggactaaagatgaagattaaaaatacctttgaacttataacccgggactaaaaatggcttttagtcccggtttttgttcatccgagactattgtggtttttgcccaactcacgaaagatggtttctctagtagtgaaagaagaactgtataacaagaagatggaatatcgcaagaaatgctgaacaaaaattttcagttttaccttgcatcgtggtaaacaacaaaaatttgttaaaaattatgaaattttaataatgttaatacaatattgatgaataggagtatttaaatacttcaaaccagctgggatttgcggctcgaaatggcttttgccctggcgtggccctcgctgggtgccgacacgtcatccggcactggattttggctgggtttcgagtcatgtggttgcttggttcatacgccgttcgatcatcatcgtgtggctctggcaatcatcgatacgggcagtgcaatggaccaatggcagacatactcaacaaggcccaccatggcaagcgaatggttgacgaaagagcacgcaagcaggtgaccaaaaacacaagcagctaataagttgttgctttgtttttgggtgggcgtggtgtatggctcgctctcgctgttgctgtgtacagccagccagtgtttgatgcacatagtgagaatatgtccatgtcgttcccttgtccttgtgtgacaacatttttttttgtttatgggtggattttaatgggtgctttgaagaccacgtctgtagtgggagcactgt

SEQ ID NO: 8997 - DNA, 19123 bp, Oryza sativa
  unsure (1)..(19123): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatattgaaaattttgtttgagtgcacagtgtgtgcattttatgaaactaatgagactaaataattatagcaaaaaattttgacataaattttgaaaataaaaaatgtaataaattaaaaattttatttgaaattttaataggataaatttttatgttcatccaatgggtaaaatggatatttttatagaaattagatggtcaactaacgggaggagcatggaagggatcaaaatcaaattttaggggtatccttggaagtaagcaaaattcaggggtatagaagggattagttaaaatttcaggggtatagaagggattagctaaaattttaaggtatacaagggatttctcttgtaggttggatagtagaaatccaaatttcatggagaacctgctctacaacggttgtcctaccactcttatgccccgcttccacatgtacaatgcaaagagtgagggccctttacatgtagtactgctcattgacaacttgacttggtggaactctaaaaaatttgctcttgtataagagatatggatgcaaaccatcgataattaaaattaattgcttcttttcttgaatgaagcctctgtagcttctctcatgaatccatggcattaaaacgtcggaattaagaaaaactagctaagtagtagtactactattactagcaaccatataatagctttattgagaagcatttataaggtgttgagacttgagcaggtcaagcaagataacaattatacattgacctatcaagtatatattctatatgcaatgcatcttattctaatcaagccttgccgagctattcgagctcgagctcgctaggcttgagagcctcagcctaggctagagcttagcttgtctagtattcgagtcaagctcgaatcaagcctgtaacgaatttgacagccctagacgtatcaaatatatttggagtatgaactatatatgtttttaaaattctggacaaataacttgatctcaattcatgaggcacatgaatatgaaattatgtattctctgcatatttatatcttgttctgtacaatttgaaatattatatagttatttctctacactctaccaaatcctttgatatactcatgtgaaccgtcttcagatggccaccacgcgctaatgccgtctaatctggatggagctgattttcctaatcacaagtccaactgtagcctacagctaccacccaaaaggccattatgtactatcaggaaatttaatatcagacagccaaaagacatactatacttttataatggtctataggaggaaaggacacatatgttcaaacatcacagtcagccaaatattgagaacaaagaccgtatatatgagaagcagttgatgtcacacagatttcacaatggcttgttcataagcttataaatttcataacaaaattgagaacaaagaccgtatatataagaagcagttgatgtcacacagatttcacaatggcttgttcataagcttataaatttcataacaaaattgagaacaaagaccgtatctatgagaaacagttgatgtcacacagatgtcacaatggcttgttcatatgttagtgaatttcatatggaacagcataatagccaacagaaataaacagaggatgagttctataagtagtgagtatcttaaaaacttgttggttgctagtaactacacaaatttctttgattttaggtgtcttgtcaggggaatgagtgcccaccacatcccttaacttacttaacgtcacagaaataaacagaaatcacaaatttctttgattttagctgtcctgccagggggaatgggtgcccaccacgccccttaacttgccagggggaatggctgcccaccacgccccttaacttacttaacgtcacataaaataaataaacagaaatgcttattggtatttcttaatgtcacagataaaatccgtaagcgaacagaaataccgatgtagcactccaccctggagtattcaaggtatcgatttctacagggaacatgtgtgtcagctcttctccaggttcatccaaggacacgaagctaagataagctaagggtggagggaaattcactaagggtagagggaatttactagtgaaagacaagtgtctatagaaagctctatttaatcctaacgtggtatttcaggcgctggccagcccgctgctcccagatatggctctacaatgtacctagtcagggaggactttagtgtacttgagggctatcaccacctttacacccacctcaaacctattgtgggatacaaagcaaacaccggaaattaactacccagacaccatgtctacgcagttaataactattttagtgtttataactcactgaagcaatcactatattttaatggactatagtgaacaatgattccataccttgattaggaactaactgagaggtaactctcatagaataaatcttaattactcaatgatattcgattaaagcagagtatttaacagagtaaaagaaataagaagaggattgccgacaactttggaattcctccgacttctactctcctctctccctaatctagtatacaataaagtacaatagagcctcttgtaattcagctcatgttttggtgtgtgagaatgagggagaagaggggtatttatagtgtggtggtgacttgagagagtggagatgctaaggaatattctccatagaatccaaagggcatcttcgtccttcccttggcaagtgtcccttctgatgacggtttccaccggtattaacgaccaaaaccatcatagaatgaggattacaaccgtcatgctgaagttgggctggattgggccagctgggagttcggaaccctggccggctttgttggcctagcccttcctcctggagtctgatatgtgggccccattgtatgttcttcaaatgattgcatcttattgggtttatgggctcaaaactccattggcttggatatggaagttatattctcatccttcatgtatatttcatctcaactttggtgggttgcatcctgcatacaaatatacaccaacactcgtggaaattgttagaaataaatcttaccactatattgaatatcttatacttttatggtcttatgcagatattgatggcgagaattttgtacttaacaaccgtcaacaccaggctcgccggcctccactttcccctctcccaccggcgcggccggccgccactccctctcaggttcacggcaatgtcgacccgggtctcggtctggatcaacgtcagcagcggcctcgacagcggacgccagcgggggcgacgtcgggaaggggcactggtggcctggggaggagcacagcgaacaagcccggtggaggcggcggctcggatggagagcggaggatggcaccggcggacgtcgatgatagtcagagaggagctggaggtggccggcgacgggcgccgtgccagtggagttgaggcccctggcggcagcggcccgggtggagagcggacgatggcgccggcgaacatcgatgatagtcggagaggtgctggaggtggcctgcattgtgagggaggccgacagcgaacggggcatcgggccttgaggtcgtcgggtggtgaggagagcctcgtcccctggcggtagcacaggcggatggggatgccccgggatctaggcggatgcggcctggagaagactgcgttgggcgggcgacttgggctcggactggccggcggcgggatctcctcgctcaaaggcggcttagagaagctcggggcagtgaagcagcatccgggagatggcggcagagatccatgaggtggcggcgatgaccaagggcgcagcaccgcccaccagatcggcgtagggttttctcacttacatgtggatcctttttctgactaggatgccacgtcagctaaactagaggtttatattgctaggggatctaaattgcacggttttgtatagtttaggggtgaagatttctaatattggggattagggatgtcatacaaacccgatgtaaagttaagggacaactggtgatgcaatctcatgtgcattgtatatattcatccattcgaaatcaagttgagattaaccatacgttttgtttacctaatcgatggtcaatgttatgcttatcaccacctcatggtcaacctctacatcaccatcatttgaagcttgaaattaaagatatatatacataaggattggtaaaaattgtactaaatccttccatccatctaaaaataaattatatcgctaatgtgctagcatattcaaaatgttatttctgaaacatccaacccccctaacatcaaaccttcttcacatcacacatccaaaagataaaatttagaaaaaatagtgggtgagtttatctagttgtggtactacactatagatcagaattaccttgataaaaaagtttcatccaccgatgttaccaattttgaacccctgcattttgaaagcccttgttagttgtagcttcaatcatctgtttcacaaaggttaactttctttatattacaccagaaaatctttaagaattataaagtacttcatccgttaaattataagactttctagcattgcccacattcatatagatgttatgtatgctagaaaatgttataatatgaaacggagggagtagctgacaaaaccaagtaacattagtagatgacaactgcacacttgtatttgccttttggtttcactggccataacctaaataattttcagtggtgcaggaattaggctagacctaaataatatgatttcgtagttgctttcacgaagacagcgcatcagcttcattaatttgtactagaaaaattgtaaaaactgacaaaaacacacaaatccattaatttcacggtattttcccgcttgattaatatgttacaaatttataaaaactgacaaagacaaagacaaataagatacactgcggaacggtcccacctaaaataaaaatttaaaaactaaaaaaacaaaatacaaatatgacaaaaccacttattttgagacatctaaaaataagtgatgaaaagagtatagtttctctctcccctgctcaaagaaaaagtaagacacactgttggacggtcccacctctaacaaaattttaaaaactgtcaaaaacaaaatacaaatgacaaatgacaaaaccacttattttgagaagtttaaaaaactgaaaaaaaattgcaagaattgggcagtgcatcaacacaactcaataaaaacgttccaacagacgtggtgccccaagaatagctcatgcatcccaaggggcagatccatctaactcaaggtgtgtttaattcacgccaaaattggatgtttggttgaaactgaaacgatgtgacggaaaagttggaagtttgtgtgtgtaggaaagttttgatgtgatagaaaagttgaaagtttgaagaaaatttttgaaactaaacacggcgtcaatacaactgaaggatccagaaaaggcagaagtcaaaggcaggccgagggtgaaaacggttgttgacaaagcaaaagataaagggttaatttgatccatgccattgcaactttaccgatttagaaaaatgccactactattcgcgatatcggttgggttccattgcaattttgcaaaattgaaaccgtgccatcgtcgtgacattttccatcccttcagtcttcttgcttcttcctccgtcttctttcttctccttgtgggcaagatgctccagctggtgttccggagcagcaagatccgacgggcgatggcggaggccaaggatggcaagctggcgccggcctccacggcacgccgggcagcgcggcggtgttcgagctcaccgccaagttctgctacggcgtcagcgtcgacggtggggtcaggtgtattttggatgcgtgcgcaaaaaaaaaaaaaaagaaatacgacgctacctgtacatacactatatgatgtgtgaaggtgtgcacgaatcttattgctatcgtgtggatgctagcctaggtgccgcagcacctaggtgctaaaaggacaaaggagaaggcgccatcagccatgtaagaggaagacaagtaataaaggtgatgaaaataaaacttgagcagacgcaaaaaaaaaacattattttttgcgaatataggaaatataaatgtatgccttgttggctctctctaaaaaaattgttcgcacaaagcatgataagctcttaggtaaagcatcagtgctcatcgcactgcggcgtcctgtatctaccggattagagctctaatcgcatttaaaaaatcagaatcatgtggtaaaccggatcttgagagttcagactaacaaatccttatacaccaacagaacaaaaggcttccgcatacagaaacagagttacagattgtcagtaagaaaaaaaactaatctgaacttcacgtatgcatttcccaaacatatctgatgaaacagatctggtgacaaacattaagcatgtcctcataataagaaacatcaatcaaagaaagggaccttgtactgttgttctgaaccattctacttggacaaacagggaacaaccattctactgataaatgaacaaacgggggataatggcaagttagcatttcgacaatagatgacaaattatacctccacgagcagattgacgcccgattgccatcatagctagtaattgctaatccaggattcagagcaccagcggctggattcaacgaactcttggccgcatcactcgccggagagagaaccatggctgcatccatgaactgctccatgggggcttcgctgtcggccgctggaacagccatggctacctcgtgtcctcgtgtacagacttgagagcaggggtggagctacatagagctagggggtgcccaggaatccagttcaaaaaattttttagctatagtttgtctattttcaccatatatatactctgtcagttgaaatttaggcacccgtatcaagctaaatttgattcaaaccagagtaaaacaagcaagtggctccgcccctgcttaagagaagccatccccatcacgccgttgcccatcgggggaactcagctcccttgcggagtcgcggtccgaagcttgcaatgcagagccatccaccggggggcagacttcatggtggagctgtgctggagctacggcgtcgtcgccgattacgctgcttctgcctctcctttctccttgcttgaagcaatgcttgaccgcgtgacacatggcgcggggctgtgttacctgggatgggttgcgtgaaacataatttggtatttgggttgcgtgaagggtgcacaaatcgtgaacaaaatccaacgggccaaaaaaacggccggcaaacaaaaataaatcagcaggcagccagttagcaattcccctatttttttttcttattactacaaaaattgcccgtgcgttgatgaagtctatttaaatcttattagggttatatagtttagttaaggtgaaattcacagtcagaatttgcttggatatactccatccgtcccaaatataagaagtattttagaaaatcatgagctacaattaagagtccgatcatctcaagttaacatgcgagttttttttaaatagattttttatacgactccttctgtatttttaaaaacaaacgaacttaaaaactgactcaaatacggatatgtatttccaaaagcgaacaaacttaattaaaaactgactcatacacatatgacgtaccaaagcaccggtaaaaacacatcttcaatttttataatagtagagaaaagatagagatagatatgagttatgtactagttgagaatacatgatgagatgttttacacatgcttaaacacatacgatgattatacctccagttttaactgataataactaggtaagtttcctcctgttgtaagtgaccatgaccttccccttgggccccggcatgacgacggtccagtccgtctccgggaacggcgacaccagctgcagctcgaagttgcgcagcaggtggctccatatcaccttgatctgcatgtacgcgaacgcctcgcccacgcacgcgtgccgcccgccgccgaacgccgtgtacgccagcccacctgcaccctcctccctcccggcgccgaacctgcccgggtcgaactcgccggggtcccggtacacccgcggcagcgcgttgtggagcagcagcgggctcgccaccgtgtggccctcgggcacctcgtactcgcgctcgccgctgccgccgcgcacgacgaagctccgccgcgcgtggcgcagcagcatcagggccggcgggtggagccgcagggtctccttcacgcagcgctgcagggtgtccatcgccgctagggcggcgtggtcgacgcggtcgccgccgtgccgacggagtagccgcgcctgctcctccacggcggcgcggaggtggtcggggttggtgaggaggcgcgcgccggcccaggtgctggtgctggagctcgtgtgctgcccggcgaagagcgccgcgacgagcatcccggcgacctccgtctccgtcgtggcgcggccgtccttgtacctcgcgtcgatcaggcactgcagcatgtcgtcgtgccgggctccgccgccgccgccgccgccgccggagctgcccctgcgggacctcacgatgtcggagaatatctcgccgagcctggcgcgcgccctgtctcgccggcggtgcgccgggatggggaggcgcgggaacaggatggtgacgaggcgcatgccgtcgttgagctcgcggaggagcgtcgagacctcgtcgaacatcttgtccctgacctcctcccctagtagacaacggctagcgatgagggtgacgagttgttcaaactcttgcttcatgttcacagtgccggactgtccccatcttgcaaagtaaccctgcacaatgcgtatatagacacataccacgttaattaatatcttgggcctgtttggcacagctccagatccacctcttctggagctagagctcagctaaacagtttcagctccacgtaaaatgggagtggagctactcacaaaatgaagtagagatatggagctgggttagataactccacaacttaactccagactcaactcctgaagctaaatttaggaattggagctctaccaaatataccctaactctacgatcaacccttgagattgcatcgaaatttaccacattttgtattataaaatttagtaactccatgtatctcaaggtacttaaactattatggtaaaatttgatgcatataccgctaacttttaaggacggtaaaatttaatatggatataattttaatttattaccgtagtgaatttgcttttattcactaaagcaacatgtcaacactaaatgtgcatgccaaaaactcgtttgcttacctccacttcagcaaccatgagatcaacgtaagtcctcagcttcgccggcttcatgatatcaccaaagaaccggaactgctcgtgtcgagtggcataatccacatcaaaagcgaccccgggaccaaaggttggtatggtgaattgcgagacctcatcctggctgatctctgaatctaaccctttgtaaaaatggcttgacgcctctgacccaaccaagaaagtcaccttctgttggagcaagctaacagtgaaaacgcttcccatcttctcataatggtggcggatgaattccaccgggccattggcgagaagcgatggtaaaacccctacaagaggagctccacgggccaagggtggaggcggtggtctagagaattttgtgccagtggttcttgttctttctcttgttgcaatcttactcaacattgttgcagcgacgaacagttgagccaggaacaaccatatggctcctgttgttaaatccattgttgaaatataatgaagtctgctgacagcaagggacgatgaaagagtgtgttagttctattacaacagcaaaagatagaaatacacaatgatatatcagaatatgtgtatgaaaacgcatagagagaaatatttaatttaagttttagtcatttttctcgcccttgagacgaaaatctaacaactctcatcgcttccatctttcactaatttaaacacaatctttgtttagccaaaaggttaaataataaattgttttaaccaatacataagctaaatttacaatcaataaagatttactaaactaacatataaaattatacgaagtaagataagattaagtaaaacaaatgcatttaaaattgccagtaaaaataaattanagatatttntgggccccctcattaatactcatggttataattcttatgagcaagtttaataatataagctcactgctagttataaacctatattagagacaaaaacaaaatatattagctattaagttatttagtttttcttcctctcgcacacttatacgtctaatgtgtttatcttggagcatgtgtagaattagttcttgcttgagatccaacgtcctttatttttatttttagttatctttatctccatataagcttatggagtagctcactattatccttcctctaaattaagaatgcattggaaatgaaactttgaaaatctttcacgcgacaaataaattacaatgaaaaaggaactgctaattagttaaagcctttcagcatatgtatatctgatctccacctttataagtagtacgttttttgagcaatcaatacgttatatatacgtggtatgtagatccgaacatattgctagaatctaattagcattttctctttactaaaccatctcatacggcaatactaaaggtattatcaatgaaaacatgatatcacttcgactgttatatacatgcaaagaaaattcactctagagagtgaaaaaagtgtatatgtgagagacaaaaaaaaaagaaaagaagaaggaatgtgtgtgtgtcagagagcgagagagggacctttgttttagcagaaaccaagatgcttgttgtggtagtgaggtttttagctcgtgaagatggatgatgcgtggaggcagacgctatctagcaggggtatttatagctgaactttcactcaacatgtgtctaacatatgaaaaacatggcccttttctgattggttgctaacaacatgccagaagggcaaaattgtctgtcgatttcacgaaattaatattgcctgccatgtcatttaatattgcctgctatctattgacatctggatatgacggatcgaacgcgttatcacctggaccatgtgttgttcgttatgctctcgtgtttgcaaagtacgtgtgatcatctggaatagatgtgattattttgacatgggtttgaatttacatttatatatttgttaacaagtgtactatataatttacatgtatttctcaactaatttgtgaatctctttgttgtctactgctcatccatgtcccaaccaaacaagctaaagctaatacaacaattttctcgaactattaaaatatccagatgcatgcactgaaacatttaaaattcataatgcacccatccaattttttgatgcacctcccttgtcgctccttccagtgaagcgacaacgtcatcctcgagcacgccagccttctcgaacgtgagaatagaagaagagccgctgccgcctaaatttgggacctcaagacaaatcattgcatggcgccacctcaacatcatcttccccagtgccagtgaccacgccattgtcgcacgccaccctcagggccctggtttagttcccaactttttcttcaactttcaacttttacatcacatcgtttcaattttaatcaaacttctgtaaaatcaaagtgtttttgattgttattctgttatgaacaatttgcatatgagattattagttttgatatttggaatttatttacgaagtggttttggagatgattgaaatttgcaggtgaataggaactgatgtctgtgatttgggttcggtcagaccgggcagtgtgtgccggtcagaccagtggtgatcgagcgttcagaccggccagcccgcggtctgaccggccgactctgtgttggtttcggttttgggttgtttatttggatatccatgattgtttcatatttatggcttctagatggatactatgcgtatgtaatactgttatttgctactaatgagtcaagttggagatagcttggtctcgaaatatggtttctttgtttgtttcatgtgtaggtgacttgatgcttcgggagagtattgctggtgatggatcgggagtcagcttggggataagacgatgtccgtgacggtcagatattgtgcgggatacttaggctagagttcaatgcacgtggttggtgaagattccatatggcatacgatggaggtattgtgtgcgtatgggatgcggagtcgaatttggaatgagtccaaattttttttgatgtgaaacagcaggagaggctcctactgcgctatattaataatataataataaaaaaggggacaatatttacaaaatttacaaggagtccaaatttggtatgattggagtttgtaaagtttgtttcttgtacgagaaggtttcgtagatggtttaggacttctagtatgagtttggttcgtagctttagactgcctacctcatgtataaatagagagagagtgtgaggcttcccggtatcgcttttgagagcaattgagttgatagtttagttagagtttcgagtttagtcgaaatttttgtaaagagtgctgttgttgcactttgtaaacacagagagaagcaataaagttgtcatctactttgagagttcttcgatttgtgtttcatcgggttcggtggtctaaccgacaacaaaccggcagcatcgcggcggtcagaccggcggcatacctgtggtcaaaccggcaacggcaacaggaggcagaggcgactttggagcggtttggccgggcgatcaactctagtcagaccgacagcttccaggcggtcagaccggcgcatccacttcggtcagaccgcgatccatcgaatttgagggtaacttttaattccgcaaaaagtttgggttttttggcataccaaccattcaccccccctctggttggcttagttcttgtatttcgatcctataagtggtatcagagccttgttttcttctttggattttaaccgatttagagtttttgccatggctaataagtttacaactaagccccatgttttcgatggaacggatttttcttattggtgtagtaaaatgcaatcttatattatggctgaggatcttgatatttggagaaaagtttctaatccttatgtgattcctgaacaaattaatactgctactttaaaaactgaatttgaacaattgcaaagctcccaatattcttttgagtgggatttctcgttcggatgatgatcgtgtttctcatcttcaaaccgccaatgagatttggattgctttgagtaattttcatcaaggaactaccaatattaaagaacttcgtcgggatcttttcaaaaaggagtacattaaatttgggatgaaacctggagaagctttggatgacgatctttctaggtttaacaaaattttgagtgatcttagatctgttgattcttcttatgatgttaattatacacaatctgaggtttctcgctactttttgaatggtcttgacatgcctatttgggagatgaaagttacagctattcaggagtccgttgacatgtctactttgactttggattcgctttacacaaaactcaaaacacatgagatgaatattcttttctcgtaaagttgattctaagtttagtgctttggtttcttcctcgacttttttggatgttggtgctccttcatcgaagtcttctattcttgttttaattaatgccatctccgatgagcaactcgaacagttcgaggaggaggatttggttttggttactaacaaattttctcgagctatgaataatgttaggtacaggaaaagaggtggaccaaatcgttgctttgaatgtggttcgtctgatcaccttcgttcgcattgtcctaagcttgggagagataagaaggaagaaaatggtggtgagaagaccaatgataacaagccgaagagcacattcaaagggaagaagatcaaagagactctcaagaaggcttttgactcaagtctatgctgcttttgagccattaagcgatgtagatggtgaaagtggagatgaagataagggaaagaacatctctggtgtttgcttcatggcacctggtgaatcggattcagagtgtgaagacaatgaggtccgttcttttgaggaagctattcttattttgagtgcaaaaaataagaagtgtgagaagatgtatagaaaataggagtttattattgaatctcttaactttgaagttgctagattaaaatctcttattcccaatgatgatgattgcaaaagttgtgaggttttaatgaatgagatttctaaaattagatatgtcaaagctgcacatgatttgaaaaatagatcttctctagctcttggatttgctttgcacgcacgcactttggatgagttgtttttgactaaaaagttgttgcaaaaatatcaaattgcttttcatgctagtttgatgtttaacatgatttgtgccaaaaagttaaaacaacaacatgatgttttggattgctcaacatgcacactaaacaagatgaaactaaaagatgctttaggtcgtgttgagtaaatggaagatattgtgaaaatcaatgaagtgcttttttccccaaatgtagtaaaagcaaaggtgtcatggtagattgtgaaaattgtgctaattttggtgtgaacaaaacacacccttatgctctcgtgtttgcatcaacgtacgtgtgatcatttgaaatagatgtgattattttgaaatgtgtttgaattaacatttatatatttgttaacaagtgtagtatataatatacaagtgtttgtcaactaatttgtgaatctccttgttgtctactgctcatctatggcccaaccaaaccagctaaagccactgcaacaattttctcgaactattgaaacatccatatgcatgcactgaaacatttaaaattcacaatgcacccatccaattttctaatgcacctcccttgtgcgctcctgccggtggagcgacaacgtcatcctcgagcacgccaaccttctcgaacgtgagaatagaagaagagccgccgccgcctagatctgggacctcaagacaaatcattacatggcgccgcctcaacatcatcttccccagtaccagtgaccatgccattgtcgcgcgccaccctcaccgctagatcctctcccccaactacctccttcactcatgcttcacataaatgaatctaaccatcccaagttacaagctccacagtgacctcgggctcatcccaacgttgtgagatcacctccatgtctgcttgtgctcaccatctaataatggaggagggggagaggagggagtggcagaagagagggagaggggccttgcctcctatgcctgcctgcagtcaccgtatggccatagaagaggggaagatgagggagcgagagaagagagggagagcgagagcaaggtatgaaatgagtggtgagaattgaggagcgcctgatatttctatcttttatcgagcgttcaagcaggagtatttccacaatgttcatcaaagacatcgtaaaaaataacagcttagtattatccaccaccccgagcaccttatcataaaatgaccactctcgaactaatatatcctccacaaaaaatccgactagatcatacccatcgtggccaagtagtgtcttaggctgcgttcgttctggggtgacagggagtttgtttgtttcgttttccgcgcgcacgcttcccaagctattaaacggtgtattttttgcaaaaagtttctataggaaagttgctttaaaaaatcatattaatccatttttgaagtttaaaatagttaatactcaattaatcatgcgctaatggctcacctcgttttgcgtatcttcccaatcttctctatctccttttcctcaaacacagccttacacaccaatgaatacgtcgatctacaaggacatgtcggagccgacgtaggccctcacacgactgcctcaattgatgcaagacaagtcagatactccctccgtttcacaatgtatatgtctaaatacattaacatcaatatgaatgtgagaaatgctagaatgatttacattgtgaaacggaggaaatatatgcttccgttatactccgtggcgtccaccgtaccacatttgcccacgtcaccagccgtccaccgtaacctcgtgccaggacacatgcatgaataggctaccactcggactcattggttggccagctggctaaggcatttaaaacaagaaaggtgcaggtcacctacaaacgaactggtgctgtgctctgctccaatggtctcggccagtgaaagcgagccaatcaaccagaagcaccaccggttcacagctgacacgtgccatgcttgcagcttgcatcacccaagaaaacaagagatggattggattttataatttcttaatgtttcgaaccgtcgaacttttataactttggccactgataattttttttaaaaaataacttaaagtattacaaagtattacgataaaattaaaatattatttatttacgtataaactgcattgacgatacataaacttatttatttatcatgtgggtacaatcgtacgaacttataaaatattaaatatttaggtattgattgtacccatatgattaataaatactccatctgtcctaaaatataacaacttttagctcttaagatttgtcccaaaatataacaacttccccaccaacattctcttcccaaccaatcagaaccctccaccattcaattttcccacctactccactactcaaccaatcgcaatcctacatcatccatttctacctactttcttaataaccgtgtctaactctaaaaataattacattctaggacggaggtcgtaggacactggatggttaatcttgctggtttaggtgtcgatcaggatatacaatgtaaatactccgtcctcctttttacttgatgtttccgatagctttatagaaattaaggaagctgtgaactgacgcttttgcccttcgctgtgatggctgcattccgtcggcgcgaccaataaataatccacgccgccatctctgatgagtccgcgacaacgagaccagcactccccagcggccacgtggagggccagcgacggtagcgccgtgtggagcgatgtcgtagaatcaaatcacaataactaatcaaaccagagagggtgaatggttggtatacccaaaaactgaaaacttttagcggaaataaaagctaccctcgaattcgacggatcgcggtctgaccgaagttgtcctgccggtctgaccgcttgattgccgtcgatctgatcgagattagatctccggtctgaccgccgagatcagttgccgcttgctgtcgccgccgccggactgaccgtctcgccaccaccggtctgaccgccgcttgccgccggtctgaccaccggtatatcgccggttagaccgccgaaacccggtgaaacacaaatcgaagaactcttaaagtagatgacgactttattgattctctctgtgtttactgcaccaacagctctccttacaaaaatttcgactaaactcgaaaccctaactcaaaattcaactcaattgctctcaacagcgataccgggaagcctcacgctccccctctatttatactcgagatagacagcctaaagccacgaaccaaactcatactagaagtcctaaacaccttagtaaaccctatagtacaagaaacaaactttacaaaaccaatcataccaaatttggactccttccaaattcgactccgcatcccatacgcacacaatacctccatcgtatgccatatggaatctccatcaaccacgtgcatcaactctagcctaagtatcccgcatgatctctgaccaccaccgacgtcgtcttatccccaagccgactcccggtccatcaccgcaaatactctcccgagacatcgagtcacctactcatgaaataaacaaagaaaccatattccgagaccaagctatctccaacttgtctcattagtagcaaacaacagaattacatatgtatagtatccatctagaagtcataatcctgaaataatcacggatatctaaacaaacaatcggaaaccgaaaccgacacagagtcggccggtcagaccgcgggctggccggtctgaccgcgcgcataccgccggtctgaccggcacacactacccggtctgaccggtcacatgaaataacagcagtacctgtagattcacctgtaaatccaatcatctccaaaactacttcgtgaattaattccaaataacaaaaccaattatctccgatgccaattgttcatcacagaataataatcaaaaacacctttgattttacaatctcccccttgatgaacacattggcaaacccatcaaaaatgttttagtgtttggaaaaataaaaacaaaagtggtaaaaaatacacttcgtacaaacgtacacatcgtgctaaaaaattcaaaagaaaacttctccccctttttaaaaagagagaaattcccaatttcaccgtctcaacaactcgaaaattttcaccttgcttctccaaaaaactcatctcttcttccccttttgacaatgatttcatcaagcatagaaagtatggtcattaatatataagagcttagcatacatatagt

SEQ ID NO: 8998 - DNA, 664 bp, Oryza sativa
cagcaacatattcagattcagccgttgattgagcaacactagattgtttcctagaagaccatgtaatcaatgatgtaccaagaaaatgaaatgttccactagtacttttcctatcaattctacaaccaccaaaatcagcatcggaatatccacttaagcatatagaagatgaagtagaataccaaattccaaactcaagtgtatgattcaaatacctcattattcacttgaccgcttgacgatgtaaaacacgaggagaagcttgaaaacgcgcacacaaacacacaacaaattgtatatctggcctagaagcagttagatacaataaagatccaatcatacttctatactccttttgatcaacagcttcaccatcttcatcaggatccaacacagctgtagaaccaattggtgttgaaattggcttgcaattctccatcttgaaccgtctgaaaagatccttcgtatacttcgtttgatgcacaaaagtaccttgaggtgtttgctcaatttgcaatcccaaaaagtacaataactcacccatcatgctcatctcaaattccctgcgcatagtctcagcaaactccacaaccaaagcgtgagatgaacaaccaaagatgatatcatccacataaatctgaacaaatagttgattatcaccatg

SEQ ID NO: 8999 - DNA, 1256 bp, Oryza sativa
gcaaatgtgaaactttggattgacgtccaaatcgaagttcataagaagttttgatctcaagaaaaccagatttgaaatatagcatgcagtgttaatcgcctcagcccaaaattttctaggagttttatattcatccaacatcattctagccatctcaacaaaaacacgatttttcctttcaacaacactgttttgttgaggaacacgaggagaagaaaattcatgttcaagacctctttcattgcaaaattgttcaaaagaagcatttttaaactcaccaccattatcacttcgaattcttttcaaagaaccaggaaattcaagattcaatcgaagaaacaaatcacgaaagtgttgaaaagcttcgtccttagttgccataaagaaaacccaagaatattgagaaaaatcgtcaacaataaccaacacataccactttcctccaacagattgcactctagctggaccaacagtgtccatatgtaatagctgtcctggtgcatccgtcatcacagaaacaataggagcatgtgaagaagcaaccatcttagcatgacgacatggtgtacaaaccaaatcaagatctttcttaagtttaggcaaaccacgaacaagatccaaaccacttaacctagtgagatgatcaaaaccaacttttttttagtctacgatgcccaaacatcacatttttatcaaacttagctaccaaacatgttatgaaacaggattatcaaaatcagctttaaacactctttcatagcgagaaatattcaacacagaatcaccacaagaatcaaaaactttacttccaattttcttaaagtgaacctcaaaatcttcatcaacaatttgtgaaactgaaagcaaattatactttaggtccttaaccaaagctacattcttcaattcaaaattttcatttaccttaaccaaacctgtagcaagaacggcacttgtagaagcatcaccaaagataatccattcagtcttggatgcctttcttagggaggagaaccaatttttatcaccggtcatgtgccgcgaacaactggaatccacgatccacacgttctccttccttgccaccaaagcctacacacaagcagaagtcgaagcctcagtactggggttagataataataaaaatttaggaatccagtattgagatacacgaccagaagatccagtaggcatatatccatgtgcaaaaacagtttgagaattttcagaaaaattcctccaaggccggtctgacc

SEQ ID NO: 9000 - DNA, 2865 bp, Oryza sativa
gaggctcttcagtcggtctgaccgcgggacccactgcggtctggccggtttcctcgaggggaaacccgatttttgccactttaattttgcaaaagcaatctctctctcctttttctgtttatgagctaatctgaaacaaaaatcaacaatatgtccatctttgccacaaaaagaacaagtatatttttcacgatgattagacacattggtagaattagaagacttagcaacacaagcaacaataggaggttttgcatgcacaatattggattttgtagaagatgcactcaaggtagacataataccagcagatttaaacacagttttgttagtatcaggtttaaccaaaatctcaccacttatagcaccaacccctaacacaacaggaggatgtctagaattatgaacataatgattaaaacctaaaccacgattatttgtgctaaccttagattgatctaaaatcatgttgaggttctttttaccatcagaaaatctaagcaaagaatttttcaaataagaaacctctttttccaaattagcacaattttcacaatttaccatgacacctttgcttttatgacacttggggcaagaaagcacttcattgtttttcataacattttccatgtactcaacacgacctaaagcatcttttaaattcatcttattcaaattacatgttgagcaatccaaaacatcatgaggttgttttaactttttagcagaaatcatgttgaacatcaaactagcatgaaaagcaatttgatatttttgcaacaactttttagttaaaaacaactcatccaaagtgcgtgtgtgcaaagcaaaactaagagcaagagaatatttatttttcaaatcatgtgcagcattaacctctctaatttttgaaatttcattcattaaaacctcacaacttttgcaatcatcatcattaggaataagagattttaatctagcaatttcagaattaagagattcaatgataaattcctgttttctatacatcttctcatacttcttattttttgcactcaaaatattaatagcttcctcaaaagcacttacctcatcgttctcacactctgaatcagattcaccacatgccatgaagcaaacaccggagatgttctttcccttagcttcatctccactatcaccatctacgtcgcttagtggctcgaacgcggcgcagacttgatcaaaagccttcttgagattctccttgatcttccttcctttatatgtacccttcgacttgttgtcgttggtcttctcaccatctttgtcttctcttttgcctctcccaagcttaggacaatgcgaatgaagatgatcaaatgaaccacattcaaagcaacgatttggaccacctcttttcctgttcctggcattattcatagctcgagcaattctgttagcaaccaaagccaaatcctcctcctcgatctgttcgagttgatcatcgaatgtggcattaaaaatagcaagaaaagaagacttagatgaagaagcatcaacatccaaagaagaagaagaagaaaccaaagcactcgacttagaatcaactttacgagaaagaacgttcatctcatgtgttttcaattttgtgtaaagcgaatccaaagtcaaagtagacatgttaacagacttctgagtagatgtaactttcatctcccaaatagacatatcaagaccattcaaaaagtggcgagaaatctcagattgtggataattagcatcataagaagaatcaacagatctaagatcactcaaaattttattaaacctagaaagatagtcatccaaggcttctccaggtttcatctcaaatttaatgtactcctttttgaaaagatctcgacgtagttatttaatgttatttgtaccttgatgaaaattactcaaagaattccaaatctcatgcgcagtttgaagatgagcaacacgatcataatccgaacgagaaatctcactcaaaagaatattacgagctttgcaattttgttcaaactcagtttttgcagcaacagtattaataacttcaggaatcacataaggatgataaacttttctccaaatatcataatcttcagccataatgtaagattgcatcctactacaccaatgagaaaaatccgttccatcgaaaacatgaggcttagttgaaaacctagcaggagtagccatggcaaaaactctagatcgataaaagtccaaagaagaaaacaaggctctgataccacttgtaggatcgaatcacaataactaagccaaccagaggggggtgaatggttggtatacccaaaaactgaaaacttttagcggaaataaaagttaccttcgaatttgacggatcgcggtctgaccgaagttgtcctgccggtctgaccgcctggttgccgtcggtctgacagagattagatctccggtctgaccgccgagatcagctgccgcttgctgtcaccgctgccggtctgaccgcctcgccaccgccggtctgaccgccgcttgccgccggtctgaccaccagtatatcgccggttagaccgccgaaacccggtgaaatacaaaatgaagaactcttaaagtggatgatgactttattgattctctccgtgtttacaaagtgcaccaacagcactccttacaaaaaaatttgactaaactcgaaaccctaactcaaaactcaactcaattgctctcaaaagcgataccatgaagcctcacgctccccctctatttatacccgagataggcagcctaacgccacgaaccaaactcatactagaagtcctaaacaccttaggaaaccctctagtataagaaacaaactttacaaaaccaatcataccaaatttg

SEQ ID NO: 9001 - DNA, 6118 bp, Oryza sativa
ggtcacatgaaataacaccagtacctgtagattcacctgtaaatccaatcatctccaaaaccacttcgtgaataaatttcaaataacaaatccaataatctccgatgccaattgttcatcacagaataataatcaaaaacacctttgattttacagatgtggccatggagcagggcggcggcggttgcggatagtcatcggagttcccctgtcacatcgagtgagtccgtcgacatccccggcagccacgcatcgggccgtcgatggcagctacagccacgcagaggaccgccttgagcacttctccgccacagccccaagcaatccggcgcgtatttgttttgtctagcaacgaggtttgtctttactgtcccgtgtgtggcacggggcttcctaatgggcgcgggcgcagccgcacacgcccctatcacgcctctccttagggctaataacgctaattagcagtgatgatgttaattagcggtgatgataattgttagtattagtttttttaaaaaataatacataaatagaacttttaacttagatttagaaaactttcaaccagatttaaaaacttctgactcagatttgaaaactttcaactcagatttaaaaactttcgactcagatttgaaaacattcaaattaagattttttaaaaacttttaactcagatttgaaaattttcaattcaagatttgaatattttcaactcagatttaaaaactttcatctgaaaattcaaaacatttaactcaattttgaaaactttttctcaaaattcaaaaattcaactcaaattgaaaactttcaactaaagttgaagacgaaagattcaacttctaaaataaaaaaatcatgaaaaaaagcaaaaagaaacaaaaaacgcggacgttagcttttccggaaaaaataaaatacggacgtgacttcatccgcacgcatacgcgccagcgccgtgggccttatgggcctaaaatgcacgccgccaacgcgcgcgcgaattagctatcgcgttgtggcaccgtattaatgcagagaattgaatcttggtctgtgtgaattttgaatctcagtattgttcctgaaaacaatcttcatctgtatgagtacttcactagaaattgcaatcttggagtagtttccactggaaaattgcaatctccgtattgttcctgaaaatgatattggtttgactcttaaccaggtctgtgaattctgcgatgatcaaactgggactaaattcagagagaatttggtcaagctcaaaccaaattcagagataagtatagaccaaattatgagagaaatttagaccaaatccagcactatactaccatgtggacatgtggatgattacacatagcatctcttcaataatttggtgttattttttcatgcaacatgattgatggcctctgcatcttttcttcagacactttggcagttctactgcatgtacatgcattttttctttaattaactctaaaactgcaaccaccagatgacaataaattaattaaccacagtgaggagaggaccaacatgaatttagtgcttgcattgacattatctaaaagaagcagaagctaatggagtacaggtttagatcagagtaatcacttaaattcagtgctctgcatatgcagcagatgaatactcacaattcacaagaaacctggaagaactcagtatcctttattgcggcacatttatatcttgttaactttacaagagtattgatgttaactttaaaagaaattgcagactaacgttacaaacaattctgtcaagctagcttgcagatcagaacactctcaaaacaaacatgctacacataggtacagtgaacatgccacacatgtggagtcaagcattttgtcaaaacttgttgtcgcatatacagtgaacaaaattcaactgtgaagaaaatgattcatcaggatctttggcttggatgaatgcagcagattgtggtctgatgctgcatgcaaagttcatggacagttcagttctgtttcaattcaccattgcacatccgcaacgaattgcaggcatatgcaggaccagctgatctgcaatggttggagacacctagtctagtaaacagatcctgatatgttaaccatgaacattttttttaaaggaatattaaccatgaacattaggccaatgtcaaatcgtcattcatggttcctagataaatttcagcagggtcgatttacatcttgcccaaacgattgagcaaatcagacaacagtaggttgggattattgtgacctcgtagcactgaaaattgcagttgcagttatccaggtgacccaaaatgaactgctatcagaaattaagaacaagttcctggaaaaagaagagaaaaaatcgtctgaaaaggatttgggggaagttgacaatttatcgacgaacaataacaaagaacataaaccacgccagggcaccaggagcatatcttcttctccttgttggttgagcatatttctatccatgcatgtgataatgatcggctgagttgtgataagataggattagattttatctctttctgttacatccgttgtcgctgctgttttcctcctgagatggcgtggttgttgctgatctcgtaggcttctgtaaacgccacggtgagggcttttctgccaaattctttcacatggtatcagagcctgatccaatctaatctagcgacgttacttgatggcgtcgtcctcctccactaccagtagtgctaatcctctccagggaagttcggtgagtgagaagcttgggaaaaccaaccatgcactatggaacgtgcaggtttgtgctgcaattcgcggcgcgcatctacagggacacctgactggcgcagcggagaagccagacgctgagatcactgtcacagctgacggcaagacggagaagaaggcgaatccggcgtttgaagattgggaagccgtggattagcaggtcctaggcttccttctcgcatctctatcaagggatgtgctcatgcaagtcgcaacgtgcacaacggctgctgaagcatggacaacgattgagcaaatgtactccacccacactagagcgcgagccatcaacactcgctttgcggtcaccaataccaagaagggaaatatgtcccttgctgagttcttcggcgagatgaaatcgctcggtgacgagatggcagctagcaccgggtgaccggttgaagaagaggacatgatcatgcacatcattgcctgaagtctatctgccgtgattttggtgatgaatttgagaatggaattctacaaagctataggcatgtaatcattgggacatgattaaaccattcatttctacaaagctagtgttgagaggatgtccagtccctctaccgatgtgattaaactttgtaagttaataagcgtcctatgtccatctgaactgtccattctatttttgtattagtgtaaaaggctagagatttttaatcatgtgatgtaactagtcttccatcatgtagacccccgtttttataacaggaatcaatcgtgtaaacagtaccatttccctggatcaagtagtctggtatacacgagttcatagctgaaatatcaaatgcacatacacgagagtctagtgcgaattattacatcataagcctgcaggcgtagtcttaaatcatcggactgtgcggtccggaatacattccaaaagcagaaatagataaagcagcggaattaaggcagcggcatgccattgccacaggcaacgaccgtaactaagacctattgagcgccattgtcttcatcaccctcctggtaataggcatagggatcctccgaagctttatctccggcctctgattaagtttatatttgcaagggtgagtaccaaccgtactcagcaagccaccacatcaacaatgcatatgacaagggtatttcaaaggatggctatggttgttttgcgcaaagcaagtttttgtaattcttttcataagcctaagacctagtattgactgatcaaattttagtaccaatgtttacatttaaacaacgacggttctgtccaccatccattgtgatcccaaggatagcttcccgccattgagtcgtcatagttttctgagaacgtccaccttccctcctctctggaagtggctccaacagcataaaaatcatcatgcaataacccatcccacacaagttaagaatttagagtctagccaagtgtaatacatgtcccggtgctcaataaccgcgagcacggctattcgaatagatttgttttactcacactgcagtggatgtacactttacccacactccgcgactgcccaacacatgagccttatcccaacacatgagacgtgtcacggcaaagcttttcgataacctcgcattggcagtacccgctccatgaacttttcatcctcatgcactctaggcgtacacggtttctagcagtgagaggacttctggcgcacccgggaagggaagactcacacaaatgcattaagttataattatgtttaaattatcacatggcagtcctaccaatggcgacaccactatagagcccctgccttacacatcaagaagccactatgcatggatactgcctccgctcagctatttactccgctaggtctatccccatacgagaagtgtggttgtacggggtcgtttcatgcttaacttcatggctcggtccttaattgaccggggacgatactagtctttcccagataccacccaaatccaccgtccgccccagtctaaaatatgtatttaatttcattcctacttcctcaaatcatgtcattattatcatggcaatgtggagctcatgtctccacatgccgcatctcaattatcttcccaaagataattgccccaagcatatagcatttgataaaatatgagtatgcataaatctagagtagcatttctaagcaagtgtcataattgactaagtactcatacgtatttatggttacaaagatttaaaagtaaacaatattcaaggcatggcataatcacaagtagaatgttcatcattgcatgcaatcttatttgtaaacaaaataatttcgcaattgggatcaatatgttcaaagaatagtgatgacttgccttgctcaaagtcttgcgggtcttgaccttcgcttggatccgcaactccctcgggctctataattacgtgcgaaggaacaatttgaattctattagaattcaaataaaatccaaataattcacacaaaagtcgaacgcgaatcaatctttctaaattgacaacaaagtttgcggaaccactttattcgaattgttgggtcatttaacctaaattaattatttcctagggtctcaacataattatttatttcctaattaaatctaaattcctaccgcgaatcgacctcttattgagattaccggaaataatctataatcatatcaacgttttacgattctaggttataattaacctataattaaattctaattactctaaattttctaaacttcttaatctccctaatttatttcccctttctctttcttttcctctcattccttttctttccttctttttctctcttttctctccttttctctctttttctctctttttctctcttttctctccttttctctctttttctctcttttctctctttttctttctttcttcctcctctccctaccggcttctccctttctctctctctctcgcctttttgcccacccggccgacgcgcccgtgaacgcgagggggggaaaagacggctcaccggcggcggcagcggcagcggcgcaaggcggtgacgctcggcaccacacccggcacggcgcggcggcttcaaggcgacggcgcggcgcacgaaggcgccggcacggcggcatgacgacggcggcgcgtggagaaggagaagaggggggagaaaatgaaggggatgggtgtggggtggagaaaaggaggggccgggttttataagggcatgggggaggggcgggcggcctcgtggcaacgcgacgggcggcgcggctgaaggaaatggccacgggcggacggcgcggcgcggggctcggcgcggctcggcacggggctcggcgcgacggtgacg

SEQ ID NO: 9002 - DNA, 12668 bp, Oryza sativa
ataatctatggaaataattaattaaaatatatcttccaaacgggacctaacttaaattaaacttgtctattcagccattaattaaggtcgccaaatactccaatcatgggtgcagatccctggagttggtgccaaattcaccgggtggatttcaacagatctgaaccattagtttctttctaggagctagaaatagccacgtcaccttcttttttgcctaatcctatgtacgaggactgaagcataccaaaattttttaccaatctcttgatatgacattaagacattgtatagaagcatcagaatgagtacaaaatttccttcacgcggttcataatgattaatcatggcgttttgatttgctatgcccgtgccgatgtgctatatacttaaagttaaatggcataacaaatgtaacatgcatgtccgatgttttcaatcaactagcggtaatattacaatatccattccctaggaaatatatatctaactactcatattattcgatctgctcctgatgtgtgttatattccagaaaaaaaaagtaattatttgggatgtggtgtccactcgtgtagatggggagaagtaacttgcttaatcttatccgttgaaatcaaacaattgcttggatcacctgaaatacatcgggtggatttggaacgtactccaggggatctgcacccctccaatcatatcacgacaaattaggtgaatggagcagactcaacgacgtgatgctttcaatctttggttcttcctttctgttttgacagcggtgcatttttcttatctaccaaggtcctatctgtaaaaaaggcgatcccaggtatttctcaccaatggacttccaggtttgttggtggatgatattttaagaaataaacaattaaaaatcaaatttaacaaaacaacatatatttggagaaaatatcacattactacccccaccgttaaaaaaattacactcacagttcaacaacttaacgggtgggtgagatgtagtacatggacttaaaaattcttagcacagtaagtgtgtagtataataacttgacaattcagtattttttttcaagcaacttagctaagtatgtgatgttttggttaacgattgctaggtgacttcttttcacgatgtcaatatatatgccatcacatagcagttctacggatattaccttatagtattaaatttaatctttaagaattacattgcacattcaatttgcactactagtttggattttttttctctgacttctcaaatgtagacaaaaatataatattttatacatagtaaagtttaatcaacttttagttatcagaacaaaaattgaaatatacttacacaaatctgcgctagtatattgtcaaaataagtacttaaaaattgaatatgtataaaaaaatactcgaagaattaaattgtcgcatcacttcttaacatagggtgtgtttggtttatggcgaaggaggctagggctgagatgggaaacacaccagtgagaaaaaaaaaagaaaggatgggaaatgagaggaattgagagatggaagaggtgaacgtatgctctttttatttatcacgtgtgtcgcctgtcgcagggccagttcatccgaccgattcaatcggatgcaaaccatcccgcttctatagagaatattctctatgtggtgaccatatcccactcccacccttcaaccaaacacgtctaaaaaataggcgaccatatcctatccagacaaatcctattgtataaaaattagcacccaccttacgaatcattatactcatacactcacttataaagtttttacacttaaattgcaccttcagttgtccaaatgggacgggcccaaccatgtcggcctagacaggaaggaactgtggggactacctatgcatttatcgacaaatttttcctcaaaaatttgacagatgtaattatagtacaatcgtagtgtaattacactgtaacttacatataactacactgtaacttatatgtaagtttcacataattttgaatcgttagatctattacaagatttgttttggtgaggaagaaaacaaatcatagcacacacatgtgaaagaatttgttcccatgaccttcattttaccgaaataacatgttacggagagatttttgaaagttacatacaagttaaactatagttgcagtataattacatgtaagttacagtgtaattacactgcgattgtactgtaattacatctgtcaaatttttgagggaaaatttgtcgacaaatatatagcaaaatcggaacggtgggagcccatggcccggccgggccgtgccgtggttgggcctccaccccggcacggcgtggtagcacggcacagcaaagctgcacctgcgcagcgcagccttcctctcagccctgacgccgggagtagccacgaccgccgccagtgaacctagtagttttagtccgttgggatgaagtaggcagcacggcagcaacctcgtttttgtgggccaaacgtgccacttctagccccatgggccaatttttgcccggcccggcccggcccagcacagcatggcctgccaaagaattgggccatgcttgggctcttagctcagcacgtgggctggcactgcacgcccgttggaataagttcactttaggtccttctatttgtcgcccagtcctatttttgtcccttagaccgcaaaaccgggtataacccgtccccaacttatgaacaccgggtaaacgtggtccctcggtggttttgaatgcggttttggctgacgtggtgcctacgtggcttgtttgactaggtctccgtcccacgtggtattgatgtggcgcttacgtggcaattatatctcggaaaaataataaaaagcgtggccccacatgttagctgaaaaaaaaataattttaaaatggtggggcccaccacatgtcagcctcactcctctcttattccctctcccttctctctcttctttcctttcccctttctctctctccttgccgggcagcagacggcgcgggtcggcggcggagcaacgcgagctccggcgacggcggcgggcgtggtcggtgccccaccccccgagcggagtgccgccagtctgcgtgaagacgagcagcgcggcggcgccctggaagatggcgatgaggacgacgaggagtgggagagccgagagggggaagggaacgacgaggaggacttccttgttgggtccgcctggggcgccgccgcgatggcggtggcagccgtcgcgccgccaccttcttctctggcgtagtgctcgctgctggggaggccccccggaatccgacgccgccatctgtgtcgccgccgccgaccacccggacgccctcctctcgccgccgctccctcctctctcgccgccggcgccgccgcgcgccgctccctcctgtcccgccgccgcacgctgctccctcttctcccgctggcggccatcggggagaagggcgacggatggctaggcgagcggcgcaagagagagatagccgtcgccgccccacgcgcctcgcgcgccgtcgcccaccgccggtgatgcgctgtccgtcgctatgccgcccgccgctgccacgctgtccgccgccgcccgctgtgctggacgccgcccggcgagaggaggaagcagagagatggggagaggcggagagaggaggaagaagaggattggatttggtcattttgagaatgacatttggggtccacgtgggcctcaccattttttttttagctaacatgtgagacgcaccattttaaaattatttttggtgtgcagctgacatgtgggatgacgatttttattatttttccgagatatattaccacatcaacgccacatcaataccccgtgggatggagaactagtcaaacaagccatgtaagcgtcacgttagccaaaaccgccttcaaaaccgccaagggacctcgtttgcctggttttcggaagttgggggacgggtcgtacccggttttgtagtcaagggacgaaaatcggactggacgacaaatagagagacccaaagtgaacttattccacgcccgtttcattgggatttaagtgcactttaggtccctcgtcttaacgttgagtttgaatttcgacctcgaacaaccatactagaaatatcgcgtctatcaacttgcaaatctggtgtacccaacctccaaatcaatatactatctggttttttttttacgtgactagtgggccccacatatcaggcctatttcttcttcctccaacctcccctctctcttcatctccgattccccatctcccgaactactactccattgctactgcctgttcctcccagtcagcggaagtgtactagtggatattacatttgcgagttccttaggatcaataggagataatgtatggtttatggagctgtaagtacaaatcatcaatacgttaattaaattaattgctaacaatattcattgctatgattgtgatgcaccttccaaaatttctcaagagtgaaagggagctggatgatgaagccattcagaacatacaacgagacatgtggtatttcatacaccatgaggcaaacttgttgtcaccagcttgggagaaattttttatataaaggagagtctttgaacttcccaaaaaacgagtgtcttactaactgcagtaagagtataatttcaatttcacatacgcgtcatcggtcgagctataagacattgaagtactcggatatgatcgtccaatatctatgaacatataagtgcttcacaattatgtgggttaattaattaataccttccattaattatcgtgtcttgatttatatattgcgcatgtatattaattgcaagcaataataagaaaacatttatcatcgattgctcgatcgataaatatatcctctaagtgtgattcccaaatatgcgaacaaactaaatagattatcaaattttgcaaaaaaaaaaaaatcttcgcaggcgggtcctgtatcatctaagcaactggcgaagtgcatttttactagcgggccatgtagcttaagtgcgctagcgaaggtcattttcgctggtggtcgttataaagcagccgccaacaataacggtctttgctggcggctgcattatgatgcccgcctgcgaaaatgcatcttatgctcgcggtctgttgtcaccagcgaagatgacgcatcttcactgccctttgatctctgacgaagcagtagaccgccagcaaaaaatctgttttggccgccataaaaaatgtttttcatagtagcagtgtagggagcatggtgtggcgcgatgcagctctaagggtgcgtttggttcccgatcaaggttggatgggatatggcggtccatattttgctggatatgacgatccagttttttatttggtggagtggatatggcgatccagttttttgtttggttataaggaagaagatggatttggtgatctttttttttatggttggaggagtaggatggatgagtggttgcaatcaccctttcattagaggtggtgagtatacccccttgaaattcacctaacccaaaaaatatatcaatcactacaaacaaaaaatatctaaataaaataaaaaatcagaaagaaatagaaggagaatggagaagaaggaaaaaaagaaaattggtcctcttcgccgaccgctgtcgcgcctactctcccacccgccggccgccaccgcacctcctctcccgccgcctcctccaggtccagtcgtcatccctagctatcccactcctgcccacaaactaaacacccataaaaaatgggcctccatgtgttctatccacccaaaaccctccatccaaacacacagtgagtgcaatgatcgtgcgtatcataatatgcgcacgcgatgatcgcgcgcgtcataatatgggcacggaacagcacaatgtaggcaacagatatatgatttcgtcaagcctgggaccaagatttattatgaaaaggagaaatatttaaattgaaattttataactgcatatttctccatttcatattatacgtccataatatttccctgcttcatatcataagatttttggcttttttttttctagtcaagcttccttaaatttgatcaaatttatagaaaatatgatagtattttagcacaaaacaaacatattatcaaaatatattcaatgatagattaatgaaactaatttaatatttatatgttactaaatttttctataaaattggtcaaacataaataataaattttgacaaaaaaaagtcaaacgagttatataatatgaacctgggaggttactatttatcaagtattcccatacatgtatatatagtcatcgtcaccaaagagaaaaggatttaaacattttaaagaaagacatatatgcaagattaagaactgaacaacaactaaaaaatgtacaaagtatatatataactacatatctgcctggtaaaaattacagtacacgaagaaaatgtaatgcaaaaaatacaaatcaacattataaacattaaaggaatcaatctctcaagaattcatccatctcctcgatggaaggcatgacgtccaggaaaccgccgtcgtcgacgttccgccttagccaccgtctcggcgccggcggcggcacgacgtggcgatgatggcctgttcgccgccgccggcttccctcctcctccggcgaggccgtcgccgccgtggagtccttcccggtgaggctctgcacgacggacttgaactccgcggcgtcggcctcgacgaacctggtcacgatgtacttcaccgtcatgggcttcacctcctccattctcaaactaggattagctagcaacacttaatttgcaacagatgaaatgctactaatccgaacgtacgttcttaactctcacttcatccctgacttatatagagctggcttactctttcccggtcagatttgtggttggtgcatgcatgtacagagagagagagacagtgacagagggagataattttgactttgtgacgataaagtagaagactgggcaaggacgcagtcatgttcatgtatgctgagctcggtcagggatagggattgggtgcagaccaaagatcaaccccctagtccatgctgcaaaagtatcataaatggcttagcacaatttgacttgaacagcagtacaagtggtcgattggaccttttcctctcacttttgggatttgaccatgttgagagaaaggtattacctgtgttcttatattttatatatgtatgatgatgattgtcaactgtaaagaaatttgatattgaaacagttttcaaagtacctttttatataatttctttcaaattaaatatatatatagtgttgtcaacttttggacataagaccatacatcttattttaaaaactatgtaaatattatttagtttgttctgacttattttactagtcaaggtactttaatttaaggataaattatacttctacttatctgtattaaaatttcgaattagatgaattgtcaaactttatgtcctaaagacaacagtgtcatttatttaaaattgaagtataatcataataactagtaaattaaatctacagtattatggaattaccttttgagcccggtgtgtacacgtagattttgatccattccataaaaatagttcaaaagatcaatatagttaatttgatgcatcatcaaaactatagtccaaatcaaaattttcgtaacttgtttttgtaaatatattagtactatgacattacgattatatttttatgacaacactaggaacatatttcttgatgtataggcaaactttaagcatatcgattatatattcttgaatattaagtttaataacacatgaaaatggtatgagccatagaaactaaactgttgtaaaattaatttactatcattcataatccgaagctctagtcgtcgttttttatgcatcaccactactacttttgatgcttgtatatatgatagatataataatttggatgtagtatggtttaattcggtcaaaaatctatatagatcgttatttgtgacgtcactttctttaaatatgattaatctcctagctcgtgttgacttttgtaatcttgtgttttgactggagatgttatatatgcagcgccgtttacgacagtgcgactcgacgccgttcatgcatggacaattcttgcatgcgaagcagcgaaagcctttcttgcatactcctacggaaaaagtacaccaaagatctctcaacttgtcatcgaattacaaaatcgtctcccccaaccgtaaaaaccaaatatataacatcccttaacttacaaaactgtttgttttacatctttcgatggttttgaccattgttttgtccgacgtgacggacgagccatcgtaggacccacatgagccctaaatgttaggacgccacgtcatcaggctctctctttcccctcctctcccttcctcctctctccctctctcgaaaacgctttgcatctgccgtccgacggaacgaaaagtatcggacgcttccgtcctaccgcgccacgcagtcaacgctgaaacatatcggcgtccatccatccaaacttatccatccatgtaataattcctctctcctctagccttctcgtattctcctttttctctttgcttcaactaccaacgctgcgccacttttctcaaataaagatgctattagatggcaggatgaggagctagatggagtaagagtcaggccgggcatggatgccaggggagtcgcgagagatggcgacgcatcgccgacggccacaccgcagcatcggcggccgggcaaggcggcgcggggtagggaggaggtgctggatcttggcggcggccacacggcagtggcagaggtggcatggcaggggcatagggtgatgtgggatagggtggaggtggtggacctcgccgctggctgcgacggcggctaggcacagcgacgtgggatggggaggaggtgttggatctaggtgctgatgcggctagcctaggccctggccggagtccgcctacctcgcgctgtcacctccctccgccgcattggtggttgtggtggccggagtagaagaagaagatagaggtcggttcattttgccagagtttttagcgaggttgcaccatattatttttcctgttgcactttattgcattaaagcgtttcattttattttgattcgatgttgcatgtattgattcttcgtgtttgccattggtatgtgtttgaatattgtatttgcccttgtcctcgtctaacaccatcaccttatttgtctctcccatgccgatcgcttgtttccggtggccggattagaagaagatagaggtaggttttgtttgagaattttttggtaatgttgcagcttatttattattttttttactttattgtattaaggtgtttcattttgttttgactggatgttgcatgaattgatttcttggtattgcaatcagtattgttgaatgttgcatttggttgaaacaattttgctcaagcgtttgaaacatttttctctgatagtgaaacatctgaaacattttcattgaaacaatttttaccgagcggtgaaacatgtgaaacattcttcaataatacggtgcaacaccgtccgatctgtagcagcctcctctttcactcactcatctccctctgggcaggccggccggcgaggggtagatgttgtgtgctgggcgtggcgacagtgctgcacggacccacggttgaccgctgcttccaccctcgccactggaccatgctccgggagaacgcccccacagcatccacccctcgccgccgcttccgcaacgtctgcactagcaaatccgtagaggtagacctccccgagctcgatggacactacgtcttcgtccccaaaggcgagggcctcctcctcctcgtcgacaagcgcacgtccgtcgtccgcctgctcaacccgctcacgcgcgcgccacctcgcggagctcccgccgctcatcccgttgcttgaccacggcaccagcaatggtatcttgattctgatggtaataatctccggtaggacacttacatggatatattcatgggtttaagtgccggcctcgccgacgacgctacaatcgccttgcatgccttcaagcccaagatcatgctcggcgtcggccgttgccaagctgcgcgacgaacgatggacgttgccccataagggcaaatcgttcatgtcaaccatatcattcgatggctgcttctactgcgccacaagccgagctgtcttggtagtggagaccggggctgacaaagaagaaaaccacggaccggcgccgtggctggtggtggcagctcccggcgacctcctccccaccacctcaccggccttctccgcccgacgccgcctcaccggcttcgcgccgtgctgctccacatcgccatcgtcccactccgcccgccgccgtgctcgatctccccgtgctcccgccgccgcctcccttcccttctcttgtgtcgccgccgctgcatcaccggctagccatcggacctcctcgtccagacgacctcccccccaatgccggccgacctgcctaaggggagatgagtgagagagagagagaggaggaagggagaggagaggaaagagatagcctaatgacgtggcgttctgacatgtgggcccatgtgggtcccacgttgactcaccgtcacgtcggacaaactgggccaaaaccacccaagcatgtaaaacgaatggttttgtaagttaagagatggtatatatatgattttatggttggggcatgattttgtaattcgatgacaagttgaggtaccgaaggtgtattttttcctactcctatttgtgttcatacttcggagttcaactcgtcatatggcctccccgcaccggaatatgggcttgatgccgattgggctagcatatggaatatactcccgacagattattgggctgggtatcaaattttacatcctagcactctccacaggaacccaatttccaaaggggcaattgagttattgccctacttcgatatccaaaattgattttgcccatgttttttattttttcgattttacccctaattttttgaaatgaaacagtcgtttgcccatgttccgttaattcttactaaccgtgttaaatgtaggggtaaaaagacaagtatatccttagatattttcctgtacttttgacataatcaaaatacaaatctatttgatgccatactatagcagtaaatttatcaaaattttgtgaaagtttgccaaaatttggaacaaatttgaaagtggtgtacaaaagtaccggaaattatccaagggtatacttgtcctttttaccccacatttaacaccattagcaagaattaatggaatatgggcaaacggctattgcgtttaaaaaagtagggggaaaaacgaaaaccctaaaaaggcaaaatcaatattggacctcgaagtaggggccagaatgaaattgccccatttctaaaaggctattttaaatcggaaaaggtctgatcattcctcaaaaataaactgtgtatagagcgtctcacaactatcaaaaccaaatcaagtccctcggttgttttagcggtgattttctcctacgtggcatctacattgatctattttttatttgatgcaacacttatgtgtgattaccgctaaaaatgtgatgggatctatatgtcagtgcaaaaaaaactcaaaataatctgtcacacaaatgttagccacatgtaaaaattatttttttttaaaaaaaatctctattccctctccctcctccttggtcctcccctctccattcttgccccgtccacagtgcaccaacaacaccactgtgcgagaccgcgcgccccagcgagtctacctctgtgtgggaccaatacgacctcagcatcgcgccagcaccattctacgctacaagattgtcatgcgtgtaactaatgcggttgcgtctgcttacacccccttactctttttgtgcgagttcggcatgcccagctctgctcgaataactttttcttcctagatgcccagttcgccttcatgtaacccaatgcgtcagcctccttctaccgccggccccgaccggggtaccaaggagagaggtagagatactttttttctcatgtgagtgatatgggttccataaattcattcaatttttacgatataattaccactcacgtgtgggtctttttttattttcttatttttctcaatgacaataaatacatgtaagcgctacgtcagacgaaaactaggtcaacttctcacatagataccatgtagaatgaaaccgtcaaacgactggatttacacttgtgttttgatagtttgtgggcgctatatacacgtaggggtgggcatatttagaccgaaccgaaaaaccaaaccgaaaagaccgataccgaaaagaccgagaccgagaaattcggttatgctattcggtcccagccctcaaaagaccgaatttatttcggtcattacggttattaggctcgatcggttaacacgaatctaaaccggaaatgaccgaaatttaggcccaatagaccttcgaagcccaataagcccactaaaataaaccctaaaagtgatactagccctactactagtgca

SEQ ID NO: 9003 - DNA, 25966 bp, Oryza sativa
  unsure (1)..(25966): unsure at all n locations
cacaataagcccactaaaataaaccctagaagtgatactagccctactactagtgcagcctcctcctccagcccccaccacgccgccgcctcctcctccagcccccaccgcgccgccgccgccggctccaccctccaccgcgccgccgccgcctccaccctcccatgcgcgcggcccgcctccgccctccaccgcgcggtcgccgccgccgtcctccaccgcacgaccggcgccgccgtcctccaccgcgccgcggccgatgccgccgtcctcgactgtgcggcggcagccgccgtcctccaccgcgcggcggccgacaccgtcctccaccgcaccgcggccggcgccgtcctccaccgcgccgtggccgacgccgacgccgccgtcctccactgcgccatggccgctttttcgttccaaactctcctcaaaaatttcggtcagaccgagaccgagaccgaatttgccggtcctgagtttttttggatgaaattcggtctgagtttgcgaagaccgaactgaccaaaaaaccgaagaccgagaccgaatttttcggtctgaccaaacgcccacccctatatacacggatttacggtgagaaacacgcataaaaacatggactttttcattttaaatgcatttctaaaaagataagtatatgacgttattcaattatcataatagtactttttaattaattttctatgaaaaattaaacttaaaagcagtttacataacaaatcctccaacttctaaactagacctcttaattaattagcaggccccttatccatagtggtaacacatacaaaatgtgaagaatatgggtaccaggtatctacatggcctgtctaaacaactagggataggaggtggaccatatccatatactatgtaataaagtcctcaattgccatgttgccttatatcacacggcaaggtatagatactggctaaataataccttgaaacagaagtcgaagtcgtatctaaataggttttccatttttataaccgccaatctatgtaaggtgggcaggtgggcagggagccccttaagggcaacccagacataacattcagaaactggcagatacaatccaacaaacatgagtagggctaaaccttgagagggccaaaacctatataaatctttatttcctgcatccatccacttttagatcccgtacactatctcctttattattaccaataaaaacactggcacaaaacggtattgttaaaaaactgtcacatgttttttgggcaaaaaaactttcaaatgtaactgtagtatagttgtagtataactacaatgtaattacactatagttacattgtaactacagtgtaattgcactgtaactatattgtaatctctatataatttagatataaagttgcatatattattttaatacttacatacaagatattatagttatagtttaattatattacaattatattatagttagatttgaaagttttccttaaaaacttacagcagttttttagatagtcccacacaaaattccaataatcattatactggagtagaaatgtacctactcctcactgttgccttatataatcacaccacagtccacactgccatcacaactcacaagtgaccatctctctaacaagcaaacccatgcacacagctgatgggcaacatgctaacatgcttggccaattattccacagccacttcaaccatgaacaccaccatccggccacagaattctcactgctccatcgagcttcttctcacaaaaaccatccacatcatgaagcggcggcgccgacgacggcgccgcaataacaacaaggagacaccaccggtaggagatcgccggagagcgccgccgcagagcgccatggccaccccaagagctctgtttcttcagaggaagattcgtgatggcagcgagaagaagcaattacctgcagcagcaggcgtcgtcagggtcaaggtcgtcctgacgaggaaacaagcggcgcggctcgtctccctcgccggcgaggggaggaggaggaggaccgccgcgcagcttgtccgcgagctgaggaggatggaggacggcgccggccgtgtcgatggctcgccggcgacggcgacggcgacggcgtggaggccagtgctcgagaccatctccgaggagtggtaataatgtcaaatgtattatgtataaataatgtgtgtttgtgcatgcttgtacagtgtgcatgcctgcatgttagttatgtagtaagattcttttttctttgtatggtttggtcgtcaatttaggttgggttcagaggtgaggtaaacagcacaatatctactatccctcccatatgtatgtacccagattcgtgagacatattacatggtaaattggtcatggacaggtggatataatgttcatcatgctgggagacggaaaaaataagaaacaagaggatatgttgtctacttgtctcgaagaatgaaaacactttcccatcacgctgtggtgctagctacggagtactaactagatactgtatttcccttctttctgtccttgaacttctgatttgttcttcatatgtcatcactactggagaaactatcttttttcgtgggttggccaaaaatcacaataatcctggtccaaaaatcgagactaaaaaccatttttagtcccgattcaaaagcccggggatacgttttatctttagtgtcccggttgtttataccaacggggaccaaaattgaaataaaacggattgaaaaaaaaggcagccgcactcccttggcaaccgcgcgtctcgagtcttcttatcccttcgctactactcatcctcttctatccgatttctttctctccttctcactcctctcctcctcctctcgatttctctcctctagagtgcagggcggcggcaggccgtggcgggtggtggtgcacggcgggtgggcgggcggaggggacgacggcggcaggcggaggggagggcggtggcaagcggtgggcgggcggaggggaggatggtggcaggtgcagggtgggagggcagaggggtgcgcagcggcaggcggcggcctggcgggcgtagggaagggcggcgatggcccggaggggtcattggcaaccaccgaatgctgcgccggatatgacgatgtgttgtttttgtgatatacttttaaatgtgtggtgctgttgtagatttattttattgatgtttttgtgaatttgtgaatgattaatttttgttgttgagtatgtgaatctgtgataccaattatctgtgaatgtttatttaatctgtgagtttggtgcgaaatcaatatgcaaacaaaaaaacaatgaaaaaaaaacctttagtagatggtagtgtcacgtgggggtgctaacatctttagtcctggttgatgttatcaatcgagactaaagatctatttttagtcccgattattttaaacgtttcgaattggtagtcccagataagtacccaggagtaaaagaggttctgaattggaagtaaagatgggttttccgaaatgttagtgttgtttggtgagcacaatacggtttgtactacagatcgatctagagaattatttgcattatttaatgaaacggataaaacttctgccatgcatctttgttccaaaatatatgtttcaaatacaaaaaaaaaacaattactctattataaattgagcgtgcaaaatgtatcttgttttgtttatgggttagctagcctaacttactaattctcttgtatatatgcacgctttggcttcttcgtagcatcaacactttgcagggttggtggactgatcgaaaccataacaaatgcttacatttttaatggtgaagaagcgtaacttatggaattggtttataattgattaatttaattttgtaggagcatgtacgcataatttttgtttaatttgctttggaagaagacagaaacggcgttgtatagtagtacgtgtgttggtagtagtgggctaagaggaatctctcgttaattttgtccttgctgagtgttgtggttgttggttgattgagttggtacgtagcgcatggacagacaggggtcaacagcgaaacttaacattaattgtttaattaattagcaaaagatttgtttaatctttcacatttactactagtatgtagcaagtggtggcaggaagttgtgcatacgtacgtgcagattctttccctgtagaatgggggataatgttaggttatatgatgtattttttgtgatgtttagtttctaagaaaatgatagcttatattatattggattcgatcagggcgtagttagctatagagtaaattccctgtgtatccctgaaaactcacttaatccctttcatgcccctgaaatttacccgtcccttcaatacctctaaaatttcaacctcatctctttcatgcccttaccgttacatttttattcatttcactattacgtttggtgcaaatgtcttttttacccttgatgctttaagtttaaatataagcttgaaaaatgattgaaaattttatttgagtgcacagtatgtgcattttataaaactaatgggactaaataattagtgcagaaaattttgacataaattttgaaaataaaacaaatgtaataaattaaattttttatttgaaattttaataagacaatggattttttttatcgggagcattcatacaacaattattgtgagcacgggtagtcctatctttctaggaatgcttctcttttttatgactttttttaaaaaataaatacatatttttttatttcattatctaaaaataaattttaggataaataatgcaccgcacaacaaactcataactataatagtctcatgcgacaaacttttatatttttgataatgtaattaataaatttctatgtttatctaaagagtaaaatagttatttttatagaaattagacagccaactaacggttaaatgacggcatgggtatggaagggatcaaaatcaaattttgagggtacataaggaagtaaataaaattcaggggcataaaagggattaactaaaaattcaggggtatacaagaattttctcattatagagtatacaagggattttctcttaattatagcggggttaggagcaattagaaacagttatgtaataagaaaaacagtgcttgcgtattagtgaaccaaaaacagtgattgcgtattaccctgccagggtatacataccctgcttcatcagaagggagataagaaattaagaaataatgatagatgaacgaaacagatgacgtatagtccatagccatcaatcccattattaattagcaaaagtgcaaaacaactgcacaagtgacgtattgtagtaccatagtcgtccacgtcggcaaaaatttcgggtatcacggtcaatttactattcgtttggcaagtttgacaccgcaaatttgtggaattagttacgagattatggtgaaacttagttttggctttgctctcagaagtcacgaggcagaaagttgctgagatttggcagttttctcaatttttttaagcattaatcttggctaacaggcaacatgatcgagttacgtacactactaagcatacgtccactgtccacaaaacacaaggatatatgcttcactgtgtacttacactgtagggttttctttaagaaaaaaaaaaggcgataagaacgagaaatttgtctccttatctgttggacctattattttcaatgaaagatagccaatgataactaaacgaatggatgattcataattggtggcgatgacgatggtaatgataattatatatcacatttaataataggagttcatggttaactcaatgtgtatacagtagcattagcatctctagccactagcagccagtttgaggtcgtgtttttcattttgtgtttttggactatagcatgcagttatatattgtgcttacctgctcaaagataggtcctcgttttgaaaatatgttgcgatactttttcaataaatttggttaaagttaaatgaagtttgatttataaaaaattcaatgcattttatgttatgaaacaagtagagaagcgactaaagctggcattacaagctgattacatagattgaggacatacagaatcagaaacataactcggtaatgccaacattttaagagaaaaaggaataaagttaagtcaccaaatgtgctaacagcccggcactatagctacttcaattttgtgagataaaggaatgggacaaatttaaacgagcatgcctgttatttgttgggatgaggaaataggtagagaaattaaaaaaatgattgtgattagctgaaacgatgaaataggtggagaagtagttatattataagataaaatttggatgctataagtaactacataaggacggaggtacgtagtagtattgtttatgggaaaattgctttaacgttgctcactaataatttttggattatcagatttattgtacgagaattgcatggttatgattagtatgtaacatacttggataatatgttacattgttacatatattcaaatacttacatatttgttgctaaaataagtgatcagattttgaatacgagcagtagtgtttggtggaacaaatagttactattcacaagccatccaccaacaactatggtttcactttcaaaatcgcaaaactacttaagaaagcaaatgaacaatctcgagccaaaatgtatagatagtgtttctttttagcacatacaaagatgaagataaatttcactgtatgtcgagtgtgcgtaccttttcaaaatttgccattatgttcgtccattttcagaatttgtcactgaggatataaatttcttcgtaccattcattttgcttgtcagccgcaagcaccatccgtgcacaccagcaccatcatgacaccccacggcaaggagccattccacacgctactgttgtaatattaacaacgccatgaacagcgacaagaggcccaaccactactcacaaccggcggcaccacccatggcatccagaaccactggagagacagaaggacgacatacaagatctaatcgaataggccttccatcatagactcgcagcgcgtgtaaagcgaggcggtgccaaggatatatgtggtggccggtaagtggcaggttgaatgatgtcgtccccatccaccaccaacttgtgtgtctctgtacatgtattcaccaaccaaccatagcggtatgacaactgtgtagcctagtcatcgtagtagccaatgcttgccatgcctgcacctcctcctcctcctcctgcttctttatcacaggatctagaagaggggtgcttggagtgcggggtgtgctatcaatgatggtggggcaactaggatgtgatgctgatggattggaattgaaagagagggtgcaccttcagggctcgtgcagcggtggtgcatgagtggggtgctttcttcaccttaggcaactaggatgccgtcggggatgagagtgatggtggacggacgacgctggtgctgatgctagcgaacaaacgaagtgactgatgaacatgatgttggatgtatgggatggcacggggcgaatgaattcgcattcctagtggaaaatttttttaaaaaaaacacgtgaattaggtggcaaaaaatattgaaagacgtggatattcggtggcaaatagtgaggctcctctgatttgtaggaaaacctgggaaacttggaggaatcaaatcctatatgaaaaaaatcctaacaagttggatcaaatcatatccttttctttaaatttcctatggaaggaatcatcctataaaaattttggatcaaaataagcttgatgttctccttgacgttttcttctttctataaccccaaatttttggaactatcaagtgatttttgttccgtaggaattcaattggcatgatattctatttctactttttttttctattcatgtgttttaaaggggcaggaaattccttcaaagatgaatgggaaatgctctatctgttttcgtcgttggaaagcgtaatcgagaatgccgttagctatccgaaggcatcgccgtcgtctccactctttcccgccacgccatggctgccgccgtcgccgccctccccggcaagctcccacggcagccgccgccgccgccgcctccaccttcacctcccaattcgaccttcccgcgctacccgaagtccttggccgcacaccccgcgctctcctcgagccacccctccgacgtgtcggcgctgctcgccgccgccgcgcgcgccggcgacctccgcctcgggcgcgcgctccaccgtaggctcctccgcggggacctcctcgacagagacgccgtcgtcgcaaactccctcctcaccctctactccaggtgcggcgccgtggcctccgcgcgcaacgtgttcgacggaatgcgcggcctgcgggacatcgtctcctggacggccatggcgtcctgcctcgcgcgcaatggcgcggagcgggagtccctgctgctgatcggcgagatgctcgagtcggggctacttccaaatgcttacacactgtgcgccgtggcacacgcatgcttcccccatgagctctactgcttggtcggaggtgtggtccttgggttagtacataagatgggactctggggcacagacatagcagtgggcagcgcattgattgatatgcttgcaaggaatggggatctggcatcggcacgcaaggtgtttgatggattaatcgagaagacggtagtcgtctggacgcttctgatttcgcgctatgttcagggcgagtgtgcagaggaggctgttgagatttttctagatttcttggaagatggctttgagcccgataggtacaccatgagcagtatgatttcggcatgtacagagctgggatcagtcaggttggggctgcaactgcactctctcgcactccgaatggggtttgcatctgatgcttgtgtgagctgtgggcttgtggacatgtatgcaaagtcaaatatagaacaggcaatggactatgctaacaaggtattcgaaaggatgcggaagaatgatgtcatatcatggactgcactaatatcaggatatgtgcaatctggggttcaggaaaacaaggttatggtgctgtttggagagatgttgaatgaaagtatcaaaccaaaccatataacatattccagtattcttaaggcctgtgccaatatttctgaccacgattcaggcagacaggttcatgctcatgttatcaaatccaaccaagctgctgcacatactgttgggaatgctctagtcagcatgtacgctgaatcaggctgcatggaggaggctagaagggtattcaatcaactctatgaaaggagcatgatttcctgcataactgagggaagagatgctcctctagatcatcggattggaaggatggacatgggcatcagcagttccacatttgctagtctaatcagtgctgctgccagtgtaggtatgctaaccaaaggtcagcaattgcatgccatgacactgaaggcaggatttggatctgatagattcgtaagcaactcccttgtttccatgtattctaggtgtggttacttggaggatgcttgccgatccttcaatgaactgaaggatcggaatgtgatctcatggacttcaatgatcagtggcttagcaaagcatggctatgcagaacgagcactttcattgtttcatgacatgatattaactggtgtgaaaccaaacgatgtcacttacattgcagtgttgtctgcctgtagtcatgttggtctagtgagagaagggaaagagtacttcagatcaatgcagagggatcatggactcataccaagaatggagcattatgcttgcatggttgatctgcttgcaagatcaggccttgttaaagaagcccttgaattcattaacgaaatgccactgaaagctgatgcattggtttggaaaactcttctcggcgcttgtagaagccatgacaatattgaggtaggtgaaatcgctgctaagaatgtcatagagcttgagccacgagatccagctccatatgttcttctctcaaacttgtacgctgatgctggtttatgggatgaagttgcaagaataaggagtgcaatgagggacaacaacttgaacaaagaaactggcttgagctggatggaagttgagaacaccactcatgagtttcgagctggtgacaccagccatccgcgagcacaagacatctatggtaagttggacacattggtcggagaaatcaaaggaatgggctatgtgccggacacaagcattgtgctccatgacatgtcggatgagctgaaggagcagtatctgcttcagcacagcgagaagattgccgtggcatttggtttgattactacttcagcaccaaaaccaatcagaatatttaagaacctccgtgtttgtgctgattgtcattctgcaatcaaatatatgtccaaggccaccagaagagagataatattgagagatagcaacaggtttcacaggatgaaagatggggaatgctcgtgcggagaatactggtgagctgcacagcgcaggtttgtctttgctaatgatcctgatccaggcttaacacagtgaagcttttcttagatagttgtagttcataatttttgtagttgctttgtatagttcataattttttagttgctttctgttttgtacaatcacatgttggctacagacttgttgtgttggtttgtcagactgctacatgatttgtacagttacatgaataaataatttttatttcggcagaattctctactcatcatgtagtacttatttctgtagcttaatatttttctgaaatagtcgcctgattcataaatgctgacggctttaagaacacagggcaacttttttgtttttaaaatgaatatcgctaatatgtccacagccaaacagttcaacgttagagggaaatctaatctcagcattcccctttattgtgtaccgtagaaaacgtccagagataatttagtagataaagagttttgatatgatttatattgcatataacatcctaggaaatacagacaagcggacatgtaaaacaatacaagatgaaagtaaccaagaaaattgctggaaaaactgctggttcgatcagctaccgtcttcaaacccaaaaaggaacaggatgaacatatccagaaatatgttctaggacctcgcttcaccagagcaaattcatttgatttggccaacgggccagaaccaacttcatacaaaggtggaagatgatcaaacatcaaacagcaccacagatcccaaagcatcaatagtttagatccatgttttcagccatcaaccagatggaaatgcctcaggaatggatggaagacctgaccgaaaacattcttccattcatattttctaacaggtcgtcagactgatcttcgcagttctggtggaagttgcgcaacatgcattgaagaatttgatttagcttggtgttgaagctccatcatttcttccttgctgtactttattctttcatctgtcatagaatttatacaaacttacagtcaatatactcttaattgcatggcttcatctgagatgtattcctaatcaaaagagaaaatcccttacctacaaagcagatttcagcaagtctacttgggccagccgaactttttgccacttttgcttttacctgttgaggttgtctagaggacttgtgaagatgcgaagtaccaccataatttgcctgaagttcctgtataagctcatgtctcacttcaatcacagggtgacacgtacagaatgctgaaattgcatctcctgttaagatccaacagccgcttaaatccaacatacgcagcgtggcagggggaacaaactttctaagcccagtggtggacaatatattcccacagaacccaagatgtatcaaatttgaggcagaagacagtgcatgcaaggcaggatcagacaagaaatcactttttaggaacaaatatttcagtgctctaagggatgctaagggaggtataacatcatccatcagctgtgtattattcaaatttaggctttccaggtatttgagttcttcaagcgcagagagagacagtactttcacagagttttccatcatgaaacctgcaacatgattaaaatgagttactcgaagatgaggtacactgatattatcatataaaatgctgggcaagagaatcacaacctttgatacatgtgcgactcaggtttaaaattctcagtgaaggcatcatgcttatgtataataaagcagaatcatcaatttttgtatgagctaaagacagtgttgtcagacttggaactgttcctgccagaacacacagtgcttgagaagttacttcagaattactcaggctcaaaaacttaaggttcattccaatatttgcaatatattcaattgcatcgctaattattctgctgtagctaaggtccaagtgctctagattcctcatatttcccaagaaatacaagttgcttgaagagcaacttgacatatccaagtatgtcagtgaacttggtaggatgcttgaaaaaacttcatcaatgttgccaaatgatgctgcggagataatcaacttttccagatgaataagaacttggaattccccattgcaaatagaatgaattgtgcagttgctcatatttagacacctcaaggtcggaagaattggtaagcatgtcacacgtgtccaagaaatattcaagaagctcaaagatgtaaatgcaataaggacagaagctccctcattggtaatttcactgccccatatatcaaggtgctcgagctgtgtcaatacctagagaaaaattcaactaggaaaagtttatacccaatagatatcattaaaaacaaatcaccaattactagcatgctgacagcctaacatgaacataccaaattaaaaagaaaaaaaataaagaccatatgatgatgttgaaattttgttcctgaaacaaaatggctgtgcaccatgagtatacatacctgtaaagaccgtagtgctttgtctgtgaaacgaactccccccaaatctaataaacgtaagtttatcagcgacgaaatggccataactccattgtcagtcaacccggtttgcgaaacatgtagcttctccaagctttcaatggaagcgatatgtttgatgccagcatcagagatcttggagcaccttgacaaatccaactctttcaacgtacgcatacctacattatcatcacaagagtatcgcgaaagctagttcgatcgaggtctccatgatagatacaatcgtgattgagaaaagcttcaagtattgtaccggagagcgcccagaccgcagaactgttgacgttcttgcaatccgcaagcttcagaaccctcagataccggaatgctcctaggtaagccagccactccgcgtcgacggcgatgtgaccgctcagatcgatctcctccaccgagtgctggaaaaccctgcacacacacggatcaagaattcatccacgcgcgaaaccaaacggagattgatccatccatttcggccctgtaagtgccgggggggggggggaggaggangangangaatcgggcggttactccaggagggaagggaagaggaggcggcgggcggcgaggcggcggaggagcgcgtcggcgagctgcgcggggaggcgctccagggagcggcgctggcggcgccacgcctccacggtggcggccccgcccgccgccgcgtcgatgcagcggtcgaccagcggcgtctcgccgccgccgccgccgccaccggcggaggcggaggcggacgccatgggcaagacggcgtcgccgcggcgcgagctcaacgggagaagtggggggagagagagagagaggattggatccgaattgactcgtcgccggtggcgagaggttggaggagggtggaagcggatgctctgacgtggcgtgtatcccgcggcgttggctttcatctcagccgtccgtgtcctttcctcctggagaatgaaaatgcatttaggacagcgagatacggtcttcaaaacacaattttgacttcttgtttctataaaaatatttattaaaaagttatatatgtatacttttatgaaagcctttttcaagacaaatctatacatataatttttacattttcaaactcaataacttgatagttattcatgatttatattttaaggtttaacttaaatattgtcataaacgaggagtatgttagtgagaaattccctggagtgctcctcgcaacacacacgggaaaatgtgaaactttcttgtgtgatcgagttttgctcaatccttcacgtgtaaaaaaaacaaaaaactgaagggagagacatatcttcttttaagaagatattgaacgggttagggattaaacataagacctcagagccaaaaccacatacccctttccactatactatcaagtgtacaactccaattcttcacatatcacaacttatttggataatgaaaaataattctgcccttcagcttgaaatctcaatccacaacttattatattataaagttgagcatttaagttgtagcgaaaagtcatgcataacagaaaaccaacattgtttaagatgaagaagataaacaagcaaaagtcttttgctaaatatccgtctatggctgacgaaattttgtatcactaatatcaagaatacggtatgtcacatgtttgcatagatttatctttatcacactattgacacctaaatttagtaccattatgaaatttgattggatttagaaagatcatatctttccgttgaatgtcaatctaaccgtccatgtatggtaggtctacccggtctatcatacatgggcagttagaatgtgaatttctcataataacatttgatactttcttaggataatcaaagatataccattgacaaacgttcaaatttaagaaatgcgcgccatcgataaatatgagttctaagaaatgtcatcatacaaacgattttatcctaaaattgtcattgccgccgttagggctccatcaatttcacactgttaaatacactattttaggacaaagaaaatatcaattattactattgtatttttatattccttaaaaaggaaggtaattttagtgtcacgtacctcatagaagaaaggtaataatagtgttatgtatctccactatgaacaccgagttttaactccaagtcaaccattagataataacaaactcaggaattaatacaagtgaaagcatagactgtgaagaagcaaggaatttgggaatagggagaagcactaatggtgttcatgcatgactccatccaccagggtttaaatcctaatgcccagaaatattacgcacatataactggactttcaaccagattatactgagatcagagatgtgctgctagttttcatctcttagggcacccacaatggttatctataagctctctacaagagatacatgtcggcatattttcctacttggaagagattaaatgaagagagagagcaaagctatctactaacctggagatagtctatagagaaaaacgaggcaatggattagagagctatagatacccatgtagacatactattgatgtgatttactattaatctagtctattgctgagatgtatatgttttatagagagcaccttactttaccattgcgggtgctcttagagcatgtgttaggagacgcattctttagggtgtgagtgtgatgttgtgtgtgtagtggtgtgtgcgcgtttgttgtgaaattaaaaaaagaggattttaggaattagggaatggataatagagtttagggtggagactggatagagcactgctacactggcccactggggaaggaagacgagaacccaattctgttgctgctgctgcctctttttcatagcttcgacgttgcttgtttgggccccagcccaaagaccgtgacaaagggcgtatgttatcagaatttatcgcaattaaatgaagatagtagctcagtcgcatattaatagttacttaattaaacttgatagggcaaaaggaggacgatgaacaactaaatctcatctctccaaacccctaaaatcatagtattcgaggaggaagaggatgagtatacgtactcgcgttccttggactcttctctacttcctccaaataaccacactctactctctctctaccacaaattaccatttcagaatagttgagtacttgagttcatttcagaccagtttgtagccggtgacccagatgttcgccggcgccggcgccggctgcacgtacacgaacctgaggctcctccccggccgcagcgccggcagccacctcggcggcacgtacccgtacctcgcctcctccagcccccacagccgcccccggagccccgacacgcccaggtgcagctccctcaccgtcttcccccgcgacctgttcgtcaccgtcaccgcgtaccggtagtacgtcctccgcctcctcgcccacgtccccgtcacgttctgctcgatcccgatcgccgtcgccgtcgccggcagcgacgacgacgacgacgtccggttcacgaccggagtcgccgtttcttgttcgtattcctcctccttgaggccgccgcaggaggcggcgaggcgggcgaggacgccgagcagcggcgcgttgttgtaggtggcggcctccgtctgctcgtagttgtcgcgctcgtcggcgaagtcgtcgtactcgtcgggcccgccgacgacggcgccgtcgagcaggttcgggttgccggcttccctcccgtaccacgacgagtacccctcctggcagctcacgaacgacgggtccctcttgatggacacgatggacgcgccgcggtggtgcacctgccgcgggtagctcgcgccgtacccgaccatgtagctcgtccccctcggattatcacccaaaatataattcacctgaaatcaattcgacaaaatttgagtaattcgtcaaccacatttgacaatgttttttttttctcgtgaagtggaagcggtgagagtattgccgaatatattagaaggacagagttgaccctgtttataaggaaaaccggctcaaaaaccatacaattgcacggcctttgacaatgtttttgtttgttttttacctgagatttgacgaatttgaggatgtcgaatggttgggcggcgccggcggggcagtggacggcgccgcggccggagatggcggcgaagtcggcgtagacggtgaggaggaaggaggcgctggtgacgaactggaggttgttccacctctggtggtacatcatgccgccgggggtcctggcgacgttgacggcgcccttgccgacgcaggagcacacaaagaactccgcgttctgcctgtacctctgcagcgcggcggcgtggtcgccggcgcggccctggaggaggaacttggcggcgaggacctgcacgccggggtacttgacgtcccacccgaactggttgatggaccaccccgtcccgcccagcgcctcgccgttgccggcgaggtactccaggtaggacctgtcctccgtcgcctcgaacagccacgccgccgcccagagcagctcgtcctgcagcaagatcaggtcatgtcagcaaggtgttcgtccgaatcctacggcgccgccgccacgccacttaccccgtatccgctgaaggagccgtagtagtttcgcgccaccgtgatgctggcgtcgtacttgccccggtacttgtcggcgaactcgaacagctgaacgcgccacaaaattttcagaggaaatttcgtttgatttcgagctcatttgcgagagttcttggagtgtttggatgaccgacctgcttggagtgcacaaggaggaggttggcgtagccagggtacgtgccgcggaagacgatggacgcggcggccatggcggcggcggtctcggcggcgaggtctgacccggggtgctgggggtcgacgcggaacgcctggcggctcgtcgtcatgtcctccggccgctgccagcagctgtggtcggtgtcgccgtcgccgacctcgccgtagagcacgtcgggctccgggtgcgccttgatgaagtagtcggtgccccacttgacggcgtccatggcgttccggagctcgccggccgccgccatctgcttgccgtactctaatatgctccacgacatcatggtcaccgtgaacgccattggcaacccaaacttgacattgtcccctgcatcataataacctccaacaagatcaacctgaaagacaaacaaaaacacaaacatttgcattgcactccattagaacccaactcatcatatctcctgaacaaattgaacacaatgccattgatggcatcatggttttgatcaaagatttgaaggtagaatggtgcatactccattggcctttccatcaaagaggccagagctggctctccaggagaccctctggttaggagggagaacgccggaccgctgcgcctggaagtagaggatgctcttcctcaatgccatggcatagtcatggccacccccagcaacaaatcccagcttcaccattgatgcaagtgccaagagaccaaacaatgtggctgcaccgtgagcaccaccattcttggccattgcaaaattgcaatgtaccaagaaggtgagtgagtgagagtgaagcagagtgaaggagcaggggagcagaggactttggttggcttggcttggagggagctcaaaagagtgcttcttatataccactggagtggagggaagatcagataaagcaggagattcaaagcatgagaaatagtttactgaactccagggcccctttctcactttagcaagttgttgatggcaaatattattccaaatgcatgcaactgatgaactcctaggtaggttacatcctcctacaaaatggcaagttttgtccatctctttttagtaaactactgactaatatagccacttctatgattgattatattattcatcgatggtcaccatctgttgtgagatatacactgaaatgcgataagcaacattagacagtggccacataatcagggcatgtattttagaaagctttcatgaactccacaaaagtaaacatttggtgaaaaactgaaaatgaacataaatcggactaaagttgctagattgccgatataaaatcatgatatgatagttgtaattttacagttattgtcactgagaaaaattttgtgatgttatggatagttaataaatgggataaagataattcaattccattgaaaaataaataagaaagctacatattacagaagttaactttgcatgcatatgcttgagaaacaagcgattcctcgtgcaaaagaacaccataggaactaccaactttaaaaaggaaataatgcaggcaattgtcttgcaattttgggagtatctgtaaaagccaaagaaaaggaaaaggttaaagaacgtcgtttctctatagaatgatcgtaccagcgctatcactattgataatactcttgttcttgcaatatacatgttttttttattatcatttgttttctagcagtttactgaaactaatgctccatttgaaatccaagtataatatgcgaatttcattagaaacagtctcccacgtagcctagctagggagtagggactagaaaatttcccaacttcatattcttacaaaagtatatttccatcccttaattccatcggtatctttgatgatagctgacaaaattcgctctatttgaggaaattagatcccgatctttcgataggtattgataactctcgtggaaacttcacacacacgatccagcttctgatcaacatgatccaaactctggttatcagccgtgccctactcagttgacctcgccgagaagactaatccttgtatgcaaatcgaaaaacacaagcaagaacaagatagattgcaacacaattggatatgaatgactaagcactcgaatttggggttccacaaaccaaagtagcggcgaaactgcaatggcaaaataatctaagcaaaacccgattctaaactttaacgactactgaataaatatgatttaggacgtcctagggttgccctagggcgcacaccccttaggcatagcccacaacacaaaagtgacatagtgagggtagaagtggacttggaaaaggtcttggtttggtccccagtgaacttctttgattatctatgcatttcttacacttggtctcttttccttcatccaaacaagtacatttgcaaacgataacatacgaaactcattgtgtagtaacatttatttaaatatataacaagtaaatctaatataaaacatatgcacctttggttgatgaatacataaggtagtcatggtcatatctaagctagttgtgtcctcatcactattaatgtgtggttgctttgaaatattgttacttggattattagtatttgtttttacgttttaccaactatagttcatattctatgccatatgttaaagaccaaaattattgtccataaacgaacatgaacaatgaataatgagtttattgtaacacaattcatccttaatgcttaatgaaaaaatatctgtattgtttgcatcctttaaattttgaactaattagtagggatgaaaacggctagaaatggttggaaacaatatcattattttattatatttatgcaaatggtttaaagtagtcatgaaatttctatattcatgaatttaagtaactaatgtcaactataatgtgacaccgacagaaataaaaaaactaaaatttaaaactgtaatggttgataaagatattattattttattagttttttgaaaacggtatcagtatagcctggacattttcactcgtactaattaggattactttagaacaaaagaattaagaaacacataaatatgataaattatacattcacatttcctctccaatcttacagaactgacaaaattaggaaacaattaattttctatggttgaaagaaaaaaaaatagatgatgtaaaaatagagagaaggaaggagataaccttaagcccccttttaaaatgtgtgaagatgataacatatgaatagaaaaagatgaagatttttcaaaagaaaaaatggaacaacaaaactgaggattgtaaatggtgaaaaacttacgaatttaagtagtgctataataaatcaatgcactgggcctggtcgggctcagtttgaacatgccaatagaggagattcccaactcatcctcctagtttttcataggcacgctttctaaaccactgaacggtgtgtgtttttttaagaaaaaactctataacaaagtttgtttaaaaaattatattaatctattttttaaaaaaatagctaataattaatcaatcatgcgctaataagttgctccgttttacgcgcgcgaggcatgagtttccaacttcaaacatcggaacacagcctcaaggaccttgccaaaaaacaacaaacaaaatccaatgattttttgttgtgggggtttctgaagaacttgtttgggttgaaatccaatgaatatgagatgttcgttacggtaaaccagcaaattgacctgctgtctgctgcagcgcgttcgatggatcgatcgatcgacatggcgccgttagagcaagtataatagatggctatacgaaggctaaatgctgaggtggatgaggaaggagagaagagagatgagaagcgggttgtaagtttacagccggcttaggcataggaaccaagaaaatctatgagacagacatgtggactatatatttatagtgaagagttaaccactatatgagtaagctggtagataggctataagtaagcagttggctttattattatgcttgctcttagtccagccgcaccaccccaattttcaattccgccactttcgcgtcgtttgatgcaggtggtggccgcgcgcgtgaacgccgtgcgcgcgtagcgtctggtcgtcgtctcacccctcccccaaccccgtcccaaagtgtgcttttctgacttgggtagcggccggtttgacagaaatcagggcacgatcttaggagcaccagcgacagcgattgcggctgccgcccggataatacatgagctaattccacgctgtgcccctcaacttttctgtgcactcgccgtgtcctgcgccagaaatggggacataccctcttgtctagtgtctagtgttaagattgttagtacgtacaccctagatttcaactttggcaaatgaacatcttagatggtttggattattactccatcattaacatggtcagttatatgacaatgttgatgatgagtaacaatccaaataaaatgttcttgcttataattaggatgacatacgatatttcaataatatagcatccttttgagtatttgcaaatttattttctgtagaaaagacaagtagtcaaagtttaaaaacgaatagtgttggcagttatttaagaaaatggagggagtatataccaatttccttttataaacagatataccattgtttttagattacgtgaaatcaaaccataaaagttttcataatgctttctctcatgcaaccgaaacccgagagaaatatagaaatataagatgctcaaacccgctcgccaatcctcttccaccggttcctacaaacaacggcgtggtggtccacctcgagacaacgatgccacttcttccatggtgcctccccatccttctcctccgaatcttgtttctcctattgccctctccctcccctagtaactgcccttctccctaatctccctttgtcacgtttcttggagcagacctggctgcccccaatcttaaggtgccaaatctgattgagggtcacctaaaagaaaaagagtgaggtggggcgatggctttacgtagaggcttttccttagccttcattttccttgccaccacgagaggcggcgacgaaagtgaagctagtcgtaagcaatgaatgtgtgagacataccagaggctagtgtaggtggttgccagacacatagaggaagcagtgctcatggtgctattgtcggcaccaaaagttgttggaaatatggtcacaattcagcatattttaaactaaattattaagacaataagcatggcattttcagggaataaactagtgcgaatgctaatcaagagcaacatacaaatcatgcttaatatagaataagcataaacattcatcacatgtcaatgtaaaaaaacattgcggttaacaatagtatattagaaatgagcgcgttgatgatagatatataccctgagaatggctctccgctggaatatgaggtagagttgcctctgttgatggagctgttccctgcaccgcctcctccatcgccattgtcgacatctccctcagcagcaccgttgatgttgtcgtctgtcgacatgttggcgttgatgacgaacaggaacaggaacttgcagtaggagtagtcatgttgaagaacgctccctaaaaaccttattgcccacctacccgtgcaggaactcagacgaacagagtttcggaggcccgactcgtcccaatctcttgtgcatgcaagagatcagagaccggggagaacagaagcagcacaagaacagagaaactggggtggaaggagaagtgcgccgagagagaggaaagaacagaagacactcgatctgttcgtccctttggcagagtgtttctcatgagagtaatgtttgcgcaattaatcctcaaattaacagcgaatgaatcgctctccgttaatacagaatcaattcccatatattttccgcctatccgtgcaggaactcagacggacagagtttcggaggccctactcgtcccaatctcttgtgcgcacaagagatcaaagacccgggaggacggatagagtttcggaggccctactcgtcccaatctcttgtgcgcacaagagatcagagaccggggagaatagaagcactggaaggagaagaagtgcgctgagagaagaaagaacagaagacacccgagcccttttggcagagtgtttctcgtgagagtaacattcgcgcaatcaatcctcgaattaacagtgaatgaatagctctaaattaatacaaaatcaattcccgtccattacaaaacaagagagagagagccgccatggccacggccggagcgtgtgtggtagtccgcccacctttctcaactggtcaattgggagccttaattgtctcactatttaaggtgagatctctccacttaagtttccaatgaggtattattgcctctaacattaattgtagtcctatgaaatttaattgaattaaatcgagcctagcccatttattcaacagaagtgccatagaggatgcatattttttcttcattttgcaactcgccgtttgtttgaatgttccatatattagttataagaagatgctgtcgggttcttggatgttccacacattgttttctttttttggcaaattctgctacatacccaaattttatgtaatttactgatttacatcgtaaaaacgtgtcacggctgaaagacaccttaaaaatggtaatttgttagaggacactctcggcttaattaaagagataaattcttaagaaacacgagaatatccctaggattatatgcttcaaacatagcgctaaagtaaaaaattaagaaattatgtaaatctaaatttaccatcatcccaagtatatcactaacataaatcgtattctacctttcactttagtctcaactcaaaaacttttgtccttagggacattatcatctttctaaagaatttctttctcagttgagtaaaaagtgttcttcagtaaattactagtttttatagtgtattttagccatgacatgtttttgcaatgtcaactagcaaattatacaatttaagtgtcatgtagtgaattttgccttattttttattgcaattaatattttaaatgttgcatctatttaaaatatttttaatcaagtgataaaatattttttacaaagtgacgaaatattgatcaacatgttggccaggagttcctagtcactttcttaaaaatttggccccaagtatcaagatgtctcgcggagaagatgacagcagtatgttgtgacggaaaataatttcatatcacttacacgaaaagtgattgtaaatggtatttttttttctgagtggactagctgctagctaaacggtaaatgttagaggtttccaatgtcctcacaaaggattcgacgaggtagaggaagcgggtaaacggaggtcccactatcaccatcgccgttgccgccgtcgagtcactgccgccttcgcctcccgaggccagatccggcgagccctaggctagatctggttatgaggggggcggtgccagcgccccgacgaggaaggtggagggaaagccacgcgtgacgagtgacggttggggggagggagagcaccggacactggtagagaagtactttttagtcccggttcgtaacccccctatagtcccggtttttcaaccggactacgaatccgggactaaagatcgctatctttagtcccggttagctatctttagtcccggttcaaataaccgggactaaagattttttttttattttttttctttttcattattttttaatatacaatattgatttcacaccatcctcaaatcataccaagaaatcccaaatccaaatcatcagatatcatataatatctccaaatcctcaaatagatcatctccaaatacatcacaaactcttaaaaaaattacatcacaagttaaaaaaatgcttagattcagatgtaatatgaccaaacgaggacaacaatctcacgagttaggagacacaattcgtttggtgggcaggcatacagcagagaccacacaatactatataga

SEQ ID NO: 9004 - DNA, 11355 bp, Oryza sativa
ggcagactgacattgctccttcagttcgctgctttttgtttgctgctttcgctcaaccatccacagcttcatatcccgagagagaaaagccacaaacatagatccactttcccttttcttttcttttgtggggggatcatttgaggggagcatggatgtcttttttttctctctttttcttcccaaaagaaatgcatgtttttattaagtaaagatacaaatagaatactcaagaaatataaatgtaattatcatattctctatattcattatgtaataaaactgaagtctagaataaataaataaatatcaagttgtgctcaaacatggaatctcaattttttttcctttgatttaactattatagtgttttcttgatttaataattttaaacttcagaaatagcaaatagtaataatattttcctaattcaaccccgtatcactattacaacttttcagtccaaccataaaatatcaggactactattgtatttgacacctattctacctattctagtagaatgtctgtaaaacttatgttcgaaagacacataaaaaaagatatgttgttttgaacgtaggaatcgagaaaacacgcgattctcgctaacttactataaaaatatctttttggttaatatatgtttaaatggtcatatgcattaattagtcttaagacttctcaaagaaaaaatataaggaggtcgtaatggatgttcaaataatctatggattttctataaaatcaatggctaacaaaaaattcctccgattttctgatgtccttttcgccattcagaaggggtgaacgataccaaatcctgtaagaattaaaatctgccaatttttcttcaaaaatacctagctccttctgaatgcaggaattttactacagtttcacataaatgagttcatttctataaataaatcccttccaaagaaggcctgaaaagtattaagtccagtcaaatatattttaccttggctgaacagagtttggtaaatataaatgaaaggagggagcagtaagccagtctataaatcctagtgttaaacttcttgtgaaattacaagataacatacaaccaaaaatagtattagctagcagccgatctttgagttgggtgccaatgtaaacaaggagcactttctgccgtccctggcaacaaattttgaactttacagaaaaatatgtaagctcgaatccgtacacacaaaacaagaacccagttctggcagcgatttgtgtctaaaacagacaaaaggaagtcaaaatacaaaaggcatgtccccacgaagaactgactcaatctattatctaccagactaccacgacccaaattcacgtgtcaacaacgattgcaattgtcaacagtttgcatttccggttagaaaatattttgcgatgtttgcaatttcaatataccttccctataagcgcatttttaagctggcattgcctccgtgataagttgaaaaacccaaaaagttcaaggcgatatatagagctataggccccatcaatatgctttcccttacattagctttgagcatgccaagcccccaaaacacatgttcaggtactaagcagagtagtatagctttcacaattttgctacttggaacagagaaaagtcacctcgagtgtctattatacaaaataagattagtcagcacaaaattttagttccacttgatggaaggctgcttactgcttaaacaaggcagtttaaataagagagcctccaaataagtttagattgcatacatcattgcgaagaacatcacaagtagcagcctgacttgagtttctcgagactcttgtctttgaatctacgactatttctcttcgtctgactgagaaggcccattgatggcatcagcaaaatactcaactggaatcatgtcaacatacaaatcatcaaacttttatagtagtgaatataggtttttcaaaattcactgtactgcatatattttaaatagacaagtacaaaattacctatgtcatcatccggggattcaaaaatatcagagtctgaaggcaggaatgggttgcctgaatagttttcaagggctgccaggtctgaaagtcaatgccaacagtagttagatgtaagcagtagcaaaagctgaaaataagttcatttagcaaagtggtgaacgtttttgtttcccgtctacaggtcaattctagatgaaatatgattgtcccagaaaaatattaagtagaaatatattcttttaagcactgacaaaaagtgaaaagcacattcaggagcttgttttcaaatactacactgctagaatactgtctataagtcaggtaattcagtatgtgggggagaacagaagcagcactactcaaacattttagccaagcgaagatcttgatttactccaacaaggggtaaacaaaattgaggagagaaatacaacactatatatggcataagttcaactaattaaccaagatatcaaacaagcaatgagaatcccagagaattaattaaaaatgcaagtgttatacaagataatatctcacaacataggacattacctcccagatttgtcaaatctgctgataaatcagaaagactgaaatcccagatctgctgccccaaggaagagctatcaccaccatttggtcctatttgcagaggtcctccattccctaaatcatctccaaaggtggcatttacagtagatgcatccacatccatccctgatatatcaggagtgaaagaaacatgattgcttgacattgcagatgatggactcacagccatctctgatgacatggctccagcatgtgcagttccaggaacttcattctctgtcatgcttcagaaacataatgcaaaaatcaaacgaattgtataggtgctgacagcaagattttaactgtagctacctgataggtacatatgtatgccattgtcttacaagacacaagaaaataattagtataagaaaaatgtattcaatttttacagtcaaaatgaacatttgctgaaataaagagggcaatttggtaattttgaaactacaacatattgcatgacttgggagagctaatgcatcagaaatttactctaaattaaataagcattcaaatttacaacatggctatcaagtggtttgatactgcaccaagaacaaattattatcattatgtatgttgtccaaatctgtataaatggtttcattctttgatttctttccaaacacctgatttggagggtttccagtaaacaacaaaagagaaaatatatgagataatctcaatagtagcaatagtcagtgtgatgataattctttctaagactaaaaaggaaagagggagggctgtattcaagacaaaacagagtttacattgtccatcttatcataatgccgtttatagagcgataaaacaacaagacaagcattagaacaaaacataagaaaaatattctttacccatttcctgagctcatgcgaatcggattataaccacctggtgcaggaattccatttaccacatggcaaccaggtggaccacaagatatcgaattaacatgaggctgaacaggagcaggtattccaggttgttggagtactgaatatcccataggcaaattgttaactgcaatggtaccaagtaaattgtaaggaaaacaaatgggacttcataaagcaggccagccaacaaaattagccagctaagcatccagaccaaacagaggtgatatcagcaatgttatgatgaaaacacacgaattaacacgatttagcatgaactatatagaactgagacacaagtaacccacttcagtgtcatgtgggcctcaagaactcccagagcagcaggcactgatacacctatctttcaaaaatgtgctcatttagcatcttttctcgaagttatctagaagatacatatttatcaattagctaagctacaaatcttttaagaaaaccatgcacatcgcaaatagcccgtgacatttcaacacagtttatcaaacatctgtggctaggacataaacaaatgaaaattccacaaaatgatgaaatgagtcttccaaagtgcaatagtcattctccatatcaagacagttttgtaagagcagaaatgcaagtgtttaggaattcttccaatgttatggcatcgatatgaaagaaatttgtggacaaaggcgaaagcaatgtattcatacatattttacttcataaatcagtgcttttgtatttatttttcattttgtcagtgctaagtggtccttgagtcctgtaataaatcagtgcttttgtatttatttttcattttgtcagtgctaagtggtccttgagtcctgtaatacactggcctacaagtacagggccatgcagcacatggtgttagataggtcagggccaacatacaaccctaaacattttaactataacacctattgtttaaccctctaacacgaaatgatcatgaaatacaaggggacgctatgtgtaagtgggtctgctcctccaaagatctaggctaatacggattttggacgctgatagaggcctgtgtggtccatgttgcggcgctggttggattagtctcacatggagaacttagattggttggaactagcatataaacccacgttacaattatacctcaaggttaactcttctatacaaagcaaggccagaagtgtaagtagggtgctatctgtacatggccgctccttggaaaagttgggctaatgcggaattttgaagttggggtgttacaccttgtacaactattggtatctataagaccatgtaggggcatgagagtatgggggagaagggagaaaccaacttagaaatccaagtgccaaacatattccaatcccaagttaatccttttacatgaattggtggtttgtttgtgctccagattttgccatattcttataacggtccctaaagtacttgtctagttgaactccaaaaatccatgattgtgatcaagcgcggatgactacagactaccttatgtgaatgcatggagacaaaaaagcaaagggcttactttccaaattaagggttgaacgtagcatagtgccttgaactagttaagttcatatctgtttgataaaatctatgaagaaatttctttatgacagctctggactgaaactatgtgtgtcggatgttcaagattagcattgaccttactatgatttccaaaattttactatgaaccaagcattgcaggatcagagtgaattaatttgtctctttctatactctggttcagtgccaagctgtacacagcagagccagtaatatcaatgaaagtacattgccttagatgcacatcggtctatcaggtgataaactgatgacctaacagagaatagggcatcaattaagggcagtgctatgtatgtagtagtagtaggcaccaccaactggcaaatggcacataaaagtagcatggaaactagtaaaacaacaacattctgaacttacaataatgaacaatgatacatgagtgggtaacactgaaacaaacaaaaaaggctaaatgatggcaagaaactctgaagcatggaatcttaaaaggaatgtgtaacattataagtacaataaattttgtaaattatgattataagtgaaatcaggttttcaattaattttcacacaagtcaaatatgcacattatcacagttatggcagaatagcacatatcctacatggataatttgatttttgtgaaatcacactatagagttagatattaatactatagagatagacattaccaggcataggacgaataccgttctgtgttggggtcaacggaacctgctgtggtactgggtacttcataagatggtattggtgctccaataagtggttaaacaagttaatctgttttttcaatttcaaccttatgtagtaagcccgaaagaactcagaattttcttcttcgagtttctgccatactgaaaaaaaaacaaaagggaaggctttagagctatactagatacatcaaaatgctgaactgtctccaagcatcatagaagtcactcaagtattcaatagatctttttcattaataaacaatgttaatatatgtacgacgtaaaaaaacagctttcaagttttcactataacttccatattcaggaacagaatactaaacgaaaggaattagtggattatttcagtatccatacatatttatagtactacacgatcgatcttggctataataaaatgcaaataagcagagttgtagatgcacagctgatgttcacaaaacagattaaggagaatcttattactcaactcaataaggtgaccaaaattgtcctgactgaagaagaaagaactactcctatattatatccaggtgagctctcttcttaaaatagcataccctgagcagattataagaaacaggtgttacgaaccaactcaacataagaaccttacctaaagtagtgaaaccaggttcaattcttgcacgagtagaaagagtcctaacaacttctcctctattcatatatagctgtagacagcgttctattaaattctggacctacaacagcgcaaaatatttggttagttaataatggaaggtattatactttgtatacaaaaattatacacttttcaacattgcctccataatagaaaagactagccatcttacaagttcaatatcttcacgagaaacccttttattatcattacttgcagcggataaggaatcagaatcccctaaaggtgcatcagtatttggctgttcacccttgatttcatcatcaccttgcaccaatggatgcacctttgccttgctctcaacatcctgtagaaatatgctcattaggatatagttcacttgaaatgtggtataaatgtaaagatgtagtaacaaaaggtgaaagcaagggcaatcaatggtcatgacatcagcaaaaaagtgagaggtgccaatacaaagaatatataaccttgaatgaactagtttttatgtcagagatccacaagagtttacctcatgagcacttggtatcttgaacggttgctcttatatttaccaagtgactctactgactaatacagagttaacaggccggttactagagatgttctttattttgcctttcatagacattcttacacctctccagtcttcattgaagtccatcaactacaccatccaagttctccttactagaattgtgcagctgctacatttcacactggggacctcacagtgcatggcactaggctactggaggctatctttgccaaatcgatcattgcggtagattcatcatgttcaaaactgattagaaatcagttgcatggccaacactgttcttggagccaatagttggcaagctccgacttgttgttcctggaggctatctttgccaaatcgatcattgcggtagattcatcatgttcaaaactgattagaaatcagttgcatggccaacactgttcttggagccaatagttggcaagctccgacttgttgttcctcaaagtcgaagggggagaagattacaagggacatgattttcattttacagttcagtacaaacaaattctcaaaaaaaaaagagactggaaaaaatatattgctcttgtctaagagttgcataaaaattaaattaccatattagcctggatggtaaatcttctagcattttacactccaaaagtcatctaagtacattgcatatagattctaagaagtaaaatccaatcttccgagttggcaagctatctatttccgaattaatttatatgaaaggttctctcacagtgtgactgacatcagcactttaaacaaaagacagtgcatcgaatttatttttttttcaagaaagattcttacagtacgaggtactacgacatcagcactccaaacaaaaagaaacacagcgcaacaaacaagctcacctgggaaccctccttcattgcggctcaagcccccacgtgttcgtcagattaacacttctcctgaaaagagctattaggatattattaagaattcaagattttggcaaaaattgagagaaaaagcctcgaattagtctaaagagaaacgagggttaacgcgaattggaggaagagagtgcgtgggtgggtagagtgggacgaatgctcaccaggatggatgcggccgaagcagcagctggacgaacgacggcgcacctgctcgctcgccgggatggatggggacgcgcaggcggcgggcgagctcacgaggagtcgacgacgaggtgggaatggacggggaaaaatatcctcggcagccggcaccgcaccaggatttctcctctttcttcttcttgggcacaattacgcctggaaatatgagtactaacttttttgttattgttttttttgcttattgtatatgttaatttaaactaatatttttgaatcaaatagatataattaatgatttcctagttcctacagttaaaaattacgttctaagatttaaaaattatagtggaatttacattgtaagatatggaattataatatttaaacttttttcttgaaaaatggggcactataaaatgcgtaaatatttatagctaatcctgaaaaatattggttatccagcatgtaaaaagactgcaatgtaaaataatttagttaaattgtttctcaactcaattcaaagtgagacgtttgtcaattgaacgaactttgagataataaggtgaaaagtagaggaggctaagtcaccaagacaccaaccacacacaagggaagatttgttcacatcccttataggatactagagcgggagcacgctttgcgcactgaccagcttatctggatcaaaatgcgtttgttcttttttgggaaattagctgtgttttttcttttttgggaaattggctgtgtttttttgctgtttaggggggaaaaagaatgaatagtttgagcattgaattgtgagcatttgtgaagaagggtgtcaaaatgtcgcttgttaatgtaacggcaggcattttactggaactatttagatagtataaaggcaagtcattcagctagaatgcatgcatatatgtactatgttctatagcattggtagcagatgcagtagcatcttggatcatacaatgctaaggaaggtaggtaaggcaatacttatatacaatgataatcatgacaaaaagccatgaacaaaagatcttggttctttagtcctaggtaatttcacaactgccatctgtcttctagctgggacatagctttgtacatatatataagcaaaagtcttgagatggattgcacgtcgacaactcattcactgtgtagatgaaattaagagttgtgagattaggaaatgcctttaaattgctaattagttatgtgtagataggtgagtttatgtttgaggagtaacctgtcattgcctttttgctgggcaccatccttgaacaatttcttagcaaccggaggtgttgttgtaggtgtaggcattcctctgtttattgaaatgatgtgttagttacaatggaagaaagctttattattggaatgcacctaggagtgatcaaagcaccttttttggcttgggtatctgtagggaatgatggggttgcttgtttggcttcttcggcagtttgtccctttcccttgtaaaagaagtggtggttaagtcttaatgaatgagctgaaaggaaagagatatagtagtaccttattttcagtagtatcaggcaggacaacaattgaagatttatcatgtgaggtgttttcttcagcttttgtgtcagttttgggcttgcaaaattaggaaagaagtgagagtggatgtaattcagtatgagtgacaacaagtttaagggtggctataaagtggttaccttatcatcagttttaggtttggtcctgctagactgcatgcgagacactgagacaacaatgtttttcttggtaggtgttgaagaatttgatttgctagttggggtgccctgtgttccttgagtgatagtgaacttggttggtgttgagatggtttgtcttggttgaatgggctgctgtgattcattgcttgtttcacttggtgttggtgctatttggacagagctgcttgagcttactgagacagtagctgatgtcacttgtgaagcatctggggacataaggagtagtggctggtttgaagcaccagaggatataatgctattaacttgtaggcactcttgactcatcatgacagtatcccgcgtaaagctaacattccatgcaaaattgctgccaataagtgacgtgatttcacttggaatgtattcactgtttggtggattttcttcaatgagagattctattggcctgcgtagtaggcgttgtgcgatccttccgaaaaggataaatgtagcattagcatcatcatcgccggcaattaatactactttgtacctacatgaaaaatggatatggctatagcaatgtgtggatgataattgctaaagatgtaagaagacagagcgtgttctattatgaaccttggatctggtattccgatgttagaacagctggagcatctgtagctagagccatatggttctgaagttttatagcatattcgacatgaattgtaccatcaagaatattcattgcatatccttctgacagtcacatttactataaaacatgttccctgcataagaggacagtgaaaatatcatattggtaattttattatcaaaaagtggatagatatagttaagatgtgttttagagatagtgtcaaccttgtgtttgtgagggtagatattaaggatttctgcaatactcttttcttctggtacatcttggttgtatcctgtagcaggctcatcaacccacttgattggctgaaagtttgtgctaaagctacatagaagaattgcatcttagattaatggatactgtgaaaaccttgaagaatacagtggtgcacatagattgtaagaataactgtaagtaaattaaattacctctcgtttaattctgctactttaggaatatttagattaatataccatttgcatggtgagcttccagttagtgtaaggcctatatatgtggaggaaaatattagatattgttagttacatgcagtcaatactacagtaattgaaagtttagaaagaaatgtacctaatcctctgtaatctttcataagtgttccaacaaacacaacaacttgagcttgagtttgactagcattgtatatctcatcaacatcaaaagaggttgctctttctccccagagtgtgacaggaagagtcgaattgctagttttgtggatttggaggggaaaaagtgatttaattgtaattggaagagatgaaatatg

SEQ ID NO: 9005 - DNA, 1131 bp, Oryza sativa
ccatgacattcagaaccccagagtccgcacatcctcaaatacaaagcacttccctagttagatgtaggttagacttgcccgtgtcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttgcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacgggcctg

SEQ ID NO: 9006 - DNA, 699 bp, Oryza sativa
aggacggcaggagacctgttcgctcgaggtgtctggcctgaagtgcttgccactaggagtgaggcagagaaggggacatggttgctggcggcggagtcgatttgatggtgacgcctatatgcggtgggtctcgaccagtagcgacgagaagaaggcgcgttccccggccgacggcgaggaggcgccgtcccctcggcggcggggtgaaggcctgcagacgaaggtagtagcagcccaggcgacggcgaaaatcaagagacgaggcggatcaggaggctagagtgatgttagggaaaaaggcgggtccagatcggcgcaggcccagtggacgtggaagagagggccgacgagatgaggctccatgctagcagtggagacttggaagtctattggagcatatttttttaaagtaaaatcctcaaaaattaagattcattgctgctcttcctttcaatggtgttcaatcttaattgcttattgatttgttttaatctttcctattttgttaggggagaagatctgcatgggttgcatcggagcttcaaaggttcttaattatttttagtcagatgtgcaagagctgctggaaatacttggcaggtaatttcagttcatccttctgttcagtctggcatttctctgaggagttcttctactgttatgcgttagatttaaacttgttagtgtctaaccatgatg

SEQ ID NO: 9007 - DNA, 25520 bp, Oryza sativa
cctgttgcaacgtggggtagcgttggacagtgtttggttaacattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggatttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgggttcatgaaaaatgttctatgcataaaaatcatcatgttcggttatttatttgagtcatttgttgctttgtttaagttggatttgagcatgaattgattcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagaaagattagtttctgagccctctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcgcaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttctgtcgggtcttgatgatgaattgaccaaccagttgatctctagagattatgaggactttgagaagcttgtggacaaggctatccgtcaagaggagcagtgtaacaaaatgaaccgtaagaggaaggcagcccagttcaggactccccaggggaagtgtcagaagcctcgtttcacgatgggacatcagggtggaccttccaccatgattatccggcagcaccgtccctaccacccgggtaatttcaacaagaacaacaacagtggcagtcacagcagcctcaacccgactccaagtccattaatgattccagctcagtcagatcagtcagatcagctagctcagccagctctgccagaacagcccaagaggttgggagaaaagcccgaactctgcttcaattgtaacaaacccggacacacggttggaaagtgcccgaagccaagacgtgctggacccaagtttgttcaggcccgtgtcaatcatgcgtctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaaggagaggtggtaaccttccagtctctagtgccgcggaagccagggatcagtttaaaccaggttgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccagcgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgacctgtttgatcaattgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaatgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatctttactcaacctgatttgaatctcagacagcgaagatggttggagctaatcaaagattatgatatgggaatacactatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaagggacaatctggatgggagaaagattgtgtgtacccgaaaacaaggaattaaaagacctgatactaaccgaggctcatcaaactcagtattccattcatcccggtagtactaaaatgtaccaagacctcaaagaaaagttctggtgggtcagcatgagaagggaaatagctgaattcgtagcactatgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctatcaagaatcatgtgtttacatggtgtacctaagaagatcgtgtctgatcgaggaagccaattcacttcaaagttctggcagaaattacaagaagaattgggaacccgtctaaacttcagcactgcttaccatccacaaacagatggccagaccgagcgagtcaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagtcaccactcagaggaagaggccacttgggaaagagaagatgagttgaaggccacccacccgcacctcttcgccagctcttccgaatctcggggtcgagattccgtttaaggggggtaggtttgtcacaccctgaagtttccccctctccttgctttaaaaattggctaaataaatcgtccgaagaaattatcttatttaacctagagctaattccctaattaataaatgcaattaataattgaattcggcgtggtggaatttttcttgagttccccatgctccaatgcattaacaagatttttagtggaattttcagagccttggaaataattttaaccaattaaaaatcaccaaagtgcaattttaatcccaggaaaatccttcccctctttttcttttcttttccttcctttttctctagatgggccgtcggcccatctctctccccgcgctcggcgcccctttcctggggccggcccgttccttctcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgcccctcttcgcgccccactccgcgcccgcgtcgccgcccaccttccccacatctcccggcccgtgcgcgcgctcgagagggcgggattcgatttcgaatcccacccctctctctctctccccccacctttccacgtcgccggcgcaatagggtgggttcccggccacgtccgcctccccctccgcctataaatcgttccccgcgtccttctctcgttttttcctcttttcaccgcactctcccgtgccgtctaccgccctcgcgccgcgcacccgagctccgccgcccgccgcccatctccggccgcgcgccgccgccgctagagccaccgccgcgccgcgtagtcgccaccgtcacgctcaccgagcccgcttgcacctcggccaccattcggttgccgccaatcgtcgccggagcgccgtttctctcgcacgccggtgagctctccatttccacctaactccggtcggccgctctagccgccgtggtcgctctccctacccctaaccccctctctgttttctcctagcgtgccgccgccgcccgtccgcacctcagcatcgccgggtcaccgccgcctttcatcctccgctttggtcgccgtgctcgccggtgaggctcccctccgctcccttttttttccctctctcccgtgtgcgccgccgtccttcgcgcgtgcgccgtcgccttcagccgctgccgccgcttttcgccccgtcctccgtcgcttcccacgccgccgattgccgtcgccggcgaccgtgcgcgtcgccgccggttgccatggccggccggccggttttgaagccgagccgagccgtgcctagccgccgccgtgccgtccgatcggcccctcggccgatccggaccatcggtcccgtggaccggcggtggaccacccgcgtggtcctggtccacggtagaccggccgctttgagccgctgacccgtgggccccgcctgtcggtgccgccccctcccctcgctgacgtcagccctgggacttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgccttgtttgtcgcgtaggtttcggccgtttcgtcgatccgaagtttctcgaagacgttgctgaggtcccatcagttcgagagcaaggcaagtcatgcaatacgtttgatcatattgtacccaatttacaagtatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggggtagcgttggacagtgtttggttaacattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacacacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcaatttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgctgaaagtgtgtagtcatgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctatccctcctaccatgcgccctaatgtgcccctgggagtacgtgagtcggtccgggggtatggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtacccaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcttggctgcgaacgcgctcgaaggcaaacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaagtcctgcgaggatggaacatcaagttacgacggggtgatgttttcgtacaaaaacagaaacaaaacttaagaaacctcttggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccctgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgtgcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacactagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtatgcctcaagggagcgtcggaccgagtaatcatcagcgtcagggtgcagaaggtccgcctacaattaagagtgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggactaactggtgctcccgccagcggtagcccgagcaggtacgacaagtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgtaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaagaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccaaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgaatgtccagatggactagcatctgcgccgcttggaacttctgcattcttcgggcatttcttgtaagtatggccgcacagatcacacttgctgcagcgtaaagtcctcccacctgcttctgactcatccatatcatttctgatgcgtctagtttggcgtcgaccctttttcacccttaacttagatggatctggaacataaaaaacttgggcactcagcgttgtgtaagatcctaagatcccgaacccatatatctcctcactccatgtatgaaagattgcttctttcctgaaataatttgagacgtacacattgggagatatgccacaatcaccggcaacagcaagaatgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatatactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctttttctcattgttggtgggtcatcatgtaatgcaccaagaggtatgggaggctcgtcaccttcaacttgtggtctgcgagattgctcatctgtttgcttcattgtcaactcatccaacttgtcccacaactcattaaatttcttctcttggttctgtgcacagagcctcttaaagagctccataagatgcttgttcttgaattgcttgtagaaatttgcacccatgtgacgcatggaccaccgactccgaacatcaggccatttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatacaaaagccataggtagaacctggttgttcccatcacacccaattgctgtcaatatctgacctcggtatttacttgtcataaaagttccatctatgcatagaacaggtcgacaatgcacaaaagcattgatgcaagcacccaatgagaaaaaggctatttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttataagtagcacttgtgctcggtcacaatgctaactttccaataatcattccatttacccttatatgcatggacacgccacggacaatcttccttcatgcaccttacttcatacacataatttgttgacttgatcaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacaaggggccatgaccgttcaaaagtcatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaagggggactgggctttataggggggaggcaaaaatcgccctcccccagggcggcaagggggccgcctgcaaaattccatgccccctcgccgcccatttgcaggcggccccccacacagtacaaaatcgccctagcggagggcggcaagggggccgcctgcaaaattccatgccccctcgccgcccatttgcaggcggccccccgcacagtacaaaatcgccctagcggagggcggcaagggggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatgaaaaattatttttgtaaaacttttaataaaaaaaattaaaaataaaaaaaattcgaggggaagtggggaacgagacgagggggaggcggagcgatgcgatgcggagttcacggcgtaatatgggccggcccatttcggcccaatatgggctgcgatgcggatgtaactgtatgccgtccgatgggatgatttttttttgaaaaagtacctcgtcttgttaccgaattacaaaatcgtctctcaccaaaaaaaaccagatatattagggctgttttcggcacccttttccgacccctcttccttgttttccacgcgcaggcttttcaaactgctaaacagtgtattttttttacaaaaattttcaaagtttctatacgaaagttacttaaaattcaaatataatccatttttttaaataaatagctaatacttaattaatcacacgctaatggaccgctccgttttccacgcgtactgttccggttgggaacatacaatggcgaacacagcctagttcccttaacatacaaaaccggtcatcataggttcttgggcggttttatccctgattttatccgacgtggtagctgagtcagcgtggaacccacgtgggtcccacatgtcagcgactactccctttcgtctctcttggcaaccggcggcggatgaggaacggggctgggctaacgatgggcggggagaggagcggaggtggagatggacgtggcggcggcggcgccaccgacaacggcttctctcttgccctcgtctcgctctccgtcgactccagcgcccgtgcatcctcctctcccgccgcagtgattggctgaggggtgctccaccctccgctgctaccagccctcgcaaggctgcttcagcgaggctatgacaccatcattgtgttggcggcgtggtcgatttggaaagaacacaacaacatagtgttcaaccagaaggtcaggagctggacagctagggaaatggccgaggaaacaatgctttggcgtttggccaaccccgcagtgataggctcccttagagcaacttcaatagaatggtcaaatggctggccaagctaaattttagcaaatatgaggaaaaaatatcctccaatagcctctccatccggttagctaagccatccgaatggccaaattgtacctctcactggtcaaacttagagagtctctctgcctagctattcgtgggccccaccactccccccaccccatctctctctcccggctagagcaagaaggcgtcgatggcgccgctcgtgaacggtgacggcacgaaggagagaggcactggagccagccgcgaccgcagtcgtcgtccgcgccgtccccagccgcgaccaccgtcgccgtccgcaccgtctcctgagccggccgcaacagccgtcgccgtccacaccagtcgctgagccagctgcgaccgccgacgtcgtctgcgccatccctagccgccgccatccgcttccatccccgcgtggatttgaccgggcggcgtggattcgggagaggaggagtgagagaaagaggaagaagaatgggtacagaggctgacgcataggtcccgctgtcatagactcaaagtagagaggatggatggatggagaggctattggagtaaacaacgaatttgatttgacaaatgaaatggagagttggccaaatatatatttggagagtcgaatttagagagagcgttggagatgctattagattgcaggtttcgtggctagattaggctttagctcctttcttccggttctcctatcccctgttgctctttgtttttcgatgtaaagaactgtttttctccggttaataaaaaatacgcatctaccgtattcccccaaaaaagcattacgcaacactgcgatagcgcgacgttgattcggttttacatataaacccctaatttttttacaaattggccctaccttagatggcgatgcgtttcccgtcagccctgtcacgccgccgccggtcgccgaacggcagccgcagctgcgcgggcagcggcggaggcggaggcgaaattttctctactgctcgcttacaatctcagtagtgtcagtagtgtgatagagcaagaggaaatcgacgcaaaaatcagatggaagtgtgatagatcgtcggtggtgtggggaggagaagatggccggagaggaaggtggttggtggtgtgagcttgctgctgcggcggaggccactcgcttcaaggttcgctcctttctctctcatatacaaatttgtgcttgtgtttatttgcgcaagcactaggaggagtgcgatctgttagtgcctaatttaatttcagtccctttcatcagttccatcgttgttgattgctcgtaaaatattctccgttccattcttactaattaaattgaccggacaaaatatggtgttttaggtgactggcataaatttgacctgctaaaattttattgtctgaagattattgtgataattttgactgcatactggagcgtgtaccagctagccccccaagtcaaatcagtctcaagcttcattccactcgtatctggactgctgcccaaaatccattggtgcatctacttttgagttcacatgaaaatccattggtgcatctactttgagttcacatggttcacatggtgattacaagttcatgtctgataatcttatgtgctttctgatgttgactaatcggctttggctctgtagaaagtaatgaaggtagaaacacataaacgtgggaatccttcgtcttactttttgagaagaaaattctggtttagaaagagttacctcatgtagacgtctttctctctgctcatgtaaattcatgtaaatcgctttcaatactagatcagaaaattcatgtaaattgctttcaatacctgcacaaatttcttgtagacgtgtttctctctgcttcgttccttctttatcatctctagaatcctggctcactatgcaaaatcccatcttgaccacttgctcctgagtcctgatagagcttggcttggtatggagattctgatttctgctgtggcaggtgaacttatcagccggttcatctcttcgctacaacaatattacagcaaccacacaagcgaggaagatgatcgtacaaggttgcagcggatcttgctcaggatgcactctgttgttgaggaggcagaaggacgccacatcacaaaccaggggatgctcctacagctaaagggacttatcgagggattctaccatggttaccacattctcgacaaggtcaccttccaacccccagaagaagagagcatcaaagatgaggtgattcacgagataaattcatctgccttgattacttcgaattcggccaagcggtttcgttttgctgatgctctaaggaaacacacaccaatttcctttgctagcaggagcacaacaaacctgaaaggtgttgttgaagatttagaaactaagatcgcggatatgagagagtttgtcatgctcctaggcagctaccctcgcctacctcgccagccttacagtacatatctgttcatggataagtgtatgtttggtcgccgtgttgagaaagagaaagtcatcgacttcttgctttgcagtgatcttcctgatacatatgtcagcattcttccaattattggtccacacagaattggaaagaaaactcttgtgcagcatgcttgccaggatgacagggtgaagagctgcttctcccatatatttttctttaaagaagatgatctgaagatgggagagctgttgcttaactccaaggcttctccagggaagtatttgtttgttattgagttcatttgtgatgtgaatgaggcagcatggaccaaattccaatcatatttgcagaatatgcccagtactgaaattaaggttgtaatcattggtagaacagatgatgttactaagtttgggacaacccaacccatcaggatgaagaggctgtctgaagaagagtactggtactacttcaaggcactttcttttggaagcatgaatcctgatgagcatccaaagctagcatctctgggcatgcagttagctactgagatgaatggatcatttcttggtgcaaatatactaggtgaactcttaagagctaatcctaacactcaattctggcagagtatcttattaagcttaagagggtttgtacaaaagaacttgtgttggtttggtgtacaccctgaagatcttcttgaaagaaatacccctgttgatttcaccaggatggcctttcttggtgctcaagttcatggttgcctggtttatgatcttagggtcgctggccctgcacaaaatcagctaccaaaactaacgtcaagagaagtgttattgggaggtaatattcccgtcgaacagaagtttgatgtgctggtatggaaatctggcattccaccatactgtgattacatagctacttttgagaaacagaaaccacggcgtgtggttgggaagaggaataccatctaccactgagaaaacacaagctcaaatcttaatttgggggagaactctacaaattaagaaattatatcgtcggtaatgtaatttaaaaggcttgctctgactactattggaataatttgtacagttcagatcaatgtagcacttgtgtctctactgtaggttaaaatgtgtatatttttattaagaaaaactctgttgtatctgttcctattagtttggatatgtgaaattcagtcagttacagttgttaccctgacttgtatttgcatgtatgacggaaaccttttgtaaagaaactacttcatgtttctgactatgtgacctatgtatgaacaatttaatttacacaatatctgtttgggcatagttagtttcagtccctttcatcaattccatcatggtcagagcctgccttgcttgactttctaaattccaattaccctaatggtgcatttctttatagacctctgtttagataatttcttcctgattttctcttgcaaatcacaaaggatatgttcatctctgcagttgcaagtgatctttcagccatttcatctccttttggatccagaaatttgagaagcggcacacaacagtggaggggaaggaatcttgataggctgaacagcatccttctaaagatccacaccatcgttgaggtctcatggcagatcacaacctgaggaatgatcctccagttttggcgcctatggtaggtacgttatttgattagtatttttttggcacgtcaagttgcagactgttggtgaggaggtagtacttgaagatcattctcaaaacgcctctgtttatggtcagaacaataagctatgaagaaaaaaaattttgttttaggtgtaaaaaaagatagggaagcaaattagtgctgatagctttcctaggttatataggctgtatgtacctttcaccaattatccacctttactgtagttattcagacagttcagggcatagaggcatgagtagctactgtagctaacagatgtttctttttttaaaaaaaaagaagaagagaaaataatgatgtatatgctcttactagtctgaacatgtaaatgcagtcagtcactattgctattagtactatgaacattacgtataccttttgaaaagaaactactccctccgtttcacaatgtaagactttctagcattacccacattcatttagatgttaatgaatctagacatgtatgtgtttagattcattaacatatatatatatatatgtatgtgagcaatgctacaaagtcttacatcgtgaaaaagaggaagtactttatgcttctgactgttgtgtcctcatatgaccaattcaatgcaccaatatatctgttatatattttgccgggttggccgaaagattcggtcaaccaatttcatgaagaaaggaagggtacattacaattaaagagcttacaacgactgttaaatagtgcctaactaatttcaatcactttcatcgtagtcccagcagctgccttgcttgactttccaacttcctaacaccttaatagtagtatttcgtaacaaacttctgcttacacaatttcctccagggttaggctcacaatggacatgctcatctctgcagttgcaagtgatcttgtgagccggttcatctcctacctggtccataaatctgagaagcagcacacgacaacagagcaggacctggagaggctgaagagtgttctcctaaggatctacaccatagttgaggaggcggaggcacgacaaatcaggaacagaggaatgatccttcaactcaagggtctcatggaaggtatgtttcttgggtattatgttcttgactccttccagttccagtgtgttgaagaggagggtgtagatgaagatcaccaggtcagttgcaagcgccttcggttcagtacctgcacaaggagcacttcattgttatcactcggtacagagaacacacctgtgcttaagaatgttattgaaagtttggagaccaaaatttgtgatgtgagggagcttgttgtgctgctagccagttgccctcgtcttcctcagcaaccctattgcacatatctgttcatggaaaagagtttgtttggtcgccatgtcgagaaagagcaagtaatcgactttatactacatgatgatcagaacctggctgtccttcctatcattgggcctcacagaattgggaagagaacccttgtccatcatgcttgtcaagatgaacgggttcgtggtcgcttcctgaatattgttttcttccatggtgatgatcttggaaacatttcattaatgccttcaacgaaatacttgtgcatagttgagttcagttgggatgttgatgcggaagcatggaagatctttcgatcatctatgaagaaggcagctataagtggcagtaaagtcattatcataggaagaacagatgagattgccaagtggggaacaacaccagcaatcaggttgaacagattgtcaccagaaatgtactggtactacttcaaggcactttcttttggaagcatgaaccctgacgaccatccaaagctggcttctctaggaatgcaactggcaacagaactacagggatcatttcttggtgcaaacatacttggccacatactaaggggtaatccaagtgctgaaatctggagtgggttcttgatgagcttgaggatgtcacgaaagcgcttatccatcttcgaggagcatcctcctgagaagaaccacccttctcatacagctgaagtagcgttcatgaattatcgaggttgtatgttgtatgatcttagggaggctggccatttccagagtgatattcccagattaacaccagcaggagtagagctagaaggcaaaattccttgtgatttggggtttgatgtgctggtatggagatctcaaatcccgccattctgcaactacatagctacatttttgcagccaaagccccggcgcattgtcagaaggaacaagaatcccctggcagttagtattacttatcaatcatgatcttgtatgaaggacatatgccctccaatttctggtcgatctgatcagaattcggatggtcaagatcgattgggatggtaaagaatctatatgcataacaatcacagtaacctgtaacttgttccagatactagtgtacctgtacatccgcttcttcttcttttttcttttcttttttttcttttttttttgctggtttggatgtgtgtagtttaaggtagtaaggaattgatgtgggttttaaaaaataacaattatttcctcgtttcttttgccccatgttctatcatttaattacttcttgtgaaagggcatgtagcctagtgattgcagtgatctgagtagcacctaagatcctaagtatgttgggtccaatttctctttcttgttaacttcttagccttattttcttacatggaggaaattggaatgacctgcatggctgcatgtttagcttgcgggttgctgttggatttgtgaaaattttgaatgagaattcgccgtcgtcttgctcagaacggagcatataatattatagagtaatttagtgagtaagcgtcatgcatattattacagttagcatatattcattggtgtcgtgtttcatattgttgtgaactcgaatacgatgctaattctgcgaaatttgagggccgtgaaatagattaatatgcttgtagctgacctgtaaacctgctacttaatctgttgtacttgtaaaatgctctacatatgggatcatcttaaaaattcttaatcgactaaccacattactgcaccctacataggtgttcacatcgctgtagttttgataatggctgtcgattggctatctcgatgtgtaaaaaaggaaagccacagaagtgtacaacacacaagatgttgattattattattattattattattattattattattattattattattattattattattattattattattatctttttaaacataataatagagatgttcttaccaacctggttgcaagcactagcagcctgtgccctcttctcagcttcctagggagcatcattgacaaatcacacccttctgatgacttcgcgctacaaaataaacaaacctaatatagaacataacatatatcttagtattacaaatctacaaatctggatagaacatattttttttatagtaacacagtacaaatgcagacgctcacaacacgtgcactctcatccctataaacacacgcacaccctacttctatgagcacctccgaaagactggaccaacgtatattgaggttaacaaagtcaccacggacacctcattgttctaacattgaaagaataattagccataaatgctagttccaccaataagaatctaacttgttgagttacggtcacttcgctggatatatcatatatcaaatgttacctcacatattacaccacatattagatttgtttaatttagaagagagggagtaagaaacaatgacaaaaggtatccaacttgttaagcttcatctttgtttgtactccatatataaaaatagccgcagaaatcacctgagatgtgtaggcctcgtgttctccacgcgcttctcgacttggcgcctcgacgagcacgagcatggctaccaccaacggcgatgccgagctcaccgtggcggaggaggcaaaggaggaggaggaagccaccgacgacggcgacggcggagtgagctcccagtgg

SEQ ID NO: 9008 - DNA, 4250 bp, Oryza sativa
tacagggtgagggtggtggtggtcgtcgcgacggcgagcctcgcgctggcggcgttcggcgcggcaggggcgcggctgggccgggctcccggtggccgggccgggcttagggcgtggtcggagggttgctggccatggccgccacctatggcgtcatgaagctcttcagaacacatggcgtttgatgaagctgaatcatgattaagttgacatgatgtaaaattatccaaatgcatagagacacggttttttttttaaaaaaaaaaaagcttcggctaaacatggtgagacttaccgattagtgatgcaacatgcgttcttgcatttcacaggtaaaaattgcttctgcataagaagaccagatatgaactggttaccaagtttgtccatggatctgaatgctccccaataaacagaggaagattgcaaattcatacattttccactgttccacaccataatctcatttcttgccagaaaaaaaggaaacgtcagactgtaccagaatggaaacaacgaaattctactgaaccaacatggttgaactgaaccatttgattgcatctcactgcctgcatgcgctgcagataatcatttcagctttacaaaatcccacagcctcagatcatctcagagcagctgcatggatggatatatatgtcatcccgtaaatatatatagagttggtaacatcctagtagctactagcttgcttaaggtatagatagtcagctaacgcgcgctacatatataatatatacaaaacgaaaactttcgtcatcatactatatatgctaaggttctccatctgtgagtttctctcctagattggtgccgctgacctgtgttttgccgcgatttagtattgattctttaacctccctgtatttcttcagctcctcaagggcgtcagttgccgtcaccggtgtagaacttgatgcgatgctgccatgttcctcagtcacgaccttctgaactgacgaaggttcttgaggaaccacagcagctgcatctgactgtaggccttctctgaggcttggtgcagtcttcagcagatgcacaagagcaccaatggctgcagctggagaccttgtggacgagccaccagcatcttggttcttctgttcctccctgtctgagatatcagccctggaaaattgaggaggttccagttttgcttatacgaagacttatatagaccccaaaaggtaattgaaaaatcagacaagcagtaaatccacaatatagactctttcactaccaaatttctttgagcatgtactggccattatgctcttctttaaaaaagaaaacaccatcttgctcattgctaagccttataatagctggatataatgggatacaatcaaatatgtaatttgataaatttattcctaacattagtaggctagcacaggaatattgaagtatctggttcaagaggtaagctatgatgacctgttttagattgttgagttagaataagttgcaatttctggaacattgtagataaatagttataaaaaaaagctaaaagtagttaatagacacagattgtcctgtacagggtaaatggagggtgggctaagataattattacatgataaaaggataatttgtgcagtgacattataaagtaacaggctagagattgtcagctcctcagttgaagctatatcagtttagtagaattaagaccgtaagctgcaaataagttaggtgcaggaaacaagtagaggattttaagacaactgaccttcattttgaatatttgatttatatctacaaaatcatctcagttccatgcctaaatattaaaattgatgtacatttctatcaattatctttcctaaaaaaaccactctggtttgggttccagttcatagtttgcactgtacattgaaatctagcctgtaatgcaattcatattcttatattaatttttcaatgtaaattactattctcattagtcaccagaacatacacgtgaacaggaaaaatataaaattaagcaaatgtcggaaataagaaactaaggaataacataaattaatgaatagtagttcaagagtacaataaaggaagaaacattatattgccaattagtatgagaaatagatttttttttctggttcaggtaacattgagacaagaaattatgtgactattgagcatctaatctagaatcttgaagcaagcatagtgcctcttcagttctcattaagaagagcccactttgaattaatgaataaatttttaactataatcaaatgcaacaataaggttcacaggccttaatgagcattacaaaaatatagcataaccgtctttaatttgaagaaaactacatagaacacatttctgcattgcctgaaattaaataaccctttcttggagcatgtgcatattaagggcatcattctggaaatactcaggtgtcaggcatagtctcacaaactacatactatttcaattaggtgactaggaaagaatacctgttaagctgatcaattatggtgtctctatcttcccatgcaaaaaccaattcatgttcatccagttcatccataataaaaagtttacttgatgtccgagtcaatttcagtccatgaaagtatcccaaatcatatttactgtaagataatacctagggcagaaagcagaacaagaaaatcatcagccaaaaatcagatccaattatcctagggtaggaatctcataataaaattattgttattggctcattgcaaatttcacatgttgcttgaacaaataacagatatcaattaccttttgcaaggccatgtccttttcaaattcacccaacctgactagatccttccttacatttgagttatgatcaggggaatgtgccaggttgtcattgtgagatgagaactggtgcttacccttcgaacatggagaaggaggcaacccgctacctcctcctccgcctgacttcaatgtgggaatagtaactggtgcactctcatatcggaacaaagggtttttagggtagttagctgaaggggattgggatggtgatggtgacaatggtggtgatggatagcattcttcaaatggtgtatatttcttctgcccagaggatgatgcattttgtggatgtgagcatgtttttagagaaacatgcagaggaacgcctagctgtgggcttccacgggattgtgccttagtgggagaaggagatggcgacactgacgttccagctccatgctcaatactccaactgtgcctcctggtcattgcagcacatgcaggtgcaatgccagctgaagggagggaattgaatttctttagaaagtcagttgtggggctcccaacgtaatccgttatgatctctggtggcattggtgatgtaggttctgaagctgccaccacctccaacactggcacataagaaactgacaagctcaatcggccaaacagagtttcaattggagcaaatgcatagtgtttcatctctgcatcctctgcccgggtgaatggctcaacaaatgaagatatcttgtgtgacaggttgagaggacggattctcccagatgagttcagttccctgaagagactgtatgctggcaagagcctgacgagcagatgcaatgaccggagtaacactgtcgatccctggtaggtagccctgtacaagctatgatcctcagccgagctgttcctagacttcctgccattgttcttgctgccattaccattgccaccgccagacttgcgagcttcatactgtatcacccacctctctattatcttcccactcccagcagctgtgttgctggtgctgtcccggcataagaggacaatgtcaatgaccaacggctcaaggttgctctgccgccacaggtcaaagttctcgagcacagccgggcagtcccggagcgcaaggttgaaccaccggtcgcgtggctggctcccggacagcggcgaggacggtggcgagggccgcgtgaagttgcgcgacgactcgtacggagagcgcgactccagtatgatgtggaggctcttggcgaaaaactcggtgatcacttgctccaccatgggtggctccgcggcagcagccatggtatcaaacacctagtgtgggtgcatctgggttcagctaattttgctttctttgggaaaaaaaactatgctattaattcgagctgcgtctccaatcttcgccacgccggtggcggagggagaagaagaacgagtaataccttatccggagccaatctcgc

SEQ ID NO: 9009 - DNA, 5818 bp, Oryza sativa
ggccgacggcccatctagagaaaaaggaaggaaaagaaaagaaaaagaggggaaggattttcctgggattaaaattgcactttggtgatttttaattggttaaaattatttccaaggctctgaaaattccactaaaaatcttgttaatgcattggagcatggggaactcaagaaaaattccaccacgccgaattcaattattaattgcatttattaattagggaattagctctaggttaaataagataatttcttcggacgatttatttagccaatttttaaagcaaggagagggggaaacttcagggtgtgacaaacttcagggtgtgacagtgtgaccgtcctttgtgcgattgtggggatggatgcatactcaagtcttccctcatgatacaaactcggggcaggagattcttccaatgcgtgaactttgatcaggtatgcttcatctattcgaagttcaaatggataaaaaaactaacttcttcgtacacaattgtaacatcttacgcagacatatcgtccaatgtgcaacttcatcgagtaggtagacatggagaacccacaaaacgacggaacccgtgcttacccacgtagtgaaacaagatcggactacctaaggcggaaggatgagcatgaacgtcgaattgctgctgaggctttagaatggcacgtaaatccccttggactccccacgtggcgtgagcgtccgaagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatagattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactaaataacattactatttttacagggcaatccaatgatgggtggatttactcgatggatcgacaatgtcactccatcatatcatggccagaagataacagagtcagaaacacaagtagagtatcaacgattgaaggaccacgagaatgcaatgcattctaaccgacctagaaggggccgataggttactgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccaagagcgaacggccgtctgccacgtcactttcgctgccctctgggatggcgatttttaaaaatcgccctcccagagagcggtaggcgaccacttctgtcaattttcaaaatgaaaaattatttttgtaaaacttttaataaaaaaaattaaaaataaaaaaatttccttcccctcggccttccctcgtctagggcttctcgtcctccgacgacgacgacgcgagcacggcgatcggtggtccggcgcggcaaggttcgaccaccgcctcctgccccctacctccctaccttctccgttctggttttgatttttctgctatctctcgtctgcgcgccctgtgtgaattggctagatctagtgaaaatggctcgctcggttgaatcgagttagaacggccagatttgttggtgagtatgcactgcgggttgaaaatactggtaatttttcgttagaaattttgcccaaccatcccttccttggatcaacctgctactcgaacccaaacccttgaggtacagtttgttctttcatttcggacttctccatctacattcactaatttgttatgagctttatgatcattgcggtaaatagcaataggaagatacataacgtcacatgttttacgagggcaagtagtagatttagcactaataatgtgagcttatgactggacattcatccgcatatttctgcgtcacagataactgcctgcaccgaatatttccacttcagctctcttccttttttgatattgattgagtttctctgttctggagtttatcttgtttatctgtatagttgtgttcatgtgaatctgatgttatagggtgaggcaatggtttctgcaattagtgggggacttattttctatttagcctgccatgttattcaatcttttgttcaaatgagaaactttctgtaacacttgggagtatttatcagtcttgatgaatttgttccatttcatggttgtgcagcaacaatgacggctggatacattgccggttccctggttggatcatttgccattgcttacctgtgtgacacatttgtttcggacaagaaggcatttggaggtgactgtcctcttacggaaatgcctgtgcttaacctcttgtctgtatctaaagctgcattattttttttgtaaacaggtagcattccaaagactgtttctgagaaggagtggtggctagccaccgacaccaagttccaggcctggcctcggaccgctggaccaccggtcatcatgaatcccatcagccgccagaacttcatcgtcaagtccgctgaataggcgaaaccgtgagagaagctggttcagcgtcttgtttccatcacggagctgaaggttattttctaggtcttaaaactgtaataagacatttttgcagtttcagtcatatcggtgagcaaattttggggcttacagcttacttaacatttgatgagttctgttcgtttgtgaaaattacctcctaggagcaaagaattgtattgttctcctattttgctgtgttcttttgccaatctgctgcttaagctcattttgtggcgtttccttgccttctgtttccgcactttggaccagtgtttgtgcatgatttatgcttgaaccagtattggtgaaaccgtgaaagcgattttgtcagaccctgtaataatgtcatatatcctgttgtgcaagggtctcacaatgcttcgatgctcactgaagactttgatgaaaacctcattttcacccgtatgcttgcatatgcatatgatctgatcagttggttgcgagaactctatgccaaaaaaatgttactacaaaaatgttctgcgtctgctagcttctctgcccgtttctacaacaagctgtggctcaggaggaaagcaaaccaaaacaattcaacaagctgtgctcaggaaaacacaaggctatgttttcggcaggaccaaacttcatttgatggagacttataattctctattatcaccagagaactgttgtacatgttcagtccatattctaccaaagtcttctctctccatcatcctggcttagcatcagagatttcatttacaatttgttctaaaagccagctccccgtggaagtatttccttgtttatctccttttctccaaaattaaccagtttattttgcagaaagcaggtaaacaactaaacaccatcctacaaattttgccgctaagcgggtaaaaggagacgacgggtcaatgcttttatcatgaaccctaccatccatttatccacccaagagcaaagttagaattgttcttaccgcctaccagataaaatagacacatgcgaaaagaacttgcaaacaataattggatacattatgtgagtaaaatccacacgaccaagaatttgtgtgaacatgtcagggtttggaataaaatacaaaagcattttttttcgccgggcaaaatacaaaagcatttgccttcagcctgtcaacaaggagtacgtagtgtggcaatattccacaaaagtcagtcttccttgtggtaacctcagaagtctcaacacaacatctatttggaagacgtctgaaaaaaatataaattatttgcttggatttcaaatcaaaacaagatcttaatagccgaaaattttggctaagcgaggattgtcataccacgtgacctctaagctttgcaaccaacatgaaagactagtatgcatattcttcggcaaaatttgcccttatgcccaggaagtttggacattgtttttaaggtggtaaattgcaaaatcatggagagagcccagccaaaactcgttgacagtttcgcaagctggtggcatgaagcaatgtcctagcataccaaaaagagatggacaagaagttcaacagccctgttgatgtacacatgttggaatatttgaatggagaggaaataaacgagtcctccaaaatgaacaccagaatttgcgagatgtccacttcaagatctaggacatcaagcaaaaagagagatccccagtttcttagtttcttggttgctggccttaggagctgctgtgggtttggttttggcctttgtccattgagtttgtgatggagctgctgctggaggaacattccttagtttgtgatggtgtggatctttaggacactcatcagcttctcaaggtcctcctttattgtctgaactctgcaaggagatgaaatggctgacatgatcacttttgcaactacagagatgagcatgtcctcttcgaatttgcgagaccaaaccaggaagaaattaatcgaaacgaattcctgtaaacaaacatatcattaaagtagttggaatatagaaaggaaggagcagtgactatgatggaaccaaccgatggaaggcactgaaactacatatattgttgtacattaaattggccatacacaggacatcaaagtcagaattcagaaacagaaagtagcttcttttgtgaactatattgtcagacacatgacgctagtagggtagcaatagtaactaacagaattttacatactcaaactagtaaaaacagatacaatagcggttccctaagaaagaagacatccatgaacctgcaatagcatgacatatgctcctttcacctaaactgactgaataatcagtagtagctagaatctgtgaaaggcatacccagccttctaaactatattgtcgaagcgtagacaatgtaatttctttctagaaatttttcccccagattaa

SEQ ID NO: 9010 - DNA, 7429 bp, Oryza sativa
atgaaccggctgataagatcagttgccacagcagaaatcagaatctccatgctcaccagagctctgcttggaagcaaatggtcaaaatgggagtttgcaaagtgacccaggcttctagaatctagaaggttacaaagaagtaggccaagagaccaagacaagtcaacaagaaattaaagtctattattatcaccagagaagggttctacatgttcagtctatctcctaccaaagtagcttctccctccatcatcctcgtttagcatcaaagctttcatttacaatttgttctagtagccagggccccatgaaagtatttctttgtttgtccccttttctgcaaaataaaccaattctgcaaaaggagacgacaggtcaatgcttttatcatgaaccccatcatccatttatccacccagaacaaagttattgttcttaccggttaccagataaaatagagtaataggcccatgcggaaagaacttgcaaacaataattggatatattatgtgaggaaaatccgcacgacccagaatttgtgtgaacaaggagtatgtagtgtggctttggaataaaatacaaaaccatttgccttcagcctgtcaacaaggagtacgggtggcaatattgcacaaaagtcagtcttccttgtggaattcaaaggttacctcagaaatctcaacacaacatctatttggaagacgtctgaaaacaaatgtaaattatttgcttggaattcaaatcaaaacaaaatcttaaaagccgataatcttggctaaacaaggatggtcaaaccatgtgatctctaagctttgcaaccaacatggaaggctaacgtgcattttcttattctttgtccttatgccaaggaagtttggacattgttctaaggtggtaaattgcaaaatcatggagagagcccagccaaaactttttgacagttttgcgagctggtggcatgaaagcaaaaaagagatgggagaggaagttcaacagccctggtggtgtacacatgttggaatatttgaaaggagaggaaataaatgagccctccaaaatgaacaccggattttgcgagatgtccacttcaagatctaggagatcaagcaaaaaagagagatacccagtttcttagtttcttagttgctggccttaggggctgctgtgggtttggttttggcctttgtccattgagtttatcaaacctcagcatgtagtgtgccttgtaaccacatttagtctttgctatctttcttctataatgcatcacggcagagctcctgcccttttctctaaagaagaattgatctcactgagaacaaagtcacttgtgacaatgattttcaactacagcctcttcaacaggctgcaactttgatgtgtaagaataatacccagggtacatacctaccataggccccttgaactggaaaaacattcctcagtttgtgatggtggtggatctttaggacactcatcatcttctcaaggtcctccttattgtctgaattctgcaaggagatgaaatggctgacatgatcaattttgcaactacagagatgagcatgtcctcttcgaatttgcgagaccaaatcaggaagaaattaatctaaccgaattcctgtaaacaaacatatcattaaagtagttggaatatagaaaggaaagagcagtgactatgatggaaccaaccgatggaaggcactgaaactacatatattgttgtacattaaattggtcatacacaggacatcaaagtcagaattcagaaacagaaagtagcttcttttgtgaactattctgtcacacacatgacgctagcagggtagcaatagtaactaactgaattatacatacccaaactagtaagaacagatacaatagcagttctccaagaatgaagacatccatgaaactacaatagtatgacatatgctcctttcacctaaactgtctgaataatcagtagtagctagaatctgtgaaggcatacccagccttctaaactatattgtcaaagcgtagacaatgtattctttctagaaaattttcccccagattaagatttgtgtctgtgtattctcagaggtagatcgtgttcctcttacgaaccatgcgtcgcggttttcgtttctcatacgtaactatgtagttacagtagggtggaatgcgagatctccagaccagcacatcaaacttatcttcgacaggaatatcacaacccagtagcatgtctcgtgatgtcagttttggtagctcaccatctgcagggccagcgaccctaacatcataaagcaggcaaccttgaacttgaccatccacaacggctatcctgctcatatcgacagggatatttctttcgaaaagatcgtcagggtgtagaccagaggaagtcaagtgcttccgtgcaagctctcttacgaataataagattctcttccagaattgagtgttaggattagctcttaatagttcaccatatatagttgcagaaagaaatgatccattcacctcagtagctagctgcatgaccagagatgctagtttcggatgttcatcaggatccatacttccaaaagcaagtgccttgaagtagtaccaaaactcttcttcggatggcctcttcaccctgatgggttgggttgtcccaaacttagcaatgtcctctgttgtacctatcactacaaccttaattccaataccgggcatattctgcaaatatgattggaattttgtccaagctgcctcatccacatcccaaatgaactcaataacaaacaaatatttcccttgagaagccttggagttaagcgagagctctccggtcttcagatcgtcttctttaaagaaaaatatatgggagaagcagttgcgcaccctctcatccaggcaagcatgttgcacaagagttttctttccaatccttggtgggccaataataggaagaatgctaacatacggatcatgaggatcattgcaaagcaagaaattgatgacttgctccttctcaatacggctgccaaacatacaattctctatgtatagatatgtactgtaaggctgacgtggtagacgagggtggctaccaaggagaatgacaaattccctcatatctgcaatcttagtttctaaaccatcaacaacatctttcaggtttgttctgctcctgctaccaaaggctattggtgtgtgttttcttatggcatcagcaaaacgaaagcgcttgcgagagttacaggctgacaaggcaaatgactgaatctcatgactcacctcatcttcgatgctttcttcttcagggggttggaacttgatcttgtcgagcacgtagtatccgaggtagaatccctcaataaatccctttagctgcaggagcattccttgatttgtgatgtggcgcccctctgcttcctcaacaacacagtgcatcctcagcaagatgcgttccagcctcctacgatcatcctccttacgtatatggtttctgtaattttgtgctaccgaagagatgaaccggctgataagatcacctgccacagcagaaatcataatctccatgctaaccagagctctgttggaggtcaaaatgggagtttgcaaagtgatcaggcttctagaggttacaaagaagtaggcaaagagaacaatacaagtctacaagaaattagtaacaagtactggaagcagttcacacgagatggctcttcctgagccagaattttctcttcaaaaagtaagacaatgcattttcaggtttacattaggcactaacagatatcattgtacgttgaattgttcgtatgaggacaccactgtcagaactcagaagcataaagtagtttcttttcaaatggtttttttcatgaatatagtgctagtcagagcagcaatagtaactgactgtttttaactatccaaattaataaaagcagatacaacggaacttttttttcaaaaatcaaacacttattagatacagacatagaggacagacacatataccagtttgacctgaactatctgaatagcttgcagtagtggtgagaattggtgaataggttatctgagagagagagagagagagagagagagagagaaagaattggtgaaaggcacatccagccttttgcagtatgaggtccgtcaattgtcaaagctgtaattccttcatttacgaaaaggtaaattagatatgatttaacagctatgttccttactttcctgtgaaatagacatgaatttacatgcattcaggtgtaaaatagtttgtgctcaaccttccaagaggaagatatttttcaatgtgcttacaaacagtaccatttgtagtgaggttcaaagtgcttacaccttgagtaaattccttaactttgtaacagagtaaatggtaataactccttaagttgttcaagccaccttatcaagaacgaaggaataatggaataatgcgtttaaatcctgatccagccaaagaagatgaacagagcgagatccaaagctccagaggtgtcgactcacctgggggcgcggcggcgattgaccggagcgaacactgaatccggcggcctccgatgagaatcccagggaacgccgagaaatgcagccaccgtgctcgcctccgtcaaaccaccttcttcctctccggccatccatctctctctacgttctccactgattttttttttacgccggtttcttcttgatccagcactctattaaaattctggggcgaccagtggaggaaacctcgccgccgccgccgcccggcgaccggcggcggcgggatgaagggaagcgagggctaaacgtacaaaaagcgccatctatagtaggataatttgtagaaatgatagggacctttccgcaaagctccggatcggtgccatagcgaattaacgatcgtaaaagggatcattttgtgtaattccatcaagaggggtatatttgtaaaactactgaggtaccattggtagacggtagtaagagcatccccggtagctcatataaatttcattctctatattcacatttagatggtcatctaaaaagattctcactccatatttttcttcgctccaacagatcatccatattacatccttcatatatattttaatgtatatttcaactaccatacatttacatttcctctcatcctctcttctattctattctactgctacttcgatgggggaggaagaggttgggcgacgggagctcgttgggcggaggaacagcggggagtcgccgggcggaggaggaccggtggcgcggtgctcaccgagcggaggaggcgcggcacgggcggtcggggcggaggagccgcggcatcggcggcggggtcgcggggggaggagccacggcaccggtggcggggtcatgggcggggagcggcgcgggcggtcggtcgctgagcggaggagccacggcatcggcggtggggtcgcggtgcagaggagccgcggcaccgtcgacagggtcgcgggcggtcgcggcgtggaggagttgagaagcggtggggacggccaggcggcgttggtccttcgagcggtgggggcggccgggcggcgtcggtccgaggagcggccgggcggagaggaggcgcggtcggaggagcagcggggcgacgcggtcagaggagcggcggcgcgggtggacactccggtgctctccccctccagatccaccacctctccgcctctactccggtatgcacttcctctttacctctactctcccgccggttcttgtccaaatggtgacgcgagtttgattgggaggtgagcagtttaggattgcgtgaggagagagacccgccatatttggcttgggaatggctcggtttggaggacctccaaaaatagcgtgtgcaatggaggctctgctggagcactgtttttctcctccatgcgccaaacactggatagatgactagatagaggagctgctggggatgctctaatatgaccggctcatcgtttgccttacatgaattcagcaaccgtcaaactttaaattttaaaacatatttttttctaacgcagttttttttcaccattggttttaagttactaagtacacatatataaatgttttactcctaataccgagctagctaatcgatggaatccttatagatatgtcaaaaaaaaatctatttacataggtcatatcattggattcaaatggactggactcttttagacaattagttatagacctacgcattgtaacgtctttttattcagtttagtggaaaggtttggatcgagtgggatgtttgttttttataagatggttagtttttcaggtgaaatttttttatgggaggaagagattttcaagtggaagtggaggacagatgggaccaaaggacaacatctccctttattaagagcgagatcaatagtacagcctactgacagtgataaatatcatctacatcagctatagtagacgtagcagctagtttttacaataattgattctaacatgtttcccaactctgaaagttcattaatttattttcattaatttattgcttttggctaactgcctcttttctctctttgccatgtttctctccaagactcccatctactgcaaacagaccaataaaatcttctttgtacccaattttgccttggggacatcaaggctgaccaacaacgctgtgctcataggccccatcgttctccactttattaagagcgagatcaatagttaatgccaaaatttaaattttaaaagttaattttgaagttttttcatcaaagtttatatttcaagattggtgtttaagtcgctaaaaacatatatataaaagttttacctacaaattattattattttgctaatacgccatatggcatattatctgtatttggccaaacgatgggggcaagcgagcagctcgacgattaatctaccaccgacttttctctctcttcatgttctctctcttccaaccctgctttaatctggtatggattttggtgcagcctactgactagacttattatagtagctctaagtagtggagacataggtatcctccatatctccgctacacatcaccaccactggccaccatggccaccgctgacttacctatatttggtgtcaacaatgtaaacatatattatgtttttagcatggatgataataaacgtgccataaggctaaagtggcaactttgatatgaaattaagttagttcacaatattatttcaatatacacattgtttacagtttatttacacgtgtaattgtgctttgtgttctctgtgcgataaattaatgatttgatcacggtacatatccttcctatgattattatcatttggataatacatgtagtgtgttcatgattcatgaacagatttgtgcaatagaatgacaaactttgttcacatcataaatttttaat

SEQ ID NO: 9011 - DNA, 36528 bp, Oryza sativa
aaatttaaacccaaaagataaataattttggttcttaatttttgacttaaactcttatatggatttaataaaaaaattcaaaaacttaaattttgtttttcaaattttacatcaaataattatgtcccattgattttgttgtaacttacagtacaatttttcacactgtgatttatgaagtaggtagcatgtaagtatgagaaaggggcaatatagttatttttgaaaaaaaaaaagtccaatagtcaactaatggaacgaaggtagaggagatcaagatgaaaactcgaggacacgtaggggataaggcagaacttacggatatgtagggaattttctctttactggccaaaagggccttcccgtaatctcatatatctctttacttgattaggccaaaagggccttcccataatctcatatatgagtgcatgcattttgttctacatgtttggttcatcttctaccaaagttttcttccatcaatccatcatcatcttccaccaaagtctcctccctccatcatctcccactaaagacttattgttagacatcctaccagcatgcatgtgagaagttttcatttttacgactttgtctagtagaatgaaagtgtttctttgtctaactatctccttatctgcaaatagaacaataaatgagtcagcaacatattttgtaaaccagcccagtcattcctggttatgtacattgaccacagcatgattgtcaaacaaggcatctggcatgatatatggagaatccagccagacattaaaaaagttgagtcactgtgagttggggtggaagagaaattacaagccacactaaccaccctacatgcaaattttgccagagaacaggagatgaaatggctgacatgatcacttttgcaactacagagatgagcatgtcctcttcgaatttgcgagaccaaaccaggaagaaatcaatctaaaggaatgtctgtaaacaaacatataattaaagtagttggaatatacaaaggaaggagcagtgactatgatggaaccaaccgatggaaggcactgaaactacagatattgttgtacattaaattggtcatacacaggacatcatggtcagaattcaggaacagaaagttagcttcttttgtgaactatattctgtcacacacatgacgctagtagggtagcaatagtaactaacagaattttacatacccaaactagtaaaaacagatacaatagcagttctctaagaaagaaggcatccgaacctacaatagcatcacatatactcctttcacctaaactgactaaataatcagtagtagctagaatctgtgaaaggcatacccagccttctaaactatattgtcgaagcgtagacaatgtaatttctttctagaaatttttcccccagattaagatttgtgtctgtctattctcagaggtagatcgtgttcctcttaccaaccatgcgtcgcggtttttgtttctcatacgtaactatgtagttacagtagggtggaatgcgagatctccagaccagcacatcaaacttatcttcaacaggaatatcaccacccagtagtatgtctcgtgacgtcagctttggtagctcaccttctgcagggccagccaccctaacatcataaaccatgaaatcttgaacttgaccatccacaacggctatcctgctcaaatcaacagggatatttctttcgaaaagatcctcagggtgtagaccagaggaagtcaagtgctttcgtgccagctctcttaagaataataagattctcttccagaattgagtgttaggattagctcttaatagttcaccaaacatagttgcaccaagaaatgatccattcatctcagtagatagctgcatggccagagatgctagttttggatgctcatcaggatccatacttccaaaagcaagtgccttgaagtagtaccaaaactcttcttcagatagcctcttcaccctgatgggttgggttgtcccaaacttagcaatgtcctctgttgtacctatcactacaaccttaattccagtaccgggcatattctgcaaatatgattggaattttgtccaagctgcctcatccacatcccaaatgaactcaataacaaacaaatatttcccttgagaagccttggagttaagcgagagctctccggtcttcagatcgtcttctttaaagaaaaatatatgggagaagcagtcgcgcaccctctcatccaggcaagcatgttgcacaagagtttttttcccaatcctttgagggccaataataggaagaatgctaacatatggatcatgaggatcattgcaaagcaagaaattgatgacttgctccttctcaatacggcgaccgaacatacagttatctatgtatagatatgtactgtaaggctggcgtggtagacgagggtggctaccaaggagaatgacaaattccctcatatctgcaatcttagtttctaaaccatcaacaacatctttcaggtttgttctgctcctgctaccaaaggctactggtgtgcgtttgcttatggcatcagcaaaacgaaagcgcttggcagagttacaggcagacaaggcaaatgactgaatctcatgactcacctcatattcggggggttggaacttgattttgtcgagcatgtagtatccgaggtagaatccctcaacaagtccctttagctgcaggatcattccttgatttgtgatatggcgtccccctgcttcctcaacaacagagtgcatcctcagcaagatgcgttccagcctcctacgatcatcctccttatgtatatggtttctgtaattttgtgttaccgaagagatgaaccggctgataagatcagttgccacagcagaaatcagaatctccatgctcaccagagctctgcttggaagcaaatggtcaaaatgggagtttgcaaagtgacccaggcttctagaatctagaaggttacaaagaagtaggcaaagagaccaagacaagtctacaagaaaatagtaacaggtactggaagcatttaacacgagatggctcttcctgagccagaattttctcttccaaaagtaagacaaagaaagaactcggaactataaagtatttagtttcttttcaaaaggttcctttcatgaatatggtactagacagagcagcaatagtaactgtctaactgactgctttcaaatattcaaattaacaagagcagatacaaaagaatatgttttcaaaagaaacacttattctatatagagatggtgtagagacatataccagtttgacatgaatataacatgaaaaaaagtcaaaatgacttataatatgaaatggaggtagtagcttgcagtagttgtgagaattggacaattggtgaatagatcacagccttttgatgtatgaggtcaattgtcaaagctgtaattccttcctttacgaagaggtaattagatatgatttaacagctatgttcctttctttcctttgaaatagacatgaatttacatgcattcaggtgtaaaatagtttgtgctcagccttccaagaggaagatattttcaatgtgcttacaaacagtaccatttgtagtgaggttgacagtgtttacaccccaggtaaattccttgtaacatagtaagtggcaactcactaagttgttctcgccgccttatcaagagcgaaggactaatggaatgatgggtttaaatcatttaattaagcaaaagtggctactataccatactactatccagccgaagaagatgaacattgccaatagaaaaaaaaactgacaaatcctgactcaattgtatactttctagagggattagttcaagcagattaaaccataatgaccagcatgatcgtagccaaagaagatgaacattgccaatcagattagttgtagatctcgcacgaaactgtacacaagctatctatcgatactatcaccagattagttgcaaaatcccgatgcatgcacacagccagatccaaagctctaaaggtgtcgactcaccggggcgcgcggcggcgagtgaccggagcaaacctcgaatccggtggcctccgacgagaatcccaggccacgcacacctccgtcaaaccaccttcctctctatgttttcctctgatatttttttacgccgatttcctcttgttccagcgctctattgaaattctggggcggccaatggcgaaaacctcacctccgcctccgcctccgccgccgccgccgcccgcgctgcatcccggcgaccgaccggaggcggcggcggcgggatgatttgcaaaaacggtagggaccttttcgcaaaactccgtttcgctgccattgtgattgtagaaaggggtcattttgtgtaattccatccattccataggggtatatttataaaaatactgatagctaccagtagcgaactagcgatcacacattgggttcaaatgggctgagctccttcagacgatatgggccgtccgccgtcgttttcttctgtttgcaccatatcgccgacaccggttgccgtctacttcctccatcccataaaaaactaacttaatataagggattttgagtttttcttacaatttttgatcactcgtcttatttaaacttttttaaaattattatttattttatttgtgacttactttattatctacagtattttaaccacaactttttgttttttatatttgcaaaaaaaatttaaataagacgagtggtcaaacgttgcaatcaaaaactcaaaatcccttatattgtggaacggagggagtatgacacatcctattactacgaatttatgacactaaagacatttttgttagatattctacagcatgtgaattgttgatctccaattatccatcatcttcacttaccatcaaagaaatcgtttttacgacttggtctagtagaatgaaagtgtttctgactatctccttatctgcaaatggaataataaatgagtaatcaacatattttataaagaataaattacacccacgatacaggaactttgataggtgggtgtgatctagtgtaagaacttgaaaaataagtagactggtacatgaatttggcaatcatggaattttagtttaaaaacactgatacatacctttgattaatcctaatattttaaggttaactgctaaatcgttggctcatggattcaattttgtgttttgccattttcgtcacccgagacaatgaatatattgattagtcgaatcgctcgaaaattatattaattagtttgcatgcagttacttttgatatcatatattttttagtttcaaatcaatagattattttattattataactaagcaattcaaagcaatacataatacatgtagattcttgtggagatagcttgagtggctggttttttatatagcataaaaagtatggtatggaatattgatattttaaccaaaatacacgcactagccaagttattgcacctatatgcttattttttaagttcttgcattagactatactctgctaccaagtttatgtactgtagacacagtttactcttttataaaccagtctagtcatccattgggtttactaatcaacttgtttatgatgaattattcctggctttgtacattgaatacagcgtgattgtcaaacaagacatctggcatgatatggtgaatcctgcgagacaataaaaaaaagttgatcagtgtggaagagaacttagaagccacaccctaaccatccttcctacaaattttgccgtagaaacaggtaaaaggaaacagtcaatgatttcatcttcacaccacaaatttgacacctgagacctttccaacctctgttcagcagaacaagctgaggaaatttttatttttcataaggatttgaactccacacaaattcttgtgtggaaaaagagtattgccagctttcagaatctggtataaaatcccaccttttggccaacccggaaaaaaataatctagtaaaagcttggctttgtttaattcagcgcaaagtttggattttggttgaaattggagatgatgtgactgaaaagttgtgtgtatgacaggttgatgtgatgaaaaaggactgaagtttggatccaaattttggatctaaacacagcccttctcaccctaaagaattcgacctctcccaggtttcaaagttttttttttctcaaaagcgaaagaaggctgcgcttcattttattaaggagaatttacacaggagataccgaaaggactgtcccccccaaacatgtcacacaggagagactgaaatggttacaaagtgactaaagtgaggattcctcttcttctgacaatttgtatgagaaaaaagatttgatcaaatcaatcgacattttcctggtttccctacaaaagagttcgtctaagcttcataggtccaaaaattactattcatcacctctgtcacctaggtctttttattaaaagtcatgttatataaccaatggaagttatcaggcatcagcagtagtttgcctccctatccatttatccacccagaacgaagttctttaaccattgccaactgttcttaccggccaccagaaaaaaaaatagaaccatgcaaaaagaaaaaggaaacaaataaacaatcatttgatacattctgtgaggaaaaattcagacaacccaagcaaaaaaaaaaaaaatcctttcaacatgtcaagctttggattgaaataaaaggcatttaaaaaaaatcctttcaacatgtcaagctttggattgaaataaaaggcatttatcttcagcctgacaatgatgacaatgtagtgtgttgtggttgtggatgtccgaatattccacacagtcagtctaccttgtggaattccaaggtagcctcataactctatttcgaagacccaaactgtaaacaaatgcagattcttcactgggattgcaaatcagaacaagatcttaacagccgataataatttggctacgcgagcaacggagcaaggccacaccatccgatcatctgcaacaaacatgcaagactgccatgcatcttcttcaccctaatgatcaggaagtttgggaccctgttttgaggtgagtaaattgcaaaaacatggataaaatccgaccaaaacttgttgatagttttacaagctggtggcagcatgtcctagcataccaaaaagagatgaagaggaagtttaatagcctggtaatttacaaatattggaaggagaggaatagaagaatcttccaaaaagaaatctggatttctcaacatccaagaggagatcgagcagcatgaaagactaaaccaagaagaaattaatctaaacgaatgtctgtaaaaaaaaacatattagtaaggtagttgaagtatataaagtcagctgtgactacgatggaactgatgaaaggggctgaaactaattgagaagaacactaaattggccatacatagggcatcatagtcagaacattgaagtacaatattttgaaaacatttctgtcacacacatatataatactagtcagatagcaataggaattaactgcatcttgcatatccaaactgataagagaagaaacagagttttctttagaaaagaaaaacgtttatgaccaatacatgtgctacttagacctgaactgtttgaacaatttcaatagtagttcgaatctgtcaatggcatagacagcctttcgaactataccatcgacaatataattaattccttcgtagaaagtttccatcagcttaagggttatgcttatatttctctcaatgcttgatggttcctcctgccaaccttgtaccgtcgtttttgtttctcataagtaactatgtagttagagtacggtgggatgcgggatttccataccagcacatcaaacttgtcttcagcaggaatatcagcacccagtttcaaatcttgtgatgttagttttggtagctcacttccagggccagccaccctaacatcgtaaaccaggcagccttgaacttgagcacccacaaaggctaccctggtgaaatcaagaggggcatttctttcaagaagatcttcagggtgtacaccaaaggaagacaagtgcttttgtgccacctctcttatgcataataacatgctctgccagaactgggtgctgggattagctcttaatagtccacctactacggtcgcaccaagaaatcctcccctcatctcagtagccaactgcatacccagagatgctagctttggatgctcatcagggtccatacttccaaaggcaagcgccttgaagtagtaccagtactcttcttcagacagcctcttcagcctgatgggttgggctgtcccaaacttaagaatgtcctctgttgtacctatcactacaaccttaattccagtaccgggcatattctgcaaatatgattgaaattttgtccaagctgcctcatccacatcccaaatgaactcaataacaaacaaatatttcccttgagaagccttggagttaagcgagagctctccggtcttcagattgtcttctttaaagaaaaatatatgggagaagcagttgcgcaccctctcatccaggcaagcatgttgcacaaaagtttttttcccaatcctttgagggccaataataggaagaatgctaacatatggatcatgaggatcattgcaaagcaagaaattgatgacttgctccttctcaatacggcgaccaaacatacagttatctatgtatagatatgtactgtaaggctgacgtggtagacgagtctggctaccaaggagaatgacaaattccctcatatctgcaatcttagtttctaaaccatcaacaacatctttcaggtttgttttgctcttgctaccaaaggctactggtgtgcgttttcttatggcatcagcaaaacgaaagcgcttgcgagagttacaggcagacaaggcaaatgactgaatctcatgactcacctcatcttcgatgctctcttcttcggagggttggaacttgatcttgtcgagcatgtagtatccgaggtagaatccctcaataagtccctttagctgcaggagcattccttgatttgtgatatggcgcctttctgcttcctcaacaacagagtgcatcctcagcaagatgcgctccagccttctacgatcatcctccttacaagtatggttgttgtaattttgcgctaaagaagagatgaaccggccgataagatcacttgccacagcagaaaccagaaactccatgcttaccaagctaaagctcttcttgagttcttgggagcaagtagtcaaaatgggacttttcagagcgagagaagatcatagaggtgaaaaagaagctagctataagagtcaatgacaactcaacaaaaaaatagtaacaagtgctgaaggcagttcacgcaagctggctctatctgaaccagaattttctcttcaaaaataaagactaagcatttccagatttgcatgtttatacttttcattactggctataaagcacatgccgattagtaacaattaggaagtatagtatcatcacttatgacaaatcataatatatatatatatatatatatatatatatataaacaaaacacatacaaactatccatatttaatttcagcatatttcttaaatataccatattgcaaaagtatgctgcatgtaaaataaaaccaaacaaattttgctcatcaaatctactaatttaaaagttactggcgatcaaagtgaaaacaataccagtcaatgttgactagtagttgggagcagagtatatgttcctttgtctatctgactatctccttgtctgcaaatagaataatgagtgagtcagcagcacatcatataaaccgttcagtgcgtttacaaatcaacttggttctgaaaccctggtcaaaaaaaaaaaaaaaaacttggttctgaaacaagcattattcctggttgtgtgcattgaccacagcatggttgtcactccaaatctccaatataaaaaaggtatctggcatgatttggagaagaattcagccaagcattaaaaaagttgatcactatgagtaggggtggaagagatattacaaaccaccctccacacaaattctgccaaagaacaggtaaagaagacagtcaatgatttcatctgtcccataaatttgacatctttgtcacctttccaaccagtactaagcagaacaacgagaggaaaattttgatcaatccacaatttctgacaagtttagatgagaacaaagatctatcaaatcaatccacattttctgggtttctcctacaagagttcttctaagccttgttcttccaaaagttacaattcatcacctctgccatttagatctttttgttagaagttatcttatataacctaggaaagctatcaggcatcagcaggagtttgcttccgtatccatttatccacccagaacaaagttctttacctgttgcctattgttcttaccagctatcagaaaaaaatagagccatgcaaaaagaactagaaaataatatttggatgcattctgtgaggagaattcacataacccagcaagtgtgtgaacaattgtcaagatttggattgaaatacaaagcatttatcttcagcctgacgatgaggcctatgtagtatgttgtggatgtccaatgggcaatattccacaaaatcagtctaccttgtggaattccaaggtagactcagaagtcttacttggattgcaaatcaaaacatgatcttgaaaagccgataatttggacaactgcaacttggattgcaaccaacatgcatggtagggccactgttttaaggtgagtcaattgcaacatcatggagatagcccagtccgatcttttttgacaatatcgtgagcttggtggcatgaagcatttcttagaggaaattcaaaggcctggtaacttacacatgttggaatatttggaaggagagaagtagaagagtcttccaaaatgaatgctggattttgcaggatggcctcttcaagatcaaaaaggatatcaagccacaacagatatcagaccaggaagaaattaatctaaacgattgtccataaaaaacatatcaatagataattcaaatatagaaaagaaatcagcagctgtgactatgatggaattgatgaaagcaactgaaactaattcagcagtaacagacattgttgtacaataaattggttgtacacaggacatcatactctcaaagtagtttcttttgaaaatgtttccgtcacacacataatagttagggtggcaataataattaactgtattttacatatccaaactaataagagcagatacaacagcactttcttttaaaaaaggaaacatctatgaacacacagtagcggcacatgctacttcgacctgaactgttggaataatttcagttgtagttagaatctgtcaatgcatacccagccttttaaacagtactgtccacatcttaattccttggcagattttttcctgttaaattaagatttctgcttatattttctcaatgttagatggtattcctcttgccaatcgtgtgttgtggtttccttttctcaaacgtaactatgtaattacaatagggtgaaatgttagatctccataccagcgcataaaacttatcttcaacaggaatatcaccacccagtagcatgtctcatgacgtcagctttggtagctgaccttctgcaggggaagccaccctaacatcataaactaggaaaccttgaacttgaccatccacaaaggctatcctgctgaaatcaactggggtatttctttcgaaaagatagtcagggtgtacaccagaggaagacaagtgcttctgtgccacctgcccacctctcttacgaataataagattctctgccagaatcgagtgttaggattagttcttaatagttcgccatataaagttgcaccaagaaatgatacattcatctcagtagctagcttcttatgaaccctcaacattctactcaatcaacaaccagcacaaggggaaaaccaacaactccagctcaatttctccaatacttggggtcacaagtagcagaatgggaacagggattggggatgagaattctaggcaaggaattagagaaagtagacttggaatttagagaataaagagttggagaatcaggaagagcatgaggaggaaggaggctgcagccatcagattttctgtaaattcatcgacgcttcctgctgtgacgattggtcctttttgtagtggcaagcttgacaatagattgggcctaataggccttcgctttacctgcattccaacctggcccacgtgcgtgacatagctgcatggccagagatgctagttttggatgctcatcaggatccataattccaaaggcaagcgccttgaagtagtaccagtcgtcttcctcagacagcctcttcaccctaatgggttgggttgtcccaaacttaggaacatcctctgttctaccaatgactacaacctaattccagtactggccatattctgcaaatatgattggaattttgtccaagctgcctcatccacatcccaacttaataacaaataaatacttcccttgagaagccttggagttaagcaagagctctccaatctttagatcatcttctttgatgaaaaatatatgggagaagcagttgcgcaccctctcatcctggcaagcatgttgcacaagagttttctttcccatcctctgtgggccgataatcttagcaaagcaagaagttgatgacttatctttgtcaatactgcgaccaaacatacatttatccgtaaatagatatgtgctataaggctgacgaggtaaacgagggtagctgccaaggagcatgacaaattctctcatatctgtgatcttagtttctaaacaatcaaccatctttcaggtttgttgtgctcctgctaccaaaggctactggtatgtgttttcttatggcatctgcaaaacgaaagcgcttggcagaatacaggtagacaagggaaatgactgaatatcatgactcacctcatctttgatgctctcttcttcagggggttggaacttgatattgtcaagcatgtagtatccgaggtagaatccctcagtaagtccctttagctgtaggagcattccttgatttgtgatgtggcatccatctgcttcctcgacaacagagtgcattcttagcaagacgcgttccagccgtttatgatcctcctccttacatggttgctgtaattttgtgctaccgaagagatgaaccagctgataagatcacctgccatagctgaaatcataatctccatactaaaccgagctctgcttgggaacaagtggtcaaaatgggagtttgcaaagtgagccaggcttctagaggtacaaagaagtaggcaaagagaccaagacaagtatacaagaaattagtaacaagtccaagtccaggaagcagttcacacgagatggttcatcttgaaccagactctttctcttcaaaatgtaacacaaaacatttccacatactttcctatgtagtagtagacatgaatttacatgcatttaagtaaaatagtttgtgctcttccaagaggaagatattttcaatgtgcttacaaactgtaagcatttgtagtaaggttgttctagccgccttatcaagaacgaaggaataacataatgatggaattttaatcattcgattagtcaaaagtgctactataccaatactactatccagccaagaaagatgaacattgccattagccatgatcttaatccagtgtttgcgcgtaaaggcattttcctagcacggcattgcacacaagagcgagatatagagctccaaggcatcaactcaccggggcgcgcggcgggcgagtgaccggagcgaaccttgaatccggcggcctccgacgggaatcccagggaacgccgagaaatccaaccaccgcgcacgcctcctgccaaccaccttcctctccggctatccatctcctcctccgccgccgccaccgccgccaccagctgcctgcaacctcactgctcgatctctctctctacgttttcctctgattttttacgacgatttcctcttgacctagcactctattgaaattctccggtggccattggatgaaagtgaaacttcgcctccggcgccgccgcctgcgctgcatcccggcgaccggcggcggcgggatgacggttgacgggggagcggagcggggcggggccaaatgcagcttcggaaatttgtacaaagtgtaggggccttttccgcaaagctccgataggggccattttgtaaaattccatccgcatggaggggtatgtatgtaaattatcatttgtaaatggtaaagaaatccattttaaaaaatcacagggtaacaagagtacctttagagcaggtacaataggtggctataagccagctataaacatattttaaagagataaatgaagagagagaagagcagcgggctacagatttgtagccagctgcagcacggactccaagacgtaatgtgtgtatgacaggtgggaccaggtattaatagtatagtaagcaactattgtatgaattggctattacattggctatagacgatttggagctagtagtgggctgcactattgaccttgctcttgtacagtatgttgtctacatagggggttttgaactttatgccactctcgctctcctacaccgataatgttttatcaaataccaccttcctaaaaatttttgattatttaccatctaaatccactaaattatttttattgtgccattgttgtgaactaagtcaacaaaccaaaggataaatgaccattgcccttatcttccgtgaaaagagattgaggaggagcttagcctctgggtggaaatggttgccctcccgtcatagccacttcgaacgagttaaagccacactagcaaccccctcccttcttcacccctccgaacgagctagagatggtgtatcctctgtgactctgtcgtccttgccgcaccagaggtaatcgaggatgagccacgtctagcttaaaatgtcgatctggacgttgaccgccacgctgccaactgatatgcttttggttgcaacactgtgccactttgaaggcgccatgcccgtttgcgacatcgcgttgccacccaatatagagtcatcggagctcagttcataaccactggccaacatgtgacgacgtcgttccttcgtggcttctcctccatgaattgggaagaggaagaagataagggcacctaggtcatttttatccattctgcttagtttgctggctaaaatggcaaatttgaaacagcttagtcatcttaggtggcaaataatcaaagtcttttggaggagtgacatttgagaacatgccatccgggagagtggcataaattttaaaaacccgtatgtataacactagtactagatcaacttgtattcacttagatgtgatacctaaccttatgtttcatgttgacgttaacattatgtcactaaaatagttcgatttgagcttcgtatatcggcaaaacctaacagatataacatgttgtacccctcacatttaaggagtgggcaaggaagtcaccaaacctccttgtcattagactcgtcacacactcataactcctcatcggcatgagcattggctctctccttcaattgagccccatccctcttacaattgttgttgcctatatcagaagtactatgtcaccagattcgacttctatttcttttctttttgtcattgccgactgatgcttaatcacattgttgcgccccttcttatcctcttcttgatgctaatttaccgtctttcttgcaattttttccatcgctgtcctaactcaatatcgagttcccaaccatatacaatgtctagccaacatacatgggggctacaatgacggacattgagcttgctacttacaaatactactttttttctctttcttttttcttttcttcgttttctttcacttattcatgattatatcaaggtatatcaaacaaagaaaattagacggaatttcagttcttctcttacgaacttaaagttttttttttttgacaatacaactcaaagttggtttatctaatgacattcgtaattatactccaatataatattatccatatcatcagtgtggcacctctactcggattgaggtgttttcaggcttttagccgtccgtttcacagtgaacgaccgagatcgatcgctacagtgattcgtgaattgtaattatacacaattgtaactacgagattccagtcaaaaaaattgtaagctataatgaaaaaaaaatgcaaatcactgttttctattgtaacaacaaactcattttactatgcgtctctacctttttcttctacccgaccctccacgaagagatgggttgggaacccatgagaaagaacacagccttatacctatccaatacttgtcgccctccgcctagctccaacatatattcatatgctctttaacttattaataactcgtatccaaaaattaaatttaaaatttctattttgagcgttgattttaaattcgaatttgattttaattctaggggtagtatatttgccggctttgaattcccgaatcccggccggactccgccaccaccgcaatgccgcgccgctccgcctcccggtacgccgcctactgggccgccgacgcgctcgccggcgacgacgccctcgacttctccctcaccaagggtagggttcatcacgccggggtccccctcctcctcctccgcgctcgcctcctcaatttcttcctcctctcaccacctagggttgttgcgcagcgctggtgggcgtctcgccggattccctcacgggcgcccccgaggccgtgcgggagcgcgtcgcgctgcggtgcctccaggaggtcgtctccctcgcctccgatggcgactacgaggccacgccgacggccggaggggtgcttagtgtggacgcctcccgctcctgcgaggactcgctgcttcaactcatccgagaggtattcagcgcgcacgatacgcgaccatgcgcactcttgtggctctgatttctgaccttccttgtttcatcaagtattggttgatttgattactggaggttggttgcgatttgttcatcggttcatgtagtagacaagcgatccccattccctgttggtcggtacattgctggagatagttattggtagcttgtttatggtgtcggatgcgattgtgctggtgtggggttagtcatttccagctttggttatgtctttttttttttcagataaacaaggttgacattaataaatacctgggattttgtgttaatttccttcttgattcaagaatcaagagatatactacaatcggaacttgaataagtcatacaaacacatgcgtcatgattgggttggtagattgtcttgcttcaatttcgtaatggcaagagtacatatcctttctgattacacctatacaatgcttcttgttgtgtaagcagtaaatatcaatggacatagttggaattatggaaaagatattttctgaatttacttctcaatagtgcatcgatgatttatatgtcacattttccagcaagtacagtttataatgggctttagtacgttttttttttgtacaaaaatacgtgatccttcaatttgacgtattccacttcaatatttgttgggccctctaaccaatcacttaatccctgatccaatgtttcagatcaatactagatcttgttattaatttttttgtttgcgtattctgttgatatgaaacatgatgtttttcttgtaacatttccatctgttgtgttccctatggataaattctgcttaaaaggcaccttgtgccctctacccattgtgttgattactgatccagtgttctaattgtacaatattgctagcctagaccctgctatacaatgagctcatgcattccagtgatatgaaacattgacattcctcttttaacttccaatcttctgtgttcccacctatatttgcctatatctagagtctaataaaatacctctaggttaattcccatcagactgtaagtctttaagggttgagatactataagactatatccctatgaagaatttatgcttaatctccaggctctaaccaatgagttgtttcactgctacatgttctaattgcgcaacgttgctaggcaagatcagttattttctgagctcatgcattctggtgatatgaacataatatttcctctaccttcactctagttattgttgcaagttatatatgcttattattatgtctcaaaagataattgttgcatcaccttgcatatggactccataaatgctaatatttgtacagggacaagggaatgccatcgtgccatgttaaatgttatttctcacatgattatgtgtggcactatggtgcatcaccttttgagatgatctccatgaatgcgttaatttgtgtagtgaagaggcgatgctgtgttaaatatgtttattcattcagttttgaagctagtgtgctgcaatgtgcatattataaagtccttcctgatgtccagctaatttcaatgtttacataatgtaaaattttcagattggtagctcaggaagcttggagaaggttatgcttctgccctttagtcaagatgtccagaagtttatatgtataaagagacctacattacctgaaacttcttttgaactggtatgttaaaatgcgacatttcagaactgaaaaaaaggacttcttttgacatattgttgtgctgcttgtttgtgttcagctcagagaagtttacccagagatcacacctgtggtcctaccatcgccagtggagcagaatggcaatgatcaacatgacaatgtcagccatgatcttgaaaatacagagaagactgggttcaatacagatggcgctcagcttcagcaagatgatctggcaaatttagtcaacgaaagtaacacaggaaatcttcagaaggatgcaatggcaactcctgattttcaccaaccatgtacatcagaaaataggtgttttgatcagccacaagaagattcaattaatgcagttggtgtcaacatcaggtctccaaaagacagtccaactaatgtagatagacacatacaagttgcagctgagccttctttagctacttctgcagatttgctgggaagtaatacaggaacaatttctgagcaggacatgatagatgatacaaccatggttcaatcgcaatctcaaggggtcaaaaatcctaatacacttcattataataatggagatgaaccacttgttgccagcattcagtcaccaaaggattccatccatgaaggactgaccatacaggcaactgtttctccagcttttgacagaagcaatgatgctttaccagcaagtacatctgaaataagccagttgcctgagtttattactgcaagggatacagtaatgaattcagagccacgtatcaacaaatctcatccaaattccccgaaacatgacactgttgataaagcaaatcaagatgtggattatggcagtgttggtattcagaaagctgctgctttcctatctgaagatcgcaatggggctactcaaggagagaaatctgaaattaaagatccaccagaaaatactgcagaacatacaaaaatgtttgaacaagaaaatagtgtcgaggctcagttggaagtcggttgttccgacaaagttaatcaagatatacaggatgatggcaacatcatgacaaagaatatggtctgtgatgggctgaatgtgcagactgctccggaacctcatagctgcagaatggccttgcataacaaaaatttggtggccaaccatttgtccgagcagaatattggaaggaacacaactgctgttgagaaagattgctgcagtattccaacctctcctcaggttgttaatgacacaagagtgaagcaaccttcaaacaagagaaccatggggaatactgtggtagaaacatcgcatgtgcattcttcagatgatagtctcagtggcttcgcagccaccggtcttctgtcaatggctgacaaaataccattctgtactcaggatcaagatgccaacggtcctgttgagggcttgtcagaacaagatttgtgcataaagtgtggtaaagatggccagttgttgaaatgcagcagctgcttgttagcggctcatgatacatgttttggttcattagcgacattggatgattctggccagttgtattgtcctgtatgcttctatactaaagcaactgaagcatatcaaaaggcaaagaaaacgtattctgaagcaaggaaaaacctatcagctttccttggtagaaagcaattagctgagcaacatcagcaagctgcagtggggcaaagagctgccaacaacgaggatcatttgaatgggtgtaacgatgcatctaaaaggaaagataatcatcaatctgaaggaaataacctttctcatagggatgaagaccctacccggaagaggaagaagcagaagacaaatgctactagtgatgcttgcgctcaggaagtagtcactgaaaaggtaccagttgttcagaattctgatgttgcacccatgaataagcattctgtactccagaataacagaaaacaagctcaggttgcagagcacgagcagccagaggaaaatgaagaagctagtggagaatctggtaatgacaattcattgcacaaaacaacacattcatctcagaccaaatgcagtcctgctgtaaatcagaatgttgacgctgacaaagaaaatggccttgcaagttctcaacagtcagaagattctgatgaaattgaagctacatcttctaatgactctaccaagaaatcatcgcctccttggcgcaagttgagacaccgcaaagcaatatatcaggataaggatacagcaatgccaagtaattctaagaaagtacttgggaaccgtgatcaacatatggcttcaccatcaaggaaaaggaactatgcatgtccacccaagcgttagtaagtgttattaataactaataagcttcataagcacttctttctcctgttgtactcccatttactgcagtctgcacatagccaaaagcatagtaaacataatttatatgggcacaaaaatgtttgagttgtggttaattttgaaccaaatgacattgaacactctgtctgatttatacatatgacaaataaaactgcactatgagagagttggtgggatagaacattaagttttagtgctctcgcaagttacaacacagtttccatgaatattcatagttcattgtcttagactgatagacaacatcatgcatcagcccatatggtttaaaaggccattagctttatcatgtaataatactgtatgatggaaagcaaatttgtaggaatcattaatacctagaattcataggagtgtgagctcatgaagttatatttacgatagtgaaatcaggctgtacttacatatggtcctgacataggtaatgcacggtattctctgttgcgtgaaaatgcaagtatttacaacaaaaatggaaccatcaacgggaatttcgactcattttccttataggacttcggtgtttgctagaatggatacctattcagatgcttcatttgttgtgattttttttttcactggaactctaagagtgtcgtacatggtagtaccaagaatttaagcatgtcttttcttgcagctctaaccctattgtaccggctggaaggcgcacaaagctctgttggacagaaaaggaggagataacgttgagggtgagtgcacctgatctgaaaaagttgttaccggcactgatgaatcttgcaccatcttctgttgcctagctagtaatgtgcatggatgcacctcttgtatacttacacttctctcgtgttctattcaggaagcaatggcaaaatttaccccaagggacaatggcccaattccatgggtccagatactggagcacggtagggacgtgttccacaggacacgcctcccatccgacctgagggtcaaatggaggaacatgaagaagaaatcaggctcatgacagtcttaacaacctactagtgcaggctgtgcagcttttgttctgtgtattctaaccacttactcttagagcccattgtgtgtgtcatcaccatcttgtaaggttgtaaattctcgttttcgagaaaaaaaaagtaaggttgtaaattctccttgatgtgtagaacacttcaattttatcgttctttcttggtatgtagaacagttcagtgaacttagtttgatgtcccgagttcaacacatctattttctgcagatggctcccttctgttaaatgttaatgaaggcgaataggtgcaatgcagaagtgaagatggaaatttttgtgttcatatggacaaaatgttcaggacaaatgatcaatagggagaacagcaatgttcagacagttaagagagagagaggggtggggggagggatgtttgatgtttaactacaatcacaaatttacaaaggctcaatgatggacagggtccaaaacgagacggcgatctaggcctacacaaggataagagccagcaccaaatatatgttatttatttgatcgaagcaaatatcagactattacataatatattagagaatttcacggactaatttgtaaaattagtggttgtgatactgtgctttttgttaaacaactgtatcattcatacatcagctatattttgtatggtacagtctgagctgctcctagtagggagctagcatttttaaactcgaccatagttataacttatcataaggagtttataaattttaatttcatacaaaattcacagagtgatcagttcaatcaaaagaattatgtgaagcttgtcacttgtaaccctgcttccactacaaaactattttgagttcctagagtcaatatcatgtgcgggaaaactgtttatagttcctagagtctgctcacaatagtgcaccagaatctccacactatcagataactccgcattctgttacggttagtacccaatggctttagctttctccaacaaattctccaaaagttgatagaaccaactcagttgctgaaggatgagctctatcgttagctctgaagaaatctttgatcgtaatacagcagcaatccctaagaatcccagcatcttcatgtttcatcagttttcgtactcttgccacattctgtcttctttgtggaaatgtgcacgttcaacagcaggatggatataagtttcaatcccttttggcttgaactcaagcagcttgtcagcagcatagaaggcaagtacaacaattccatgactcccgcatccagcagccaaacttgaccagatgaccttatttggctcttgggcaacaaaacaaaaactaggacaacaaatgaaagaaaactagtaaaaaatccgtggcagtaagcaaaatagttcatacaagtcaacaagaaattagtactaacaaactggagttttcaaagtgagaggggatcattgaggtaacaaatttgtaaatatttcttaaatacaccatattaataaagtatgttgcatgtaaaatataaccatatacaacttttgttcatcaaaatgtactaatttaaaagtgattggtgatcaaaccaaaaataataccaatcaacatcgacaagtatttgggagcagagtataaagtttgttgggcttttgggagcagagtataaagtttgttgggcttgtgtgtggagttaacagtgtttgtatgtgtttcagcccagttggcacatataaaaaggatgtatgctcagaggagaatagacaaaggatctagagagttccatataaatttcccaaacaccacatggtattagaataacagacctctcaaatcatttttccctaaggagatatagtagaccattaacaaacttatcttcttgactacaaagtcatacaacaacacaaagagaaaatgcccataaaagcaccagaatctcctctggtttcacacaggaatccaaacagacaccgagatcaagggcctagatttccagcacaaagcaagccttcccttctcacacacaaccccaaacaccctgttgaacagcccaactagcatcctggcctgagctatgttgcaagcactcaactcacaagccataaacccttccaaaacctcagaagcattggcctcaactctcactgacccatacttcaccacaaaatcctgtatccttggccccagcaactccatctccacaagtctcaggcatggttcataactactaccaatgaagcaactcgccattgactcgaacaccgtggtgaagtgatgcaatgcctcgaagaagaactcgacaaaggaggcactagatggagatacccctcttccaattctaactaggtcctcttctatggtgaccactagcttaggctgtagcttcttgacacagacaagcagtaaactctgcaatgtgcttagtgacttgtaatacatacttgttgtatcacatgagacaatcactgagcctttacagtcctcgaagaaggcatgcagttcatcctcattgtgaacacagatggaattgtattgaaatggaagttccaaagagtcggcaaactccgataacagccgtacaactgtgtcatgagtgctagcgtgacagtcagcatatgttgtgatagctgttagtctgaaggacttaccgccacagcgagcaaggtccgacatgagtgatgaccactggatgccctcgccgatgttcaagtcgacgacatggacatccatgtcaccaatgatggcatctaggatggcctgattggtagtgaagtgtgcaaacttaacaaatggtgatagctcttgtatgatctggtgcaccaacatgttaccagatggaagtggctctggctgataacacccagtggatgcactggacatccgggaacgcagaccttggtcaaagtggtatgccaatcgatcgaaagaactggctgctccattttcaggtatcccagacaggaagtcatcaagcctcgagaatgctactgatgcaaggattgaatctcctgcctcgaccgcctctgcaccagcaaggaggaggtcgcttaaactgtcctcctccaagagctcctcttggattgctgccaagttgacactctcttggccaaaaattctatcatcacaattaatagacacatcaacatcaggagcatcatgttgatgcaactcattagaatctagcaccatggtgtcaagtaaatcaaggtcctcttgttgatcagaacaaggatcaacatggagagctgcttgagaagaccatatgaaatacccactctcttcgtgtgcagggaaggagagaagaggggaacaaggatatgacatagtctccattcagttgttgtctaccataacaagttgcctttgtctgtgtgcttcagcatggacaattggacatatatatacacaatgaggaggcaaggggaatggataaacgtagagaagaaaagacagagtgatgggtgagccttcaaggccaatgcaagctaaaatgtcttggtctcagatcccataataacatggatcaagctgaaggaagatataaaacgacaagtatacggcatgcattgtcattttttgttggcctagcagatgaagcagaacgaccagagaatgcactgaaggtatattccaagagtgcttctttctgcgtgtcagcatctattcagttattggactatatgcatataaaaagaataccatgtggtgttgcccacttgccctgaagtacctatagcttgtagtcatacatcaataagccaatgacaatgaaaaaaaatgcaaatataaactacatgcttggaggaaaaacatatgtttgatctttaatttggtggacaataactcaattcctacatatcttggttgtgtatgaagagtccgtttcagtctgatcagaacaatgttaagatttcaactttattatgaccagcaaaagcgcagttagttttcatttgctaatgtggttaattttattaatgctaaaaaaaacatgacatagacttgcttccaagctcaattcagtcataaagcgctgttataaggtggtactatattactgtcagattcctaatgtagtcaatggactaatggagttgtgctagttctgccaaaacattaataatttattagatgatagagtggagttgaaagaggacaatacagattgtttcaagtagtgaagttgttgcaaagcaaacacagaaaacatgtgtgggtcaagcatatttcttggttttaagctacctattgctgctatctgaacattttttagagttggttccagaagatggcaatgtccggtacttcatatacaaatggctggagcagcagtagagatggggcacaatgaggtactgcttggaactatgttccagtgagaaaaaaaattactaagaattgctctaattgaaggcatctggtagttaaggagagaatctcgcagtgacagtacaagacaaacgcaatagaacaaatgaacaactgttgttttctgttctgtagaaaaaatagcttggtgtgtctcactgtctcgtaatccccaactagtcttttaagtcacttaaaagtattatatcctggtctatcaatatagagtttctaaagtattagaagatacatggcatgctacaaaacgtgaatcacaaaatgaactacgaaggagcacatggaaagtttataatactaggtagaagatacaggtgtcagaaattagacagatcggctagaataatgcaattttcatatgtattatattatgccttaactagagaaaataagtgtagttctacaacaaaaggttatcctctttcagaaagtgttcagtatttctaggcgagaagccgtttatttgtaagttgttctgctacttcaataactagattgtcaagttactagttacaattacataagccttggtttgtctacacattattctagggagcatgagattacaggatgaccctgtgaatgacagtgtaacagtagtaaaagtaaatgaaatattattttttcggaatatgcaaagtacgtatctttgtattaagattgagggtaaggccttacacaagagcatctcaattatgtacaaaaaggatcaaaagaaaaaaataaaaaaataataaaaaggggtgctaaaggcaatgtctatcaagtgaaggaaataataagataatagtttgaagttcaagcaagagtgaagattatagcaccagggcaaagaaaaggagaaagtttcagcattatgccctatccactcgacaagccaatctatcttctaggtaaatggtgatttgaggcttgtctagattaaagagaaattcactgtcaactctgctgaacacttgttagcagtttcacatcctactacttagagcatcaaaaacttctgatcaattaaaccgaaacacatcacaatccaaggatggcaaggcatggtcaactgatttgtctattaagatctccaaaaaaaaaaaaattcttgtttcagaattcagtagactggatataactgaaagacgggactagaaaggcggcagaaaataatagtctaacaaatgcaagagtacattgaactttcaaaaggtaccgaagaacatctcaatcacttgcaaagcctaggtacctaactactgaaaacaaaaggactggtgacctaaggtccaagtcatactccaaagtccaaatttccagataaaatatttgcccatttcagctaatgctgtgggggagttagggaagctgaatcatgccatcatgtaggccccattctagagaaagcttacctggtagtgctgaagattttttttgccatttgcatccagtaaacataaaagcagctgtggtgttggatacttggatcgatactgcagtccaccgaagacgaataaacgtttggtttgataagtgtagtgttgaaattgaattgcgggacccatattgaaaaaaaatcccccaatcactacgttttgccttgcctgtatgtgccaactgctacaggcaacaaacaattccttactcggttggttcgaccacagtttagacttcgatttttcctctgacatgcatgcaccgactttcacagtgtagtatggttcatttttatgcactgaaatcgatttaagccttacactggagttgctctaacctctttgcttgaaattacatgtttgcttatgttcctattatacctcttccattcttccctggatcaatcaaacaaaataaaataaactatgtatgtgaaacatgatccacttaaaaaccccatgatttgagatatgctcattggcatggttttcctgaattaatcgcatcgaaacaaggaaaattgagaggacccaacaagagataggttaggttcttggatgcaattttcccccttaaaaacttctgtggcgagattatgctcaatcccttgggattgattgggaaataaactaaacaaaaaatcccacatccgaagagactgcttacccaaccaatcacacctaagtcctagccaactatcccggacagaaatgcgtgtacaccgataaaacaaacaattgtaccaacgtgggcgagcaactgacttgctttccacctctcatgtgcgggccgcagggagaagtttagggttaattaggttggttggctttacctgaatcgacggaggcgcgcggcggcggcggcattcctcggcccgtgcgctgctccggctgggtgcgcgccggaggcggagatggtggcgacccgacccgagccccagctccggcctgcttgggggagatggagatggagggagagaaatgcacggtgctttttgtcactgacacgtggggctcagagattatcgggcccatatataaaaacaaagtcacacgtctcaaggattatcgggctcatatgtaaatgataaaatcacgtgactttaactaaagaagaccatgatcaggagagaaatggttctatcatgcaatttagacactatcgcatgttttctcacatatgtattgcacacatcaacttaaaatatcattaaaattatacatttttattaatctacatctatttataaagtctcgtcttcaaattcattacattgggaaaaaaaccaaaactttaacatatttatcctctcaaaattgttagaatttttatctttttttacgatgaaaatataaatgaatttatggttaaaactttaaacataagtgtacatttttttctagatattttgataaaatctattagtcggtgcgcacggtgtgtatacgagaaagtttgtatgcataggatatgttgctaatcatcaaacatctaacgatccctgatatttttaaaacgaaatatttgctccacgctttggaaaataagattttaaaaataataataactagcatggtgacccgcgcagattgcgctgctagtattattatattttctctcatataatagcatatatgttttcttattataatattcaaatatattaaaatgacaacataattttaaattttataataactttacaaaactactaatgtgtaatattcatattatattttatatacatgttagttattaattatttttaatatcaaattttagttatttgtaaattatatatattcctatatggactatatggactttagactcgtcttttaatatttctttttttttaattccgaattttctgtaaattatatttctatatatactctatactcttcttccaatattatttatttttatttctgaattttcatattatattttatataagtgtcagttattaattatttttaatatcaaattttagttatttgtaaattatatatattcctatatggactctagactcatcttttaatatttatttttttaattccgaattttatgtaaattgtatttctatatagactctatgctcttcttccaatattatttatttttatttctgaatttttattatttctaattgtatttctatgtggactctaaactcatctttcaatattctttaatttttaatttcgaatttcagttacttctaaattgtattcctatattgaccttaaactcttcttctcatgtttttcttaatttcgaattttagttatttataaattatatttttatacggactctaaactctacttttaattttattgtgtttattccaaaatttagttagttttaaattcctagatggactctatactctatttctaatattccttattttttaattccgaatttctttttttttcttaattgtatttctatatggactctatactctacttctaatattccttatttttaattccgaacttcagttatttcctaattgtatttctatatggactctgtactctacttctaatattccttatttttaattccgaatttcagttatttactaattgtatttctatattctatatggactctatactctacttctaatattccttattttttaattccgaatttcagctatttcctaattgtatttctatatggactctagtctcctcttctaatattccttattttttaatttcgaatttcagctatttcctaattgtatttgtatatggactctagtctcctcttttaatattccttattttttaattccgaatttcagctatttctaaattgtatttctatatggactctgccttttcttttttctccgattaatgtgagaatttttaagccatgagagcgaacgtggaggctcctttttctattcctttaataatatataatagatacaacaatcattagaagccgagcaataaattaaaacatcgggatcactatacaatgcaattgaatatgttgataaaaattgttcgtttgttttgagccgcaacaccattccttctttcctttcaaccctagtccagttcgatacctctctttgctcgggctgtctctctttgccccctacctcccttcgttcgggctgtctctcttcgccccagcctgcaaataggcccagctctcgggctgagctaaacctccggaagaaatattgcatgatgcagctcatcctcctcattagttgagggctattgatctactcgatttcctcttttcgtttttctcaaaataaaagagaatttgcaaaactcaagattaagggcagctcatcctcctcattagttgagggctgttagatctactcgattttctctttctgtttttctcaaaataagaaagaattcgcaaaactcaatattaaggtttgggattcttgtaggttagccagagctcgtttttcttgatataaaagagaatttgcaaaactcaagatcgaggtctgggattattgtaggtcggccagagctgatcgttctcattatatctcgatctctcaaaattgtttgaggattgttgatctactcgatctcttctttcttctttatgttgaaactcgatattaaggctgggatgcttgtccgcggccataatcaatggagattaaacccaacgaaattaagggaagacaatgaggtgggagtaggaaattgattttgcaattaattgaacgagggaagcgtaaagagatccgaccacactcatccgtgagatccgtccacactcatgaagataatccaaaattgattgaggggttttgatttttgtcgcctcctctttctgttttacaagaattagagcaaaattgtattgtatcgacccagaatcgaggaatcggatgggaaatttaggctccacggatgtaatatggaatcgagccctataccgtggatgggaatcggggatgaaatattttttgactcgtgcactcgaggcagaatcggaaagaaatcgtgagggatatggattcgtgggcgctacggattaaatatttttgatgcggaattggaaaaaaaaaacttgtgcacaaaaaagttggcagcgatctgatctggattcgtattatacggagtggaatcaggaatcggaaaaaaaattagcgcctgcttcatgagacaacgtacgaaatttttttggcaaaaacatcttaaatttttataataggtaaagataaagataatagataatcttctactagcttaaaccgcttcatctaaactggaattaggcatgcttggcaggataacatcatgtagattccaactacaaagcccctgtaaactgaaaccgaatggccctgtaaaccaaaacactggagaaaatacagagaaaacatactgtcgccaaatgagtgagataggccaacaagaacattctatgcccaacctttgcagatcatatgtccccaggaccaggccaaactcttccaatggccgtttggagcacgtccaacttctttttttctatggttccagccttaacaagagaacctcctgatcttttcttctcattttcgtcggcagcattggaccacatttagaattttccagatccaacaaggttctctgatatgagagaccacatgacatgactgagacactgtttttttaaaaatatgtggacatcaatggcagctggggacaaaacaacaagagtttcaatcagaacccattccattcactataacaacatctttacaaaacaaccgtcgcaaacatgttaaacacagttctttcaaccttcagactaaggcattaacagatgattgaacaggaggatgaattgcattttcagtaatggtacaaagatcagctagctaccctacgaatgattcatatatgcatatggtatacatcagctatctttacagtacatgagttgcagttagcgtgcaacttgaggtgtgcttgagtcctgctcacatgaaatccatggagtcatttagggtctggccgctcatcgattggcctccgttcaaagagttatggggattatttgggtggtgatgacgtccctggtggccacttaagtagtgcatctgctgctgctgcgagaaataggtcggcatctgctgctgctgctgctgctggagtcctccattgaaggagtttccgttcatgtttggaacttggcctgccgctatcttaagccgctgaacttcttctcgtagggcgtcattcagagctgcattaaacagagaaggctttctcaacaggttgctttgcttatctggataaatatatttggattctttgatttcaattgccttgtaatggccctaaacaagataatattatatctgggccttaatgacaaagaaagaagagcttgataacattatttgtgggccttaataacaaagacggaagagcttctgaaagaataggacataccatctcgaagtttagcttgttcttccatggactgcaaccggagtttgagctctctgttctcagcagttaggccagacgtgtccctctgaccataagtaaattccaagatgaaaaagggtataaaattaggaatgtgtgagcaaaagataattagaaaatcaaaaaaccataagatagaacattcaaacgctgaaaacattaacattagcggatgagactgatgcacaatcagaaacatgatctttattgttagcagcagagtaaaatttaaagtgattttagttagaaataacattaacaaggagtaaaaacactaatttccccccaaaaaaaaatcactagtcctgacttcttgattccctatataaaaaacttagtgaagctttgtggagcaagataaacatcagctgttatccctgaccaccaaaccaaagtttcaaccccccacctaatttcatcatctttaatcaaaccagctttcaaatatagcatcaataaccctgtttctgacatgaccaacctataaagtatataggcatcagcattatgaccctacttttgggtgcaataaatccttcagttgtcacatcggctacaagaacacttgcagacaaaagaaaattaagaaaaaatgcataatgtgttcaggctcaactatgttttcctgaaacaaacttgtaatatttgcggagtaaaagactacaaaacttatggttactcattataatttgttagctctcgaatgataaattcacaagacagctattccatatttacaaatcatataaagccggtagatcagcttattctccctgtaagcaggactaccataggctctctccaaaatcaaaaatctctggttcaaaaagtgtgaactgataggatgtgcttaactgttcaagggctagatgacctagataagatattatggaatttttgggataagccgttacaaaagctagcatatcaataaattcaattctcactgacattctctgaaatacaaatgtatgcagtggcagtttgcaagaaaaaaaatccttctgatcccattacatatccaatttagtatacagaatatgcagggagagaactatatctgttcatggtatttttagtacactatgaaaaagtaataatttggtcttgtcaaagcgaacatctaagcagcctaacatttttcatgtaaatagtcaagtaccagtgaaaattataaattcaaaatagcaagaaaattcctaaacctgcttgtcctggaaagtgcaatttgcaagtacagaactatagcggtactcacagttgagaataaatacaaccaaacagagactaacactttttatgatcatagcatcccagtacgcctgaacaatcgtaccagaactccagaagagctagcaactttgaactcgaaggaactagaggtggttctgtgcaggagctcgttgttaaaaaggaaaattaaagaaagaaaaactcagaagccaatgtacaacagctgtaacaatcaagtaaaaacaatcaatgttgaagcaatcaaagaatacagtaatttttttgtgatcgtccatcccaaaaactgctagtggacagtaaattggttgcactggacagtgtcaagtagaaattgatgttagtcaaatgatgtgtaagctgaaacaatactgcatcaatgtatctaaagggaaatccggttattccagctgctaatatcaggtctgatacaagagaataagaaaagcatagccaaacaaaaaatcaactgatcagatagagcactagcctcacttttatggtagtagttgcagaggcaccacaagcttgagctataatgcatacctggagcagcgtgagctgtgttgaaagcgtggttgcctctgtctgcagcgtctgcaccttcctctccagctcaccggtgtacttgatcttcctctccttcgacctcgccgccgattgcctgttcgccagaatcctacacaaaagagagtacccaccatcaaattgagaacgcaacaaggagcccgatttcaggaaaaaaagaagaagaagaagcacaataggccagcaacttcaactaaatgatttcatgtttaattatcaaattgaaatagtatagggaaatagctaaagaaaagttgttgaaaaacttcttttctaattttttttttaaaaaatccagctccatttctactgaaaccgtagtgtgaaaaaaaaaattctgacctcttcgcgcgcttggggtcgaggagcgcgagctcggcgagcctatcggcgggcatggccttcttggcgtagtcgggcggcgcggactcgccctcgaacagcgagctctccccatccatcgacccgctcctcttatgcccagccccaccgccgctactcccactcccagcaccaccaccccctcctcctccctggaacgcgaggccatcgaagaacgcggcgtcgagggagaggctcctcaggtgtgcacccccaggcggccgcggcgccgcctgcggcagcgccggcgggggaggaggcggggtcgggtcggacgccgcgggggagtcgtcggagagggaagggaagtcgaggtcggagaatccgaactcgccgtccgggtcgagcagcaggtcggcatcgggcagccggatgaacgtctccgagtgcgcccgccggtggtgccccctcggcggcgctcccccggacggcgccggcggcgggaatcgcgggtccatgatggctgcggcggcggcggtcaacgccggcgagaggcggctgctgctgcggcggctgcggcggcgaagtggctggggtttgggaggtcgctgctcggagaagaggaagatcgggtaggtaatgggtctcgactagaggaagcggaggcccccactcctgcgtggacccggtgcatagaccccaaaccgacttacacgaatctcgaggcggaatggaccgtataagtgagttccggtctatgaggagggtccacggaagaacggaatatccgcgccgtgaaatggttgttgcatccgtccccgcatgggtaaacttggtccatatacacctgtagctgtagttcgggtgcacgaatcacgaggcgttacggacgatgggatgttgcgccggtgcatagttggg

SEQ ID NO: 9012 - DNA, 8139 bp, Oryza sativa
tgtggatgacaggtggggccggggatcggcggggcccgggtagctgtgagacacgtggtggtcgtgaggtccgagccgcgtgttgctcatcttgctggcttgccagttgctgcggcctgcgggagcgggtgggccccacgggtaagccgctgggtggacaccggagctgaggcttgcacaagccacaagatacttgtctgatgacaaacctcatcttaacattattttattatttcctgtatttttaaacttaacatacgtttttctagtataataaatctggacttactattcttatatatattcattgtccttaaaaacatctcatctagattggtttttttgatggagggagtagtaaaaaatagatgtgactggataaagaaagattatgatttacttcctccgtctcattttaagcgtaccgatgagtttttttttccaactttaatcgtccgtcttatttgaatttttatatgactagtatttttattgttattagatgataaaacatgaatttagttttttaaaaaaacaaataaaatggataattaaaatcggacacgaaaatgcacggttacacttaaaatgggacggaggaaatactaagaagagaaaataggtggaggagaatggttgtgattggctgagaggatagggtaggtaaatatatagttttatttttggataagtagtgtgttgagaatagctatgttttaagacggggtagtactgcttagcttggtaagagtattttgatagtagtaaactagtaatctgttatgttaagcaggggacacgatcttttgattcgaatattttcatactagcttgatagagtattaattttaatacacagagttcgttgggtagatgctttgtgctgttgacttggttacaatgttgcgacgatatttccattatatgatttttatatgagcttgtgaatgtgacagatattgacaacaaaaatatactagtagtatactagtatcccattggacacattcttattgtaaccaattgttttcaactgaagattcatccacttcactaattaaaagggcattcgatgaatgtgattaggtcagcacagcatgagccggtgatccgaagtaagggattaatggatatttttacacacaattttcatgataatgtcgtgactttatcgtatctagtaattctgtaattacttggaattattcatttgttcaatttcatatataattagaggataattggatcatgcaattacaaatatgcatattcaaataaatatcattacaatttgtttacttatagtcgtgacactgaaattttacaaaattaggattgtaccactatcgccacgttttacatcttcttcctcatctgcacgtgggacccacccattagattcatcttcttcctccatcccccctcttctttttttccatctctctccaccacctcccgtcgtccatcctcctctctgtcgctcactcctcctcccccggcacagcggccacccccaccatcgcctctagtgccacacccgctgcctggtcaggttgggtaaggatggctggcccatcgacgtcgtggttggcatcctcctcatcgtcgctcccggtcatcgtgtcccatctgcccggcactgcggccacccctgccgccgcctccaagcctagttgtcgcgtcgcgccgagccacctagcccacgtcgcacccactctggtgacagtgtcggagtggacgaatgggaagaagataggaagagagaaggaagaagacggataaggaagaaaatggatggacaacgtgacgatagtagcacggtcctaattttgtaacatttaagtggcacggatacaaataaataaattataattgcgtttatctaaatagacacatttataatgatatggatccaattagtttacaacatctcttcctcgctaagagtaaaaaaaagatgcaacatgtctggtgaagaattgatagtgacgatgttgatgcctaccattttagatgcaatccccctaccaaataaaattgagcaagagatgctaccgattttgatattggttctttatgagaaaattccttgacgtcattttctgcatctcacatcaagaagctctttagtcatcctgtcactttttttttcactttcagaggcagaaaaacaatgcaagtaaactttctcattgggctagtttcaagtgattaatgtgaactgcatctcagaaactataaaatatgatgatcataatatgacgtgttgcgcacttgtgctcttatgctcatgcatgccgtcattttgtagtaacgagaggcaaattaaatgtagaagatagggtatgattttggtgtcgattactgaaaagatagctaataattgaaatttttaggtgagagcatatgagaagatggtgattatctaaaagcactgcagcctgcagggtaaataaatctgatggtagatgacatatagaatgattggccaacagcaagattcttggcacaacagtgaataacccactgatagtcatattacttctgagccagatcacatctaactgtggccaatcagcatcagtaataacttgcagctattgttgactctctggttgtctgaatactcctatggtaatagtaagggcctgtttaatactgctccaacttctaaatttagcttcaggagttgggtctggagtagagttgtggagctggttcattttatgagagagctccacccagctccactcctaattttggtggagctggaactgtttggctgagctccagctctagaaggggtggagctggagctgtgccaaacaggccctaagtaatataattgatttattgcggagttcctatgctaatatgtaactatgcaaaatttacatatactgtcaagaaagcatgcaaattgttaactaaaatcagtactaagatgcaaacagttaattaattaagaagtgtccaagatgcaaggagatgcatgttgttctccgaacaaacaacagaactgtgtattactcatttgttaaagaccattccatcctgtgttgcttgttctctgaattaattaacaaaagtgcagtactcgtgtaagtactaaacctgcacattagcagatatgtttagctagattgctaacacttggcagcagacatacagttggagtctgaaactctgaatcttcagtacacatacgtatgcagatccatgtcgtattctcagagttctcgttaagaagtcaatcccgtagagacccaaacgatcggttgatcacttgatcttttcttgcccaaagaacaacttgctgagacaatgacgtctgtgtagactgtagtaatgtgtcgctctaatgtacaaactggagttcgttggtcgagcaacggcagataaggtcttgaataactagacaaaactataacatcccccatatatatatatatatatatatattatatgtataataaaaaattttagtgaggacgctcatgatcttattaatattgctagtagtgaagagtcgagtctccgtcgtcccaatgcttgatccgccctaagtccaagagactgaactgttgattgatctcttgtgacagtaacactcccccgtgcatggattagtgtgtgtaacggtgtgtataatctttgaaagggacatcagtgcaaattaatcggatccgggagtaagcatctgaacttttctcactttgcaagagaagagaacacacctagctagctaggcatacgtattgcatttgcagattcagaatatcaaattgccattcagtgctagttgctcctagtaacaactaacaaaccgcggcgagatgacttttgctctatcgcttggctaactttacatgagcagcttgtgtaattagttgggctgttactttatagtgaagttctacgtatggaattatgccattacctctgttttttaaatatacggcagtgttaacttttagacattatgtatttatgtttgccgatttgttttgttattaaaaactatgtaagtgtcaattattttacttgtttttataattaaagacattttaagccgtacatattatttttgcatacctacgctaaacttttaaataaaacgaatggtgcggagagagttttttttttctcatgtcccagcaagtatataccatcggtcgctgccggcagcgtgcaccggccatcgcagaaaacgtaatcgggccgccagtgggtctagggattctagactattcataaattgtgactaacacttgagtcatattcttgaccaaacacacatattttagacccttcaattcttggagattttgttatccacatacgcatttttgaagttaattttccaaaggctgacatttgaacaaagatgtgaagcgggccttctttgggctaaatcctctgcccaatgtgcaatgtgtttgtgtcggtttagaggcccaaattgaatatatttcgtcaatcagctcagaccatcacaaaacggctagtgcaaattttcagaaaaaagcttaacataattttcccatgcgtttattcttgcaaagttcttactactaattagtatttgtaatttttctttgtgtagttttgtagatgttgggtatcaaaagttaagttgatctgatgatatgtgcgaaagtaagtacattgtttgcttgcttgcttatttgacatagctccagctccatgaaaaccttttagcgaagctagttgaaatggttttacaaaatatactagagaggtactacctccgtttcacaatgtaagcctttctagtattgtccacattcatatagatgctaatgaatctagacatttgatccacattcatatagagctaatgaatttagacattgtcatatataaagaatcattagcatctatatgaatgtgggccatgctagaaagtcttacattgtgaaacggagggagtagccattaagacaataagcaaactcaacggtaaggttgctttattcatatcaccttgccctcatggggaaaagttcaaatatcaatcatcttggacaaatgccgtccaaattcaaaatttattcgtactaatttttgtgttatctaaatgattaaatcttacgaggcttaatttgatactacttaatttccttcagttgatcaccaagcatttttgcatgaatcactcgtgcacttcttccttggtgatcttcttcgtcgccggtggcacatcgctgccgtggaacggcggcagtggcggccactggttgccggggtgcggccatgccggcatcggcggagggtggaacgggaacggcggcagtggcggccactggtttcccgggtgcggccatgccggcgtcggcggcgggtgggacgggaacggcggcagcggcggccacttgttgcctggttgcggccatgccggcgtcggcggcgggtgagacgggaacggcggcagcggcggccacttgttgccaccaggatgcggccatgccggcgtcggaggcgggtggaacggcggtagcggcggccatttgttccccgggtgcggccattccggcgtcggcggctggttgaacggcggcagaggtggccactggttgtttccaggacgcggccacgccgggttctcgccgccgccgtggtgggggctcgccgcctccggcgccggcggcgcatcaggggtgtacgactcgggcggcggcgccggcggcgaaagctccggctgatccggtggagcgtggcggccgtggtgcttggacttcggcggcgccttctcgtggtgcttcttgggcggtggcgccctctcctcgtccttgtgcttgctcttcttgacatggccgctgccgctctcctccttcaacggcggcggcgcctcgccgacggcgacggcgtgcaccggcgcaaccgcagtaggcggctcgaccaccgccggctcgatcaatggcggcaacgcgccgaacgaccacaccggcgccggcgccgcggcttggccgccggtgaccaggagcgagcgcgacgtggcgtcgacgcggcatgccgagagcgacgcgatggcgaggaccacgacgaggtacgacatcttgatggcaacttctacacgagtagaagttgttgttcttgatgccatattggattagttaattagcttcttgatgtgtttctgcttaaatggtttgcttgagctttatataggacttgaaacttgagtggtttttggttggtgagggtgaaaaatttagtcaaactttgtagaaactgcgactgggtttaattagtttggtaacaccacattcttgtagtggcttctttttgtctgttgaattcagaattacaggtgcatgagggagtagtagtaatgggttgttggtgtgtccatgaatgtgacatgcattagtgagggtttaggcaggagtcatttcttcatttgctcatggtggatctcctgtatctcttttttactggtatgtgttgcttattaattagccacattttttttctggtcatgaatggtacttcctccgtttcacaatgtaagttattctagtatttcccacattcacattcatatgtctagatttattaacatcaatatgaacgtgggaaatgctagaatgacttacattgtaaaacggaggaagtattagttctcaccatcacagttagtgcgttggtatggcttcctcacatgtggttgtcttgctaggtattactacgtactatttcctccgtttcacaatgtaagctattttaatatttctcacattcatatttatatcattaacatcaatatgaatgtggaaaatgctgtgaaacggagggagtagtatggaagagaattcccaactccccaagagaccaaacttgggctttaagacttgcatgcaccacattgtttcatttgtttcttgtatgcattaagaacgaaatagctagtggtcaaccttacggcatgctatcatcatttgtcactatgcttgggtagcaacatagggcggacgatgacgaggacgaggggtcagcaagtgacactaaaggggcgattttgacaatttgctactcttttgattgccattgccatcttatagagcatcactatacacattgattgccattgccattgcaccggtctcaagggaaacacattatggctccaaaggaacaagattatcttaattagtacctcttgtaaaaaaccacacattatagatgctcttataactgtgacacgtgatgacacttcgaatcagtaacatgtggatcaggttaggcaaatcatcaaatcaccaatctaatggttaaacccttttagctaagttttaaaatgtattccttttctaagctcctggtctgagtgtggaagattcgcgagagtggaaacacacaagacacgggcgatgtatacaggttcgggccgctgagaagcgtaataccctactcctgtgttttggtggatctgtgtatgaagaagctacaaagtgcgagccagcccccgatcgttccgggatcgttctctcctcctctttttttctctaagtgggcaaggtcctccttttatatctcaaggggataccacatgcaccatctctctctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagcaaacacgccggctccggctagggacgagtgcttggaggctctcgtcctgacgggatggggcgaggcgtgcgtcagaccgcctgtcgccacctagcccacgatctgaccggtctgtgactgatcacagaccggatgaacgagcgcgctgcactgcgttacatgcggcgtgacgcgctcgtccaaaccgcaataaatgcggttagggtgagcgc

SEQ ID NO: 9013 - DNA, 4659 bp, Oryza sativa
  unsure (1)..(4659): unsure at all n locations
cgaccccccctcccccccccgagggggttaggccacgtgggtgatcgtgtctgcctcaagtctctaagtcatgatactcccggtcccatgtcaccgacagctccaaaggaaaaagattatcttaattagtacctcttgtaaaaaaccacgcattgtagatgctcttataactgtgacacgtgaggacacttcgaatcagtaacatgtggatcaggttaggcaaatcatcaaatcaccaatctaatggttaaacccttttagctaagttttaaaatgtattccttttctataagagcaggtatagtagggtacaatcagcaggcggtagaactgttcatctaagagtaaagcctacatggaagagtgagaaaacatgagagagagagagaagccggcccttaatctatcgttgggctacagccattaaaaaaacagcatgaccaatcggtcatccatgcatgctgcagctgcaagctttttccaccacttaaacgcttcccaatggcctcaatgagagagaatagagattgtgagagaataatttttgctgagttggactttttatagcccgttgctggctatactattaaacctgctctaaccgttagagagactaaggatcgtgtcataatgattctatatcgatgcctctaccttaaaaaattatgaatttcactagactgatatttatttagtggctgttagagcctatgtgtttgagagaagtaaaaaggagaagatacatgaaacgagaagagcaactagtacatctattaattattttaaatttaaaatatagattaatataattttccaaactaacctttctatagattttttttttttacaaaaacacatcatcacttagtagttgggtaaatgtgctcgtagagaatgagtgaatttatctcccaatcagtatatgtggaacgcatggagtactccgtaacatttccgttataatgttagtggataaaattataaaaaaaagtaataattataactctgttacaaccatgacattcccaacacgttgggcccatataacaacatacatacgcgcgcactcttttttcttaaaaaaaacaagccagacattggattttctattcgacttatactaacaaaaactcttgaaggaaaaacgtacttggtaaataaaacataatctacgaatccggatcataatctacgtatgagactgagagggacacgagtgatttgacgggtaggtttctatatccttaattagtacggagtatgttcttattattctaattaattttgattttcctacataataatactgcatagagagagagagagagagatacaggtggccccggcacacagttcatttgcaacgcaacggctgtttcatcttctgacgagatcacatccatgcaaacgcaagcaattaattaatcccctaatcccccaaatcctcatctccaaatccctcctcgtctcgtcctccaccgtaataatctctgaccaaatcgccaaatcatccgcccagaaagccgccgatcgatctcgtcggagagggcgcgcgaccaatctcgaccgatcgatcgatgatgcctccgaagccggctgcggaggacgtcgccgacgagcagccggagccgccggacgaggaccccgacgtcgccgaggccgaccccaccggccgctaccttcgggtccgtgcgagcgttcttccatgttttgattttttttttattttttggcgaggtttatgctggattagtttagtttgttcttctgatttggctgattgatttcgcgcgtaatgacagtacagggagatcatcggatcaggatcctccaagacagtgtaatgcttccaatctctccctctcctcgattgttacacttctcggttaattatttcagaaccatgcgtacggaaaacattggtaacatgtagaataaaacacaccctaaatatcttagaaaatgattttagattgtttgggacgaacggatcatgaaatttctgcattgcaaatagggcctaataagatgattgccttttcaccggatatgaacaagaaagcattgtaaccgttttttataattagaagaaagcaaggtttcaattacacaacgcaaccagtcgaactgccattgccaggggagctaaagggagaaaaaaaccgaaaactgaaaaaaccgaagtacattgcaacagtgttcattgacatgatatactatgttggtaattatatgtgatatgcagctacaaggcatttgatgcggtggatggcatcgaggtggcatggggcaaggtggagataaacgagagaatcatgggttcatccaaggaattgcagcggcttcgcacggagatccagctgctgaaatcgctgcagcacaagcacatcctcaagctctacgcatcctgggtcgacactaacagaaggacggttaacattgtcactgagctgttcacatctggtaatttgagagagtatgtatttatatgccacacctgccattcctctctcattcttgctacaacactattctatttcttttttcttatttttttaaagcgggggttttaatttattttccgtttatgagtaggttttattggttctacattcatatccaccttctttggaacaatggtataaaactactccatctgttctaaaatttagggcatccttattgttagtaaaaatcaacctttggtacttttgataaataattatgctaataatatatatgcttaatgtcatgtatatcatatcgttagatctatattttaaaatactttcatatgatgctgattttatagttattataacatattatgaaagaaattagtggtcaaagtgtaaaaacttataggccttaaaatttaggatagagagagtagagtacatcagataagcaaaaaaaagttcaattgtgttttatgattagggctttgttttcatgcatcaccgatcgtttgggcttttatttagaagaaaatgaatacagcataataaaattaattggctatttggcttaacgttacatatttcttttgttttcactccactagatgaatgcataatttgcccattcaatatttgaaatatctttgacactatggctgtgtttagatccaaagtttgtatccaaacttcagtcattttctatcacatcaacctgtcatacacacacaacttttcagtcacatcatctccaatttcaactaatcatctccaatttcaactaaaatccaaactttgcgctgaactaaacacagcctatgatatgactaggtaccgtacaaagcacaaaaaggttgacatgaaagcaatgagacgatgggcaaagcaaatactgacagggttggaatatctacacagtcagaagccaccaatcatacatagggacttgaagtgtgacaacattttcattaacgggaaccatgggaaagtgaagattggagactttggtttagcaatggtgatgcagcaaaggaaaacacggagtatacaaggtcggtgaactgctccacaaaggccacaataattacaagtaaattaattacaaggactggagacggctgtcttctatgctttcttgaattttcttctttatcttcaagtaaaacatgaatcgacaattactcttgttaaatacaggcaccatagaattcatggcaccagagctttttggtgaaaattacaatgagctggtcgatatatattcttttggaatgtgcatgctggagatggtgacttgtgaatgcccatacagtgaatgcaagggctttattcagatatacaagaagattactgaagtaagtggccttctatatacagcattcatacatatacctacttctacgattctggtagctaaacatataactcttctacatcaatattcatggcgctgtaactcttcaaggtgtaaagccagctgctctctccaaagtcaaagacgcagaagtgagaggcttcattgagagctgtctagcttcagtatctgacaggttgcctgcaagtgagctcttgaagagcccttttcttcagagtgatgatgccaatcacagaagctccaattcagttcaagaaccagtaaaattccctgaaaacaattttactaaagatgaaccaatttttgtctctctggcgccgaataatgggacagtcaatgggaaggagcaatctttcatcttggtgcttcagaagagtgattttttgttggaagggaacatgagcaccaccaaccctgtcatgctgtttctgcgattccctggtcctgatggtaaaataataagcatcaaaatgacatcttagcctcttaggatttgaatgcaacttagtttctgtcttttcgaacaacaaaactgacttaaatttataatttctttttgcaggtaagttcaagaatgttcagttcccctttgacatggagaaagataccagcctgtcggtgtccactgaaatggttgagcagcttgagctgcctgaatggaacaaccctgtcttggccgagttgatagacgccttcttactacacattttgcccagttggaaaccctgtgttaaagttggaaagatgttgccaagttcttcctagggagtgagttgtccagttttccccatttcggtnnnnnnnnnnnnnnnnnnnnnnnnnnnnnnn

SEQ ID NO: 9014 - DNA, 376 bp, Oryza sativa
gcattgggctgttttttagccctctcgagataattttgaatggatctgcaaaataggagcttcactcatattattcctcgcaaaaaaagggtgacgatgatgtggatcacaccaatctttgtactgttcctcgcaaaatgtaagtgggatgatggtatgcaacacaccaacctctgtcctcagagggcaaactttgcatctgagagtacacttgaaatgtgctactagctactgtttccaataccgttctcttttttttttggtttttttatgcagtttgatgctcttggttctgcgttgccactatcatctgaagaggatcagctgaaaagaattaaagagctacaggtatgtctcaattttgccctctgagcag

SEQ ID NO: 9015 - DNA, 3526 bp, Oryza sativa
  unsure (1)..(3526): unsure at all n locations
ctctctgcttctgcgttagctttgtatatatttgaggttttcagtatagggtgaagtatggcaaggcttggagggcacgagaggaggctatgaagctcatttacggtgaatggggtgaagcgtatgtccgtttgcccactttgctgcaagccattaagcagaggaatcccagtatggtctaccacatcgatactcatcctgatagggttgtcaatgttgatggagtgaccaagaaaatttttatgcgtgcattctgtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggagaaagagaattcacgagactggtgctggtttatcgatcttgtccgacgggttatggttgggccacatagggaggtttgtattatctcagatcgacatgctggtataatgaatgccatgacgactcctgttccaggattgccaccggttcaccaccgatggtgcatgaggcacttcagtgctaatttccacaaggccggtgcggacaagcatcagacaaaagagctcctaaggatatgtcagattgacgagaagtggatatttgagagggatgttgaggcactaaggcagcgtattcccgaaggtcctcgtaaatggcttgaagatgagttggtggataaagataagtggtctcgtgcatacgatagaaatggccgccggtggggttacatgacaaccaacatggccgaacagttcaatagcgtgctagttggtgttcgtaagcttccagcgacggccatagtatcatttacgttcatgaagtgcaatgactactttgtgaacagacatgatgaagctttgaagcgagtccagttagggcagcgttggtccaccaaggttgatagtaagatgaaggtgcaaaaaagtaaggcgaacaaacacactgcaaggtgtttcgataagcagaaaaagacatacgaggtcacagagaggggtggtgtaacgcgtggtggtgttagattcggcgcaagagccttcaaagttgaagttgaggggaactcatgttcttgccaaaggccattgctctaccatatgccttgctcacatcttatacacgtttatctgattcatgcaattgatgaggaatctcccaaccgaatgccgtatcagttctcttcaagagccgttgtgaacacatgggcaagtcgctttgagccatacctcgaccccacacagtggctaccgtacgatggtgaagaatttgttgctgacccaaatttgaagattaaaacaagagggaagaggagatcgaaacgattcaagaacgaaatggactcgggtctgggtggttctggaaggaaaccaccttcatgcgttaaacttgatgctgcgccggtgcaaaatagatgctcgttgtgtcaccaggagggtcacaagaaaactaagtgtactaagcgtctaaaaaagaataagtccaaaaaaaatataagtgttaggggcgtactacgaggcccgtcatcgcggggctgcgatcgaggcggggagggtatgaatcggcattgattcacttgtgaaaaagtattggtagcgtgtatttgacattatattaactaattgatttacaattgctaatgcaggtacttcaaccgctccgagtcagagctcatgcccccctagtgttcgacgatagacagctctgtgaggcctgttgtcgtcaggcaccatcatccaacatgagtggttgtgtgctattgatgcagctgtggatgtggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttacagcctcaacatgtaagtacttccaatatcacttctagttagacatttacttctttaattgagatactaaccaacgacatctcttcaacttttatagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatacgacagttcgggaagaaacaagactggccggttgaggacatctcaactggagttgaattacacaagtaaatatttcttatctctgtttgctttcattgtcaatgttcaattttgtaccatttaacccttgtcgatgctcactattgtttcatcaccttctacttgtctaggtatgacagggtgagaacaaagaaggtgaaagactggaggctagagcataatagatacattgatgaatggaggacagccggaaggaacgacaggtacattgagcccatacaccaaaatcatcttttttcagagtaccttcgttggctgcataggacatatagactgttcctccgcgctacttggacggaagcggacatagagcgncccgcggacttcgatgaggggcggaatccctatgatgtccggactagagttggatatcagatggagcacgccccacttacagacagagtcgtaacttttcttgcatttgtcaaagttatttccatttgcaccctagactctaacatatatcttctcacgctttcagtcgagagagctcctcaggagtgtgaatcaaatggggcatgccctccaagctccgaggggtggtgaggacacggagaacacactccgcaatgttttagaggtaaaatttatttagcactttgcattacttgagttatgcctaacaaacttctttttttttttttgaaatgcagaaagttcgtcaaaggtgccggaaacttgcagcaagattaggttacaggtcggttggattggacgacgtgtaccaaccgcggagactaccaccaccactacctcaatccgggcgtccaagtaccgctcgacactccatcaggatagaagagcgtgaaggagttggtggctcgtcgtcgtcacgcattacgcaaggaaggggaaagggaaaggcgccggctccacctagcgatgacgatgacgacgaggacgaggaggatgaggactacgtcgcaccagacgccgaggagatagacatgtcgcagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtgatttgtatgaagttaatctattggttggtagtatgacatatgtggtgcactttgtg

SEQ ID NO: 9016 - DNA, 588 bp, Oryza sativa
aatgtctaacgaaaaaagttatcaaacaaggctaacatccactctaataaagtttacctatcttcttaacatatctgccacattatctccttctatcttttacacaaatagcaattctaccttgaatgtatctctgtgggctgaacaagcactgcatttgatgctgagagtatacacaaagctggacaaagtgagcctcaaattgttctgtttgttgggacccttgcaaagaactatcctggcataggtaaaaaatataactacagatgtatctttgcttatgtagagcactgcaactaactattttaacaatacagggttagctctgtcgagaggctctgcatgcaagtggtacattaacataaatgtacctgagatggttgatctaaagaataggttggtactagatactaaatgtactataaccatctatatggtcaaatttatttaaatgttctctgatacatgcattctatttttttcaggattggagcaaacttccagccaatcaaactgcttcaggcaccaaccacaaacattgctgatgaaaatgctgatgacaaaactgtgagagaactcttggacatg

SEQ ID NO: 9017 - DNA, 736 bp, Oryza sativa
caaatatgtatgtgtgccttaattgacaatcgcttaacccagtattttcagtttcttatgcaaatagtacagaattatatatgtaagcactggaattttttatactgaatgaaagcacgaaaatactgaaattttataaccaataaatgagtatcactgggaatttttattattaaaagaaaaaaattccaataaacatacacagctcttgaatgaaatttccaggactccacatattacactaattttataaattcacccacatcaaggaattaacttgagaaattcaccaactttttgggcctgatttacatgtactgattttatacacaggaggtgacgacaaggaacagcaagtgaacaaaacagttccatatattggaatccaaagtacacaagaccccatttaattggctgaatgcatatccaggtgacaaaatgcaaatgacagccagaaaaggctggtctgcatactctgcaggtaagtaagcaggagaaaagattggcctccaaagctacatcaaaatgcagccatggatgaaatttctggtcaaaagaacagagaggaagcatgcaacaatctgatgggtatagcatgcaatgcaaactcatgtacttctgctgaaaatgctgttctgcctatgccatgtgaaaatgtatggatctctgtcaggtactgcttttgagttttgagcagtcacgttatactgacacgcagatggtagtagagcaaaag

SEQ ID NO: 9018 - DNA, 26634 bp, Oryza sativa
  unsure (1)..(26634): unsure at all n locations
nnnnnnnnnnnnnnnnnnnnnnnnnnnnnnnnnnnnnnnnnacctcacgcagtgtgttctcaaattgtctcagttttccatcagtgctgccattgtagttaccaattattagcttcaactcaccaacagagttctcaagatggtgtgttctgccctctagctgtgatagccttgagcttacactttccagtgcatgtagcaggttatcagcatatttcttcattgtgcgatcaatatctgctatggagactgcactgaagttgcccctttcttcttcgtgactgaccttcttgagcacatgagactccaacatgccagcactctttgcacaatgagagaggataaacatgttaagcaatatatcacaagggaagagaggcagatcacttgtatgaattgataaatgaccatgaatcaaagtatcaaaaaattaggtaatttgctggacttgggatgaaaagatacatgtaattattgtccatgttaatgattgatgagttggcaacaaattgtattgctatattacctaaatcagaaattcacaaaattgccaaataaaaaatatcatataaaacctacatatttttcacgatagttcttttttcttatttgggcaaagtgccaaactatctaacctagaccttaaaggcttgaacaatcagaaccaactaaataaaggaatcaaaacaaatcagggccattgataaagtattagaatcacaaaattaaaacaatgctggcaaatatccatcgttccctgacaagggtataagcctagcaaagtgaacacttgacatattcgggtctttgcctcttgggataagagcatgatttacccataacagagtagcatctgaaaatatcctcaaatggttttaggaaaacaaactgattgaactgctcagtatcgtaatacagtggtgattacagtcaggggctcagggttatttccacagaaatagcattgaactgctaaatgtagaaatcaagctaactagtagtatcctaactagcactgtggtctcccctttatgagcagataaggcatcaatcttcaccaacatcgaatactaaaatgtcactttcctttctatatctgaatcatgtaatagcaaacgagcaatcacaacttcacacaatcaattcgacatcactacagcgcagagtcacaaagtattaccaatcacctagaactggacattcctatggctaagaaaagcacacaagcttacgaatgtttggaaatttcgcttgttcaattcgtgtgtgaagcaggcgaggcgaggcgagctgagcagatctatcggaggcgccctcggctgggagatgataccttgaggttggaggacgccgccttggagtcgagcgacccccaagggctcgccgcggaggccggcgccgcggcggcgggagcggcgcggatgggctggaagtcgtagctgggcaccacctcgtcggcgccgccgtgttgctgctgcccgcggcgcgcgtggccgccgccgtcctcctgcgggtcggggctcatcagatcgaacagcccgccgcccccacctcctcccgccgcgggaggggacgacgacgcggcggcggcggcggcggccgcaccggcgcccgaggccgcgaggccgaggatctgtttgtccatgaactgcgacgcgttcatcgcggcggcgggcggcggcggcggcggccggggatttcgccggagttgctgcggcggcggcttgcggaggggagcaaggtgaatgaagtgcttgactgcttggttaggaaggaaattaaagttgggcttcaaattaaaaataaaataaaataaaatattttttaattttatttaattttatttttcttcactggaggagacgacttacgacttggagtacacgactagtcctccgcttgggagttcgttgggccggagaagattcggcccatttaagagtgggtcccacctgtttcggcccattatgagtagaccagcatagcatcggcccgatccggcccagcagggaggcgaggctcgccggcgcggcggcggcgaccgcgggtagggtgggtggcgcgggccgccgccggttcgacgccggcgggagcgccgccgatcgccgctccgtcgtcgtcgccgcgaggttcggatcccaacacgctcctccctctctttgtgctcgtcttctccgactccgaccatcactccgctttgcgcgtcgcgggatgggggaaatcactcgtagtcgtagcactgcatgagttagcgaaaggggaatggttcatcgcgcgagcgcgagcgcgggatctcgtcctcccgctactggttatgcagagaaaacgagaaggggtttctgattattttttttttcacgctggttttgttcattagttgtgtgtcatttggagtgtgctttaagattaaggtaccatcattcgttcagtcaattcttcgatcatcatagcttgtatgatctttttgactgtgcaattacagcatgattcaaggcttcaccagattctgatatagtgatatatatatagagagctgcctgggaattggagttctgatgaactggaggtgcttgcttgcttgctgttccattacacagatcacaggtagtagcttagtctaattaactagtggttttcaatttttcatcatgaacactgttcctgcaaaagaggtgatgtgtcgtcttttccattctgtcttgcctgaatggtctcaggggttatgaacttgtactgtaattggcaaaatacagcattagccaaaaatgttcatcttagttctcaatttggttttggttagcatgtatgcatctgtattttctgtctgatacacttgtgcatctgcattttctgtctgattcacttgttgtgcatctccgctttgctgcacatcctgtttattcaactttgtttcatgtcttttgtgttgtatcctctgcacatcctgttccattcaactttatttcatatcttttgttttgtatccgtatgataggcaaaaacattgtctaataggctgctgaaaaaaggagttcctattatatggataaagcaggaagcatatgcaatgcactcgctttcttattccctgtgatggcctttgtgtttcttctggatattgtatcacgctgatgctatttttgaaactgctacttgctgtgcatttttcaagagtgcagcatgaaggaagaggaaatttcgtgatgaatccaatttgattgaaaaccatgttggagaaaaatgtgttcaggaaaaaaggaaatcttcatgaaatgtttatgattctttttttttttgaaaccccaaaatatttatgattcggacattaaaagcaaaactattcagctatgtgcttaaacctaagtaaagaagttttctaggtggtttgattttggcacaattatttctatataaaacaggaacaaaatttatatggccataacatgttatttgttataccattctgaaatcttcttctattgttgtaagtggtattttgttatgaaatggtacgtgtggtgatgttctcctttttctaatgaagaagattttggttattcttagttgaagtgtttattgtaataatgtaaaagtatttgatttgatagggaaaatggtaatcgcagtatatctatttgagaatcatgaagatcccttcatttttttcaagaagtttttgtttctacaaattgttatgaaatttgcctcaattccttctgtatcagtaagttcctcaattatagttctacttcgtgctatcactttcagtcaatgtgctgtttgcccatgtgagaagatgaaagtggcccttgttccgttgttaatgggctcaccatttagtgccaaatgtacaattttttggttttaacattcggggcctccttccggaaataaattagaatgtaccgtttgaaaccatgcttttgtcttttcttctttttgcagtgagaccattcttttgtcttagcacttaagtatttggaaatttacctttgctgaacgttttccctataaatatgagaatgatggtgacatcacataatataagtgctgaagagttatgcctgtgaaacaaactgatggaagatcgatgtgaaagtttctggtccttgttgctctgcaattgctgtgcaattagtggccgtgctgaagagaacaatagtttttaccaaaactaattttatatgtggactgtggtatactgtattctcaccagactctacttttgttgaaataatcttggctaagattcatggcataaagttggtgaactatccgtgtaaaaaggtccatacattgagctacagaaaacaacttccttatgaattagtgtttagagaaacaaaatggtgacatcattttggtatgtctttttgtgccatgacatactacacagtttttccttggacttgcaaaaagccaacttgacttcatttttgtctgtatttttggatcatagcttactgccatagttctctgtcttttaacaccgtccaaatgtaagtgcccttgagcttttgagccttttttgcttcttttttgttgctatacaattaatgcaatgtagcagttcccttaaattgagaaagggatcactatgagatgatgcatcccttccacccagttttacaatttgtataatattaagagtcaccattggtgattgtaatgctttccgttaactgaaatatttccattttctattttggattagctggtgcggtatttgattagttgtcctgggtgatttatctatccaattcaagcgatggaaaaatgggaatccacttatttgtatttatgtgttcctgtaatgcacgtggattctctcctacctattggttcttgatcatgagttcttaggtcaattttactgtagttgcattccctttcaatttgtaatttcaatgcaaagatgctatagcatctgttttggaagcattgcaccttggatttttgcttcattgttctatgtcttgatgtcatttgatttgaccatggaacctcactcctgaaagtaacataaggtgatattggaaatgaatgtagtaagtacaaacttaggatttaatgaaagtagtatatcaaagaaaagtgtgatgcgttttatttgacactggttgagtgcaaaagacttttgtcaccacacagtttcgatataaattcatatgatcattcaggaacatttaacttcatatgtagttagcaaattccacaagtaacctctttacaatggaacaggagtgcagtgaaaagcaaagctaatctttcttgggaaccattaataatttgaaaatttcaggagaaggtttaagctgatgatgaacaagaaacgaatatactgtataattaggtgcacatgataaaaggtgatgaggtcagaaagtagaggtagatggtaacagctatggtgtgcttatatgagtacttttggtttaattgctgcttagagccgaaagagatcaaaggacttaattccactaccctcaaaacccgggcactgcccccaagatggttctctaaagaactatattatctttgtcaattaaataatagctaaagattatagtttgggtgtgttaattgaccccctaccagttctatatttgaatctaatcatttcacagtatgcactaaagaactgattgatttttgtgtggtctacaagtccaccccctgagagctttgtattgattgattcaccatgttactaattgaaagttttattggagtaattgataactgcaaaagtagtaaagctccttatttgccaacttgttgatggaaacactgtgatgctaatacatgaaactgtgatttaaaaaatacctacctcatgatgttagtgttgaccaagtttcatatgtaatagtcttgatgaagcacatgctatgtatttatgtgaaattttggtacacataaacaaaatttgtatcacgcatttgttaatgagatatccaaaagaaaaatctctgcttcatacctgaaggttctttcatttctgcaacttcgatttaactggtaatggcattatcctcaaacatgacaggacttagaaaatttataaaataaagaaaagagaatggagggagtatatgtttaaactaatactaaaccttctaagtttctctgttggcaggtaaactgtttcgttcattgagtcattcatgatttcagtaggaaaccatattcttgggagaggtttacgattttagcttccagtggcagatgcatttgtgttgagaaatatttcatcaggtaaccatttggagatgaagtgaaaattaacctatgtagcaaaactgcacttcaacacttctatgaaaaatccagatcatcacacaatcacacatagcaaccaattgtgttttctctgttcttatcttcatatcctctttggaatgtggagttgtacaatggactaggtgagtctgtttgtctgcttaagtctttgcctcaccaagcgacagaaaaacacatttcttttttgtaaagacaagaaattgcatattgttagccgccccaccctgtaccttcatggctggtctttttggtgcattgctcatcacgagagtacgaagcaccacttaaggcactaattccacttgtttattgctaatagcttccttatcatttttcatcaaattggtctctcctgtgtaagtgtgttttttcttcttcttaatgaaatgaagtgtggtcctcctgcgttttcaacaaaaagaaaaatcatttttcatccaaaaaaaaaaacttgtctatcatgattcatgcccttagtttcctggagcactggagttaaacagatggccacctccccccatgatatctgtcatctatgtatacttgttccaccatctccttctcacatgatgcctatcctaggcaggccctgtgctattgtattcttcatgtcttctactcctgcatgtgccctaccacctccccacatctcatgcctagattccctcctcctcaattcccctcactaacaccatttcagttcttttaaacaatgcaatctttgtgcctattattgttactagcaagttgcagtttagctttaaaatatttctgattttgattgcctttcttccttttctttcccccctttctgttataagtgtgatctttgcttttgttcttaaaacttccctttcatttcagtttgaattatttacatgtaattgcaccacactaacaaaagatgagccacatgagtagcaatagcacaccatgtctaggaggagctacagacgaattggaatattattgatggttggatacagtcacgcggcaagtatctcaagagtccactgcctcacgtgacaggttaatcacttttgcttagtgaaatcaaagatatatactgctagtgtcaaaaaaatgatatgtactgctggctctttgagatgcctttcaactaaacgctggttaaaatactgtcatgaattgcatgcacaagcatcacgagaatagatgaactgatcaggaatttgtcaacaagactgacagtgccatatgctaaggacacaataaatgaattgggtaaacatgtttaggctggtagatctaggtgatgatgtggtgaaaaccttggaaactgtgcaccctacaaatgattgtactctttggtatttgtttacttgttgttttatcagtaattaagcaagtacgactctctctccctccattcccttccattcatgtataacttggttagcttttgcagttatgcagcttcgctgctgatgaattgttacaagttaatgaacactaatctcaggatgattcatgagaactgtaaggtatgaacaagaatcatccgtgaatttttactggtggtaataaccggtaaccaaattatcattagactttactcctcattttgttcatgtacacttgtcaatcactgtatttgaacatgctagaatgttcactcatgtaagcattctacttctacatgctagttaaatacacatcataaacatatctttttactgcaaaggcagaagcatgtaccctatcttttcgggtaaaacgaccaacactgcaaatggaagttctaaccccaatgtaaatactctgcaagtttccattatcttctacgggattagtagttcagcattggtcaatccgaactgcccatttaccgatgggaatttggagaagaaggtagatctagatctgcgagcctgcaaaatttcctgtacttttactagtataatccagctgctagctagatggcggcttcctcaccattaacacaaagtacaagaggcagtagtaattaactatgaacttgacagtggaaaggtgagattagatctaaccaggggcatgtgacagcctctgctggggtttttaagatccaatcctttctgtttatcctgacaagaaacagcctctgccatgcggtttatataattgttactgcatggaatgaactgtgttcttctctctgtgtgtcatgtgttaccactaagcacccagctgtgatgtccctttttattcttatttttcaactttcaactctggagattcttaccagcgcagttagttcaattctcaccctgcaatgatcataattacagtgcagggctttactgtctacttacacgatcacattcagaaatggctgttaatatgtaatcaaacaaggcaaaaaggtcagttaattgttgtcttatattccaatcaacatgactctattctttctaacatctatgtttttgagttactgacttgagactttgctgcccatatattcagagtttttttctgcatttctgaagtaccgatgacccatttttctcaagtaagaatttactaattcccatttccaagttgtcaactcttgatgttcttaattcatactagtaagttcaattaccaccctgagatgtgaaaatctacagccaagtccttacccacagtctgttaaagctgttgctctaactgcatcttatttaatcatatcccccttgacacacacagcctttccatgaagttgcttaacctgatgccattgccatgtctctgggggcaccatcttttactctcaagccagcaaagctgttgcttcagttaaaaaatttctgcatcctctctcactcccctctttaagctccaattggggcattgcactgcattgcaaagcaattagtcgttggtgatggctgtcaaaaatttatacacccaatcaccaatcctaacagcagcattaaccatggtgattatgtgcattgctactagaggccataagagattgctactaaagtagtcatagaagggacagagtgcagtgttagtactgtgctctgtggccttggatccagagattctgcagggacagggacaagtctccattgcttcattcaccttcatgatctcatcagactcaaaaactcttcaacctctcctacctatttagacacctcattcttgtttcttgatctcacctcttccctacaagcatataaaaactgtaccatttgagatggtctctcttctctctctctctctctctctctctctctctctctccttcatactaaaactttattaggacttcattgattagttagaggttagtagtacttagtactagtcttgcgacataagcaagaccaagatttgggagcaattaacacaagtacactagaatccctataggattagctactacactttgcatagtagtgtgtgttcttggatatacttgcatacaagtagaggtacaaagagtgtggttattagtgtatatgcgtgatgagtagcagaagcagatggagggcggcgccaatggcgtcgaggtcgccggcggcggcggcggcggcgatggtcatggcgtgtgtggtcgtggtgctgcgcgtgagctgcgtgctcgccgtggacgagcagggcgccgcgctgctcgcgtggaaggcgacgctgcgcggcgacggcggcgcgctggcggactggaaggccggggacgcgtcgccgtgccggtggaccggcgtgacgtgcaatgccgacggcggcgtgacggagctgagcctggagttcgtcgacctgttcggcggcgtgccgggcaacctcgccgccgccgtggggcgcacgctgacacggctggtgctcaccggcgcgaacctgacgggcccgatcccgccggagctcggcgagctgccggcgctggcgcacctcgacctcagcaacaatgccctcacggggacgataccggcggcgctctgccggccggggagcaagctggagaccctttacctcaactccaaccgcctcgagggcgccatccctgacaccatcggcaacctcacctcgctccgggagctcatcgtctacgacaaccagctcgccggcaagatcccggcgtccatcggcaagatgtccagcctcgaggtgctccgcggcggcggcaacaagaacctccaaggcgcgctcccggcggagatcggcgattgctccagcctcaccatgatcggcctcgccgagaccagcatcaccggcccgctcccggcgagcctcggccggctcaagaacctcaccacgctggccatctacacggcgctcctctccggcccgatcccgccggagctcggccggtgcgggtgcctcgagaacatctacctctacgagaacgcgctgtccggctccatcccggcgcagctcggcgggctcgggaagctcaggaacctgctgctatggcagaaccagctggtcggcgtcatcccgccggagctcggctcgtgcgccgcgctcgccgtcgtcgacctgtcgctcaacggcctcaccggccacatcccgccgtcgttcggcaacctctcgtcgctgcaggagctccagctcagcgtcaacaagctctccggcgccgtcccgccggagctcgcccggtgcagcaacctcaccgacctcgagctcgacaacaaccagctcaccggcggcatcccggcggagctcggccgcctcccggcgctgcgcatgctctacctctgggccaaccagctcaccggcagcatcccaccggagctcggccggtgcgggagcctcgaggcgctcgacctctccagcaacgcgctcaccggcgccatcccgcgctccctcttccggctgccgcggctgtccaagctgctgctcatcaacaacaacctctccggcgagctcccgccggagatcggcagctgcgcggcgctcgtaaggttccgggcgagcggcaaccacatcgccggcgcgataccgccggagatcggcatgctcgggaacctcagcttccttgacctcgcgtcaaaccggctcgccggcgcgctcccgccggagatgtcggggtgccggaacctcacgttcgtcgacctccacgacaacgccatctccggcgagctgccgccgaggctgttccgggactggctctcgctccagtaccttgacctttccgacaacgtcatcgccggcggaatcccgccggagattggcatgctgacgtctctgactaagctggttctcggcggcaaccggctgtccgggccgatgccgccggagattggctcgtgcacgcgcctccagctcctcgacgtcggcggcaactcgctctccggccatgtgccggggagcatcggcaagattccggggctggagattgcgcttaacctcagctgcaacggcttctccggcgcgattccggcggagttcgccgggctcgtgaggctcggggtgctcgacgtgtcgcggaaccagctatccggcgacctccagccgctgtccgcgctccagaacctcgtggcgctcaacgtctcgttcaacggcttcaccggccggctgccggagacggcgttcttcgcgagactgccgacgagcgacgtcgagggcaacccggcgctgtgcctctcgcggtgctccggcgacgccagcgagcgcgaggtggaggcgcgccgcgccgcccgcgtcgcgatggcggtgctgctctcggccctcgtcgtcctcctcgcggccgcggcgctcgtcctcttcgggtggcaccgccgcggcggcggcgcccgcggcggcgaggacaaggacggcgagatgtcgccgccgtgggacgtgacgctgtaccagaagctggagatcggcgtgtccgacgtggcacgcagcctcacgccggcgaacgtgatcggccacgggtggtccggcgaggtgtaccgcgcgagcatgccgtcgtcgggcgtcaccatcgccgtcaagaagttcaggtcgtgcgacgaggcgtccatcgaggcgttcgccggcgaggtcagcgtgctcccgcgcgtccgccaccgcaacatcgtccggctgctgggctgggcggcgaaccgccggacgcgcctcctcttttacgactacctcccgaacggcaccctcggcggcctgctccacggcggcgcgatgggcggcggcgccaccaccaccgccgccgtggtggagtgggaggttcgcctcgccatcgccgtcggcgtggccgagggcctcacctacctccaccatgactgcgttccagggatcatccaccgcgacgtcaaggccgacaacatcctcctcgccgaccgctacgaggcgtgcctcgccgacttcggcctcgcccgtgtcgccgacgacggtgccagctcatcgcctccgccgttcgccggatcctacggctacatcgctcccggtaagagccttttctcacactcacacacattcaccagttcaaacaaaatttcagcagtttaattgaatttgttttaaaaagaaaagcacaagattaatcaatggctgatatttgatcttgatcaacgcagagtatggatgcatgaccaagatcacaaccaagagtgacgtgtacagcttcggtgtggtgctactcgagatgatcaccgggcgccgcccactggacccggcattcggggagggacaaagcgtggtgcaatgggtgcgcgaccacctttgccggaagcgagacccggcggagatcatcgatgtgaggttgcagggccggcccgatacccaggtccaagagatgctgcaagctctcggcatggcattgctatgcgcaagcccacgacctgaggatcgaccgaccatgaaggatgtggcggcgttgctacgtggcattcgacacgatgatggcgtcgaggcaagaaaagccggcaatggagttggtactgatgcagagacaaggaagcgggctgacccgagacagcccatttcaccgaccaaactcatggcccttgctagaccggcccaggcccaagcccaactccaagcccgtgctaattccggttccttgggcctgctcaacgatcaggagtgagtaatacagtaatatagatagttcaaactgaagggggcccactagcagtgtgatgtgagggtgatgattgttgatgttgaccatgcaaccatgggtgtaggcactcacggggacctgtaagaaaaggatggtttactgtttgctggtgggcccagcttgccatagactgtagggggtgtgtcgttttgctaggtgcacccttgtgggtacagattgggaatatgttatctttgtgcttagggttttattatttagtgatcataggagatatgacggtcaataatcttttgtaccataaattggggcataatgcgcccaatggattattagtgtaaattatcccactaaagtaataattgctagccatattatgggtgaagatgtttgtcaaagagagcacatgttcctcttgttgttcatattgtcccatttcttttgtttctttcttgagtggtccaatcttgatttgtgctatcaactgcatatgtaagctagcaagatgctcttttagatgtggattagtctgtacatggggtctacatttttgaaccagctaatagtttagggccctttgtagagcaacatgggtcattaatcagaattaatggaagcgtgccaccaatgattaaatcatttaataaggacgatgacagccaactcatcaacaatagtcctattttccgatgccaatatgccattgcattcacttaggacttgcatgtcccaaacttcagtgatattatatacaaaaaaaaaattctaaaagggggcctgttagaaactactggcgacaatactaaaattgctccagcagtcaggcacagggttcaaaatttcggatcgaaatttcggttctatcggagacccccccccccaatacgatcaaaatttttaaattttttttcatttttttcatgaatttggtaatattttgttcaaatttgatcaaattttattcaagaattcataaattttcggaccgaaatttcagaatttcggccacccccaatagaaatcagcaaaccgaaacattaaaccctagtcatgcatggatcatgtttgcctagtgtttctttccccccttttttttttctgtatgagtattatcgttatcaatttttggacgcaatgttccacttgacacactcaaaaccatacattcacacatccttgaaaaatgttggcataaaagtctcctagaaaaggggcactatcatcagaattaagataagagagtgtagagtagatacacacacacacaagcacaccactatgcatttggtcacaaactagctccctagcatttctaaatttgaccaagttattttttttcttctttttcagtgcaacaagtttgttttgtgttgcgtgtccccgaagaaaaaaaaaagaacaagtttgttttgtgcaaaggctaaaaaggccaatgggcctcatctcaggaaagaagacattgtgggcttcatatcgtttcaaatttgggcttgggctagagtgtgcacatcccaacttcccaaggcccatttacctctctaaaatcaaaatcaaatttcagcccacatcaccatatcccaaaattggaaaaagtacaccgaaggtccctcaacttgtcatcgagttacaaaatcgtcctcgaactgtaaaaccggatacaacgtatccttcaatttacaaaaacagtacaaactagctccctcagcggttttagctccctcagcggttttaactccggttttttccgacgtggcagctgactcagcgtgagacccatgtgggtcccacgtgtcaacctcttcttcccctaccctctccacatctcttcctcctctttctattctctcactagcagcgtagccggcggccggtgaggaggaggccagtggggaggcgggagtccggcggcgaggcggcggcggcaacgaggcgacgacgtgggagcaggagggcctcccaacgccgccgccgccactgtcgccggcggcgcgggcgccagatcccgccgccatggctcctcgtcgatagaacagccacagggcgttctctccctgcgccgcggtggcgttcgcggcgatgatctcgtccagctcgtcgtcgacggggacgccggccagcgccagcgagagccctccatccccaacctcccctaatcttctccacggcaaagttcacggtcgtggcggcgagagctccgaaacaaaggctgaactggatgccgttgctgaatgctccccagtatcgcgccggtgccatttcagccatgcagagtggcatagacagcaaaatgtttcaagaacttgcaaaattcaaaaaactttgcagaagatttgtccaaatggcacatcaagaatttgagaataatttgattttttcagtgttgtgacctcggtggtgaagccgaggccaacgccgaggaaagccctaccaaggatggcaatggacacgttgacagcggtgccgctggccgccacgccggcgatgtaggcgaagccgccgaggatcatggacgcgcggcggccgcggctagccgtgacccacgacggaggagcgcggaggtgagcaggccggagatgtagagcgacgaggtgaagagcgtcagcagctagctgtcgaacttgcagtagttgctgacgcggcgcgcgccagcgccggcgcccgccatccgccggagcacttccggtaataagtcccttaggaacgactccatggacgacacgccgcccgcggtgctgatgtcgtagccgtagatggcgccgcccatcaccaccgtggcgcaggacagtgccacgaacgccatgaccctcccggcgccgcccctcgtcgtccacgaatccggcggccataatggctggcagctcaaggcaagcattgtgtcggaactgaaccgagcaagcttgtttgcttgagctattgatttgactgcttgacttgctctgctcttatatatcgttccaaagattctggcggctatggcgtgaaagctcgatgtgacattgcatcactaatcaccattgccgatttacttgctcatacatacatctgtttcccgtccgacgacgacgccgagccgcctccccgacgccccgccgcggctccgacgccgcacgccgccaccgcttcccggctcctactacggcagcgcgcctcatcagatgccaggttcctcccgcgacggcgcggcgacctccttcccaccgccggccggcctgcccggagagaagaaagtgagagagaggaggaggaagggagaggagggggggaagagagaccctgttgacgtggcacctgacatatggggccaacacgggtcctacgttgatttagccatcacgtcggataaaatcagggtcaaactgctgaggaacctagtttatactggttttgttagttgaaggatgcgttgtatccggttttacgattgggggatgattttgtaactcgatgacaagttgagggacctccggcgtactttttcccccaaaatttgcaattcttctctccgattaatccatgcaatctcaagacgaatgcattacacatgcaacaaagagaagatgtaagactgtaaatttgaatgcaaaaatatacataaataatcaaactaagctaaaactcgatgaacatatgctcagtcacacaagaacctgaagaagattgagagggaaagaaaaagcaaaaaaaacaaagagaagatttactctatcgtatattttccttgaattagctagcatcatcatctcatgggcagcgggcgttccggccagggccgccgtagtagaagtacctgccccaggcggcgccctggccgccggcgatgtcgtagcaggcggggtggtcggcgaggaggcggagggcggcggcggggatgaggttgttgtcccagtcgacgacctggacgttgcggaagtaggcggcgcggccgtacccttcgccggggaagcggccgctgcccatctgcgtcggcgtgtgcgaccccgacggccgcgtgttcaccacctcgccgccgaactgcgccatgtcggcgcgcgcgcccaggtggctgaagaggaacgacggccagtagcccaccagcgcacccgaccccagctgcagccaccagtgaccctgcttcgggtcctgcgttgagattcgtgcgcttattcagactttttatctcggtttcaagctactaaacggtgcgtttcgtgcagtttcaaatatcatcttggagtttagctgttcaaatatgttcagattgtgagagaattaagcacacacacaaaaaaaaactgttcaaatctcgcagtgcttaaactgaggctctgtttgaagaaaacaattgatatgtaactagctggtgagaatatggaaaagctacggtggcaacttttggctacctgttcattcttagattctatatgtattttcatagtttgaattcggaggaaggattcgaactgctttgagaaggtggagattcttacaaccccattgtttggttgtttggaggaaaaaacaaaacggcatatttacaggtgaaaaataatttgtgaataaaacgtttatatacgtgtttttaacgatctacaagcaaagggtgaaaaatacactacgataaataaaccctaaaattaaatctaaatttaagattgaaaatttaaattttagctgataagtataagtataagcgaaaagataatgttgttagagtatatgctgacaaagctaagttcacattcccaataaaaatcgatcgagtgaattccgcaaagtttggtgtttcgagacagctcaagatgggaatagaatggtttcatgaaaattcaaatttgaatagaaaataagaattgaattaaattcctataaataccatggcatttgtagtactaagtagtatagtaaattttcaaaaaaaaaagtttaacttattatatgtagtttgagatctccatctatgaaaattttgccttttagaaaggaaaagacttcatggactatataagcccatcacttttggcctattgagcctatttgagagaactaacttcttatacacctatatgtttacaatctcagtttccagtcaatatattcgaatttcgttcaagatcgcaaatcatcgggagagtttatattcaaatcttggctttcaagctttgtttgaaattcgtcaaatttcattcgaaattcacagaaaagtgcgcacaacataccttccaaatgaggagggtgatgtcgaactggcggccggcgaaggaggagatgggggagatggcggcgcccatggcgatccggctgttggtctggacgaaccctgagcagtgcaggttgtagcaacccgtctcctggtacgcatcattctgcacaatgcatcattcttcagtaacttgttctttgaactgactgatctatctctcttctaatactgaaacactaggaacagattactactttactagcaaagaacttactgtccaatacgtgaagaaccttgggttgttgtcaccgtacagctgagggctcacctgaaaattcatcagaaagatacaggtagctagatacgatcagtattcagagttgagagttgagagcaatggcaatctctgaaattggctacgcctgaataagtttaagaaaatgtagcgttggtttcagggttaacgatcccgataccggatcaaaatccgctcacgagcggtatccacggaatccgtcgataaaccgataaaatccgaatgatcagtatgcagagctgagagtaaaatgtaatctctgaaactggctactagctagctaggcctgattgactgaacaagtttcagaaaaggaggagagaaagaaaagaaaatgtagcacctgccatccggcctcgatggtgttgaggtcattgccgaaggagccggagatgagccagatctgggagaggctgaactccgccggcgacgccaccttcgccggccacacgttcaggctcgccttcgccccgtagaattgccccccgctcatgtaccccaccgcatgctgcatatgcataaatttgttttgctcaccaatgtcagtatcaacgcaaccaaattaaagccctcatcttttcgcttatccctatgcttatcaaccaaaatttgaatttcaaccttaaatttagagctgattttagggttttattgtcgaagtttatttttcagcatttacttttagatcactaacatttatataaaagttttatatgtaaattatttttcgtttgcaaatatacctattggcttattccacaaataagtgaaacaatgaggccgtaaggcgtgtgtgcgtgtaaattaaccatcggcatctgaccgacacacgccagtttatttggcaaacaaaaccttgttggttattacaggaaaaaaaatacaggtaaaaacaattatatttgtattcttagcgatttaaaagctaatactgataaataaacaatgaaggaaaaaccttaagattaactttaaaattaaatattataattcaaattttgactgtgcctgagaagacaacatccaaacaatgacggtagtaacaagtaagcactccctccatctcaaatcaagttcagttttgttttggacattaatcttgatataagttatgtctaaattaatatattaaaataaacttattttgggagttggcacggaggtagtacacacgagttaacaaacttcgcatcactaccatatacaagtatatatgggggttattttagctcaattcagtaaagttgtactcagtaacattttcttaccgacaaaagtacttctttagacttcttactactgaagtattatttatttagatttttccttctcatatgatttagagttttggaatgaaataaaaaataaaaaaaattatctcggaaaggacgtaataataaaacaatgtccgagaaaaagaaaatcaaatttgtctattttatttgaagtttctcaaagtttagtatgacgcttaagataagattcaatcaaacttttaaaatttatagttatactatcgataatttattaaatacttagtcttaaaaaataaaaaattgcatgcatatgtttttcttaaaaagtattatgatattatcataaatttatcatttttctaaaaaaaatattctaacacaaaattgatgttaaagtttaaccaaaccattatcttaaacgttaaatatttattaccggagatagtagcatttgacatgacctatgatagataaagaaagaaattaatttattatccgaattaaaaaaactttctcgattttaaatcattgtagtttccctttgacagtaaaagaaactcatttgtttcagaatccagttttttcaaatgattcacaaaagagaattttaaccctggttgttgaaaaagatagataaacttttgagcatgcacagggcttgtcagctgtggtggggcccacgtggcacgctgacgtgtccacctgccgcgccggttatagttggccataaggcccgaggcccgaaggcccggcccacggcacgcctttttggcccggcccaagcacggcactgcccgacttgggtcgggcccgtgccggcccggcccgaccgtcgggcagtgcctggtcctccccaccagcacgttgggctagcccggcacggtcgggccggcccggcacgatgggctggcaggccagacccggtacacaaagtatagggactaaaaatagacatataaatgtcaatgtctaaagaatagggaccttaaatagacttattttagctatttatataccacaccacaaagaagagggaggtaaaatagacttttttttagctatacaatgtcacagcccaataggagggagaaaatttagacttattctgaggaaaagcacgatggcccatcgtgccttcgggccgtcccggcacggcccgaggcgtgttgggccgtgcctgggctgtgagtgcggcacgtgggctggcacggcacggcccggtgcgtcggtcgggccgtgccggcccgacaagcctcggcccaggcacggccgggcctgggccgtgccgtgccgggcggcccacatggccatctatagcgccggtgcactccagcacggcagtacggcttgtctgaatccgtcggcagcggaagctgaagctgaggtgacgtggcactcacctcgtggccgctgctggtggagtcgcgccgcgccgcgccgccgacgacgccgacgccgcgaggcttcatcccgaaccggccgccggcggcggcggcggagctggctcgcagcaggtcggcctccgtcgtccgcctcaccggtatcgtcccctccgggcacgcctcgccggcggcccaccacgcctgccgcaacccgtgctcgccgtcgtcctcctcctcccggtgctcgccgccgccgccgccgtgggcgtgactcctcctcctcctcctcctcctcctcgtcgtctccgtcggcctcgccgagggcggctcctgcagcgcagagccgtacaccaatcaatcattgatcagctcgacgcgacagcacacgcgccaccgtacgttgagtacagcgacgcaatggtcaggtcaggtcaggtcactgctccactgcttctgcagcggcagccatggccgccgccgccgccgttgctcacctctggcttttggcctctcagcctcgggtgctcgaacgccggctgcaggtgagacggcacgcagtcgatcacgtcgccgtcgggactctgcacaatcatccgcaaatatgccgatcaaccaagaactccaagaacatcaaacaagattagctaatcaagattgagtaatcatgctcatgcctggatcgtcttgacggaagctctcctgaccctggcgagctgtgccctgactctctcaagccggagcagctcctcgccggggtggagcgccgccgccgtgccattgctggacgacgaggcggcgacgacgacggcgaagaagaagaggaggaggaggaaggggacaaaggtggcaatgattgggcgaggcctcttgtaagagatgatgaagcagcaagaagccatcagagtggagctcatcgatctgggtttttggagccgcctgaattttgtagtgggatccgatttccgatcaatgacaagctagctgctgcaacttctgctgctgcctcttcttgtgctctctcctgaaaactgtctgtatctgccacacattggtgctcttgtcttcttcttctcctccctataaatacatggatattgttaccacatagtagtagaaagatagtccatgtatcaggtgaaaatgaggctaaaaataaactaggagagtaggaggtgaagttaacaactaacaatgcaaagttgttgtgatgttggagtggtagcaattagcaatgggaaatggctgcgaattgcagtgatcttcaccaaccagcacagcttttaggtttcaaggaccagcataattgtctcaaaatgagcaccccacatctccatgcttacatcattttactagccatatgtttttcatgtcccctctctctccttctctctctccagaatccattggtgacctttggctggcctctctcagtggggttctgtgtggtgtcacccagtaactttctagagagaaagagagagagatgttggtggatgctgtccagcgtaagatgctaaagtgaagctttccaagtgtgctctccatgtggccaaggtgcaaggcattcctaaattttggaccaaatgttcagcacttgaagcttcagtataattttctccatgcgttcatcctagttatgcagaggtcgggagtgtaattaaggtaaattgtatcatcttgatgaaattgactgagtgggataaaaagcttcagttatcttaaaggagtagtcttcgaactctgaagtatcatctcctctttctgaagagattcttgatgattgatatgcaacagttgcatttccaggtttgctgggttcttcagtcttcatgatgctcattgctttttccttgtgaaagtttagagtcagtcatggtgggggttggtgtatgtgactagatagtgaggtcactggtcactgatgagtgcagctgcattcatctgtggccatgtttgttgctttgctagccaacagtgaacagtgactcctttttttttactaagttactgaaatcttttactgacttcaggtaagtggtacggcatggcagctatacatgatggtacaaatgtgtaattgatctgaattttacggttactatgtaataaagctgtagttcatgatgaggatggtaggttttgccccctctgattattggagtaggagtaaatgtgataactgttcagctatgctttgtggatcatatggatgcatatgatcattccctgcaacaatttataacgtcagtggattgtcatgagattctgatattaatgtagtatgcctttttctttttactgtgacaatgcatggaaaattagttagtcagaatagtacaatgttacttctgtcctaagaaaaaactgaaattgatataacaggagcaagctctgcttattgttaattcttaagaatcgtaaaatttctcttaaaaaaaggccattggcaaaacttacctcgttggaaaattacagtatattaaataaaatgggttcatctacagagcatgtggtggaattcttgtattccaacaggcttgactgcttagtttaacaactttttagataaggaagatgattacatcctaggcctctatatctaggatgaacataggcataattattgttaaagaaagcctcaataagagacaaaaacccctatgagatgaaataagcaaagctcaataagagacaagaatccttatggtatgaaataagcaaaacatgccctgcgtaggaacatatgaagcatgatgcactaggtgaaaaacacattaaacatgaagcctaatagtaaccgccattcaaagtgggtaaaaaaagtcccagaagatcgagcatattttaacacctacaatcgaaaagaatgttgaatcatttatcttccgacagaaaagaaggttagttggaaaaattgaccggtactatcactccagaaacaataggcacaaatagaatccaatctggacatgctggccatatatgccttatatgatttctcccttttactaccttctcttcatcagaagtaagactttcattagctaagaacctgccaaccaggaaaaagaaatttcacaaaatctctgttgctagttgactcaatgaaaaaccctctagtactcctaattaggagtagtatctacaacactgttgtaacaacagcaatcattagtaaccttgatcatagctgagtactactactgttgctactactactaacaacacacattttcatcatccatgaaattgaccatggttcaacttcaaaggaaaagacaggtaactgaggtaggaccattcctgcactccattatcatcagtctgatgcaccacttgatcttgctattgctcattttgctacagttcatcttgctcttttggctgctctcctacacctacctgctaacctgcctacacacactctgacacacactattagggcatgtttagttggtgaaacgaaaatttttaggtgtcacatcggacgtttgaacggatgtcgggaggggttttcggacacaaatgaaaaaactaatttcataactcacctggaaaccgcgagacgaatcttttgagcctaattaatccgtcattgacacatgtgaattactgtagcacttatggctaatcatggcctaattagactcaaaatattcgtctcgcgatttacatgcaaactgtgcaattagtttttcttcttatctatatttaatgcttcatatatgtatccaaatattcgatgtgatgtttttgagaaaagtttttggggagctaaacggagccttagtggagggagaggcccatggcccatggctagaggcaatgcatgtaggcatacagaaactgcacatgcagatgcagtgctgtgctgccttttggacagactggtgtggaggaaatattatgatactatctcacttatcagtgggagcaattgttgatgtcaatgtgggggatgcaagtttagtagcagtactccattctatttctaccaacaagattctgtacaagatcaaaagaatggatttagaatgcattgatgtttgctatgcataacacatccatttcatccctccattttttatctctggaaaatggctcgatgcttcttttcatggctaaaacggctgtctggtgttaacttcatggcacgttataccttgtccctagcagtttataggtggactatatacatttgaaaactagaagtactagcttagcttaatgttcttcttgttcttaataaaaaatggaacactagcttagttgcttgggttaagtctcctaagtccatgagtgtcaggctgccactctgggtctctggtgttatgtcggtgcagagctgtgtaaaattgttggagtatgcaaaaggaaattctgcaaactaggggatcactctggagtctggtctctggtgcagtgaaggtactattggaaggtcaaatatgcaaactaattcttgtactaatgaaactgaagttcagttccatcttagatgtatttcagttgataccaattgttgatgccaatgtggggggtgcaagattagtagcagtactccattctatttctaccaacaagattctgtacagatcaaaagaatggatttagaatgcagtgatgttcgctatgcatacttatatccatcggaccatttcatccctccttttttttttttgtcttgaaaatggttgtatgcttcttaacttcttttcatggctaaaacggctgtctggtgttaacttcatggcatgctgtaccttatccctaacagcatatacatttgaaaaccagtagaagtactagcttaacttaatattcttcttgttcttaataaaaaaatggaacactagcttagttgcttgggtttagtctcctaagtccatgagtgtcaggctgtcactctgggtctctggtgttatgtcggtgcagagctgtgtaaaattgttggagtatgcaaaaggaaattctgcaaactaggggatcactctggagtctggtctctggtgcagtgaaggtactattggaaggtcaaatatgcaaactaattcttgtactaatgaaactgaaggtcagttccatcttaaatgtatttcagttgaaaccaattgttgatgccaatgtggggggtgcaagattagtagcagtactccattctatttctaccaacaagattctgtacagatcaaaagaatgga

SEQ ID NO: 9019 - DNA, 4130 bp, Oryza sativa
ggtttagtctcctaagtccatgagtgtcaggctgtcactctgggtctctggtgttatgtcggtgcagagctgtgtaaaattgttggagtatgcaaaaggaaattctgcaaactaggggatcactctggagtctggtctctggtgcagtgaaggtactattggaaggtcaaatatgcaaactaattcttgtaactaatgaaactgaagttcagttccatcttagatgtatttcagttgattcaaggtttattccttttctggtttttgcgttatcctgtccatataaacttgcaaaacccaatggtttttttaattaactgtaatgagcaaaagtccaggtaaaaccaatggtgctatcaacttctcaggtgtcaaggtactgcataaacttcgctgtcacttacctagcacagatgttgaagacttggagacaataaaacttgagttgatgcctgtattcttgctgtaaaaaactggggcagaaactccaggttatttcacttctgtcagaaaaatactaccggtaaaaagacgaagaaaaaaaagaggctctactcccttttttgtgccatccccagaaaaaagaggcactgcaataagtgctggttaaaatctcatcatcagactaattctgaaacctgcttccaaagttcagaacaaaagaacatgggcagccacaaaccatgaaaccacactcacgccatcccttgttactctcaaatgttaaaccctttcctcctttaacgcctaagggctcgttcggatcataggatagggaaagaaaatataggataggaaaagtataggaataggaaaagaatcaaagcgtgaaaaagaggaatgaaatgaaaaacaaaggaatacaaaagttgagagcattcggatcataggaagtcaattgcctaggatttgcacgcaggaagcaaagaaagagcttgaggtggattagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcacgccggcggcccgtcaggcgcggacagggctggcggcggtcgaatgggaaggcgccacgtggcattaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctatttgttcttaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacatttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctacatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatcaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattatatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccat

SEQ ID NO: 9020 - DNA, 9409 bp, Oryza sativa
ccggcacggcccgtttcatcagccgtgcctaacgggccgtgccgaaacgggccgtgccggacccgtgcccgtgccgggccgtgccggacccgtgcccgtgccgggccgggccgtgccgcccgtttggacacctctaaggtggatggacttttcctgtactttcctgtaaaatcagcatcaaaggaaacttttctttggatttcctacgaccagtttccataatccgaatgataggaaaaaagaatttctatgcacattattcctcaaaaatcctgtgaacacaatgcgagtactcctacatctttgcaatagaactgcacttgcagacagcatggacaatgcagcacattgacagtgacaatgcaatgcctgaaagggacaccaggcttaccctcaagcaactaacatgcatatgctcgcattctacctttttctcctccttttcttgtcatttggcaccacaacattataacataaatactatacattgcactagatctatgcagaaaagggagagctgaaaaaaaataaaatgcttcatgatataatgtgcgacttgggggaatctgacatgagaagcaaaacaccaagcagatggaactgatgcatgcagaagtgcacggacaaatgtgactggacatggaaggatttgatagtctctttggatccaaagctagtagtctgatgaatctagagttgaatctagagttcatagcagtgtttgtgtgcagatgagaccacctcaggtgccatgccagcaaccctcctgatgacgttgcactgcatggatggccccacattgatactgccagtatgcagtagagagtacagtatctgaatactgttttaagtctataccagtacagtcacaattgccccagagcttgtgagtacaagaagtaacacatcaattggaggaacaacaatgatgagaatcattgaattggctacaccatcgctgcatctccagccagcacagttttaaattgaggccatcaaaagtccaaaggtcctaagggtaggggataaccattgccacggcactagggtcccatgtttctgatggaacagaatgccaaacatgcatgttgatcggcagatctgctatgagagtataaatccatgtgaaatacgcagttcctgagttcaacatgcttgattaatgtttgggtaaccagatcacgcattgccttcgatggaatgactacagtatgcatgcaagtataagacatgccaattctctataaatttgaaaaaggaatttgtcgtgaaaagaactgaggtgattcttgccaatccaactgcaggtggttgcttacagttacagttataatgctaagtagtgggttaacatatgtactaacctaggtgctaaaagaaacaaactttattgctttagaacacctatgtcccttttcagagtgcaacaaattgtaatgaagatgcccaaaaaaaattcgctgttatcttctgtcccctccaccactttcctttacgtatgtgcaagctggcagtattctgcttttgacggagaaactttacatggtagatgcgccatttgctgctatcaaagactgcaaaagggaaatttggagagagcaaaaactataagcaaatcacaatgtgatttcgttagacaatacattaggtttaggaatgcctgtgtttgcatcacgatatgaaatgaaaagctaaaggtcctgaacttactaaatcaagaagcttcagaccagctgctcgtgtaaacttccttgcaaaaaggaagcaaggtgctggttttccattacttgtacaccactcctttctattttcagtctcataatatatattatcaatatcctaaaaattcaacaaataggtactcagtgaatagttagaaaatgtcatgtgcatttcgtacgggcagcttgttttggcagaactgtatacatgacaaacaaaagctgacattccttatcagacgcaacacatttccaaactgacatttgttaaagctttgaaacagatgaattgatagcgtctgccattacccaacagaggttccaacattcaccttggttgttgctttgtacttaaatattttaataatgacagaattttcaaataaaagaaaaaaaagtaaagcctctcttaatttcctttttaaatgtacatactatataatcaccactttcaggtaacaaaaaatgtgccattgcaaagaaacatatacctttatggattttacaagtgcaggagtagcatctgagattttgtatgttacaggatgccatccacgcctttcacgatctttagaagatgatagatcccacgcactgtgtgtaactgacctccgtgtaagctcttcttcaagaccatgttgctgcattcgataaaaataattgaacggtcagatgtctttgtgaggaggaacagctgcaagggatactgtaaatgattgttgacttactgcaagcaatgtttgaacatagtgctcatctggtatgcagttatgtgccttccatgcctccgcaggctggataaaatgagcagcatttagtctcacagaattactaattaaactttgttctggaacagtagagcaattagatagagatatagagttcagtggtaaattttgaagccatagataataattctgttaattaagctttttatggagtacaagaaatagcacaagagttgtgattattatactcaatgtgccagctgcagttcaaaaataaacacataaaagcaagttcaacaagctaagtgacagttcagtattttattggagactttcacttacaataggacgatcccagtcccgccagaactctggtaagggccttctctgcaataaataaaaaggtacatttaataggaacaagaatagacaactctaagctaattgataggaaagagacatgagttaagtaacttgggttgatgatatagaaaaatccggtggatcttctattcatttggcaaaggtactagtatcgaattattttatttttttaacctttttaattttaaaatctgaaccttttggccaagctagcccacctggcgtgacaaaacaacactgacacgtcacccgcaatgggcatgacaattttacaatatttccaaaatctgaaccttttagccaagctagcctgcctggtgtgacaaaacaacactgacacgtcacccgcaacgggcgtgacagttttgtcctgccagccacggtggtgtggcaagacaacgctgccatgccagccagaccggtgtggcaatgttgttttgccaaccaactacggccaaaaggtttagatcttggaaataagttttcgaatgatttatttttaaaaataaaaattaaaaaggtttaaaaaataaaataaaataaatcactgatatcatgcattgtcgtaaacattgtcagaatgtcagtaccatacgtggcagtttacataaatctacaagtttctttgtgtcctatgttgattatcttgagagcacattcacttgcgaatgcaaaaaactgtcataaaaaagtaaatattgataatattcaaattttcaacttctgttatcctgattttaatttgatgaaaggtacaaggtgaaaaagttcactggtcagttatgatcatgagtaaactatgttatacaatactgaaatttatctgcatagagtgcataaatattgagtcacataccctgcaatgcttctggaattctggcaaaacctcttcatcttcaaccacaacttcagcatgttttcttgttaacacagcccactgtatggcacaaatgaatggtgataaggtatcaaaactaactgttacacagttcaagcaaaattctcctatctttcatcaatagaaacagaaaggtacctgcgagccttttctccaattttccactgggataattgggtccattctgggattataccgacccgcttttgtatcagcaaaactgtccccagcatatgcaattggatgctgttaatacccaggatattatacaagctaaatgaaaggtgctttaagctgcaaatctgcagtttgctacaggaaccattttgaagctcaaggtacatggaaatacttagataatggaaaatgagaaaggctaacatgattttttttctttcttttctttaacattcatagttactagctgatacttgtcatgaactcagaattcattcttaagtcttaaccatcatcaggaaacccaacacgaaattgggatgcctatacctgtcaacaaaactggttgacgaagacattatgtagtcgtaagtgtagttgaagttgtacaatggcacacagctggcagagagagaagatcctagtaagcatgaatccaattaagatccaaaatggtgcaacaacgagctttgtaagattataaaaaaagatgtgtagtactaagttcaaatttggagctgtcagaaaaacaaccgtgtaaacgatacctaaaattgcaccaaggcatctggtaaattcagtacagcttcatgtggagtcccgttaaacttaatagaaacagactaacagtataacacaagattcatttccatggaatttaagattgaggactgctatcgcaccacatttttagcatgagcttaaaatcgcggacagaaactacttatcatctgagcattgcatattggaaaaaaaaattagttagccaaacgatgattaaaaaaaacaaacaatctttactagataacagtccacatttataaaaatgtaaggacatatcattatgttcaggaacattcccttaattcattatgatcagaacctagaaacaacacattgtgctgaacaagagattaagccaacacagattgcagttagggcttgttttggttcatagccttaccaatttttttggcaatggcaagaactggccattgccaaattttctggcaaaaactggctaggcattcatttgcttctactaaacttgcatttgctattcaaccaagacaaataatttagtagtgcttaatttttggctataaacagaacacatgactaaattttttgggcattgccaaaattttgtgccaatcaacttagtatctaaagtcagtaatactttatccaagcatacacactagcacacatcataattccataatccatacctgtcggagacgaacacgaagcgctcgtttaaggggtccttgagcgcgtgggcgagtagaacacgctcagcctcgatcatgctcgcctccccccaatccacctgaaggacaaatcacacatgcccaactcatcaggaacccagtgtggactgcaacggatgctgctaccgacggatcacatcacattgccaacggaagtggggacgaggtcgcgaacctggacgctgttgttgacctgccgattgtagaagaagccggatcgggtggtggcgcgggtgagcacgaaccccggccgcgagtgcacgaagatggagaatctcccttccttgtcaccctactcacccccaaaaaacgcaatgcaatcaggattcaaattaaaccagcattcgctgaaattgggagccatccgagcaagagcgagaggaagggggagatccgggcgaggcgcgcgcttacgcggaagaaggcgtcccagacgaggtcgagcgggaggcggttgcgggcgatgaagaggaaggcgagccgcgcgttccccggcggcagcggcgcctcctccacctccgcccgcgccaccgccacctcctcctcctctccccctccccccgccgcctccaccgcctcaggcttcctcccctcgccctccagcgacggggacgagccgtgcagcagcagcagcagcaccaccgacaagcagaggaacacccccagcagcagcagccccgccggcttccccttcccgccgccccgcccgtacatccacctccgcggcggcttcatctccggcgaccaccgtgggggattcggatctcaccgagcgcccatcgaatccagcgagaggaggagggtggtggactcgtggtgatctcgtgaatcgaaggaatctccgatttcgcgtgggttgccgtgccgagcaagcgcggcagaggcaaggcaagtgaagtgaaagttaagttgttggacttggagtgtctgaagtgtggacgcgccagctaccggcacgggaggggcgacgcagccgccgcatccgccgcgcggcaacggctcggggtcgggggagatcacaggtggtgtctgggccgtcggatcggaagatggacggtggcgatgtgtacggtgtaccgtgcgagaaggttggccacttcggcgaggagcttcaaagctgggacagggaaaacagaaccgctctttagcctgtctagattccaactttttttctttaaacttttaacttttctgtcacatcaaactttagatgtgtttagtttcacgttaaaattgtaagtttgaagagattgaaacaatgtaacggaaaagttgaaagtttgaagaaaaaaaagttaaaatctaaacatggtcttttctacacacacaaacttccaactttttcatcaaatcgtttcaataacttccctttaccgcgtaattaatttaacacatattcaaccttagtcttactgtacttttacgataaacaaaatactccctccgttttgaaatgtttgacaccgttgactttttagcacatgtttgatcgttcgtcttattcaaaaacttttgtgaaatatgtaaaattatatacctacataaaaatatatttaacaatgaatcaaatgataggaaaagaattaataattacttaatttttttaataagatgaacggttaaacatgtttaaaaaagtcaacggtgttaatcattttgaaacggagggagtaacaaactaaacttatataaagttagataaaaatatagtccactctataacatgtggatcgagttgtggcaggaaaaaaacaaacatttcctaaaattatgacttacctaagattttatgtgataaatttagttaccaatcaaacatgccctaaatatcaacataaaaaagttgaaaaatagattaatacgatgatgtaaaataataccacacgatttagcaaaagtgattaacaaaccattcgataaaccaaggttaaaatcaaagatccaagatgagcagggagcaagaggccggggagggtgaccacgttgtgagctgacagtggcacgtgaagtttccatgatttgcaccgactattctagcacacacatgtcccgactcccaaagcgcccgtctccaattgacctaacttgaccagcccatttctcccactggcccaatacgatatttactcaattaggcccacactctcttcacgtctaggcctcgatttgaaagcccacgaaacccggtccattcacgtgaaaaggaataagttcaccggaggttcctcaatttaacagcgatattttttttagatcaaagggtttccgcccagctttactaacaaagcataacagagttcattacagactggaaccgaaaaagaaaaaagaaaagagactttctccggtacttgaaaatcacgttaaccattgattaggtacaatccaatggtttacgatacaaggtacccatagaaagttacttaaaaaaaggtgggcaggtataaaaatagagattaagtgggagggtatataggtaattttgtcccctggtattatatcaatctatcagatatgaaaaggaaatgaccgtaacatatataagttcttcgattcttctcgaatttgtttcgttacgaagtttttaatatggattacatgaaattgtgaacaattacggatttattttgttatgaaaattgatctacacagaacggggaatgtcatattatttgaagttttggtagctcattcatggattaattaagacgtggtcgacaccggcatgctcaggttatctaaaagatagagaagaaaaatgccttcaaaagactagcagatgtgatactgtgaatgaccatagatttatgtaatattcctatctcctaataagtaactattataatgtccctgaaaaaaaagtaataatgtaagcaacaacagcgagagatgagaattagtgagcgaaagtaatacaagagcaacagttaatagagtaggggctagcggcaaacaatcaggaagaagttagaagttgttagaactggaaacaattactaaattacccatcgtcgtgttttttctatttctaaattcatctttagcaatcaacggttgatattcaatagtttgaaaggtacgctgagtacctcccaagcaccttaaaagatctcaaaagaaaaaggggaggtagtagagttggggtttccaactgaagatgagatcaacatataactgacaaaagatcaccctaacaccttccaggaaaaagaaactttagaaaacaacaacgcatcgcctggatccaaacgaaactgctgtctactctgtactcctaatgcatcttcttccttgaacaggtcccgagcatcagcttgttcctttctcgtccaactccttgattctggcacgcagcaagtccttgaagtgctccacctctccagtagacttctgcgccaccaaaggactccactgttacaataacatcaccaccttatgagcaatcatagtaatgcccgaaagacatttatcattaaagacgaaatcattccaagccagatggcccagcaaacagcagaaaaaaaacaaatgtaaggcaaattgttctttgtgccagggtctttcaatttctcaatcatctcagctcttgtcctgggaacattgctccatcccaaaaatgtctctcaagcagcaccaaagaaatctagccgaagcgcacttaaaaaacagatgatccatctcagtttatctctcccctccttcaattgaatttcctgtagcagttcctgcaactctatcctctcttctacttcaacctcagaacagcgatattgttttaagatcccttaaccataaaactagaaatttctgtatacccctaaactcacataaaccgtgcactcaaagttctatggcagtatatattggtggtttcgctgacgtggcatcctagtcagaaaaaattaaaaaaagtacatagggcccatatatcagctgcactttttttttcttctccttctcttctcttctcttttctctcttctctcttctcttcttcagtgagggaggccggtggcgggcaaagctatggatggaggaatggcggccggaatgcggcgtcgcctcgagcaccgtgacaggaggaggtaaaggggaggcagtcggcaggaaataggggaggggagaggcgcgacgacaaggacggtgcggcgacggggacggcgaggcaatgggggacagggcgtgcggcgggggttcgctccgtgcgcgccgcatcaccgggtgtgc

SEQ ID NO: 9021 - DNA, 2721 bp, Oryza sativa
ccccccccccccgcgtgtgccataggggtggtgaagaagcctgcctgcgcccgcgccctcactgaaaagagaagagagaaaagagaatagaaggagaagaaaaaaaatgtgcagcttacatgtgggccctatgtattttttaaaaatattttgctgactaggatgccacgtcagcgaaaacacccatatatactgccatagaaccttgagtgcacgatttgtgtgaatttaggggtacatagaaatttctggttttgtggttaaggaacctcaaaaaaaatctcgctgttaagttgagggacctccggtaaacttattccacgtgaaaatgccggtatggtaatattgataattgagcccacaatattctgttttttttaaaacaatcttttagacgcgcgcacatcacacttaattacacacacctaggtttacaaatacgaccataactgctcgggtttagaaactatcgataaattggccaagttcaaaaaagaattcaaaatttagtaaattttgttcaagtttcactgtttttgtccccccaaaaaaaacactagggagcggttttcgttgacgaattgcccttgtatgaaccgttctcactcaagcacgctggtttttgctttgcggcgagccgccggtggtgttgctcctagctaggccctagctagttaatcttcttctccagcggattgtgtcgatcgaattcaattcgaatctcatctcacccctacatagtggatcatgtacgtatcacgtactcatctcctacacatcatctccaattaatctaattcagattttctcagaaagctcagccattacatcatccaattgcatatttgcattctcatctccatgaaaagatcgaatccggttccttcggccaactcatgtccctttttctccacgtcgtggccgacgccgcaaaagctactccctccatcctatataaaatatttgacgccgttgattttttttaaaatatttgaccgtttattttatttataaaatttaagtaattattaattcttttcctatcctttgatgtattgttaaatatacttttatgtatacatatagttttacacatttcacaaaaatttttaaataagacgaacggtcaaacatgtttaaaaaaatctaacagcatcgaacatttaagtaaataagggagtaattttcagctgtttgatctcgattgccgattaattagttgacctcttcgcttatcctctacacccgtctcgatctttcgctcaattccgctttaatttggtgacttggcgatcgatcgagcgagcgcgccgccggttcgccgccacgtcgccgcggaactagaaacgccggcgccgggagggaatccggtaaagccgtaaattaaaggtgagtgcatgcatggaatcttggaaaattggaatcaaagctaagctagctaagctaggagagattgtgcgaatcatctagctcaaaattaatctctctctctctatatatatagcttcatggctgggcgatcgagctgcaacgacacctgcaggctagctagctaacaaccagctgagaggttaattaattatgatttgtatgagagatcgatcgagaagaggagtagcgagggagaggatggcggcggtgagcgtgggcggcggcgggaggaacatcggggtggcgatggacttctcggcgtgcagcaaggcggcgctgcggtgggcggcggcgagcctggcacgccccggcgaccggctggtgcttgtccacgtcaagccctcgttccagtacgagcagggcgtcgcccacctctgggagcagcaaggctcacgtaagcttactgctaccactgtcctatactacctccgtcccaaatatgggtaaccgtggatatccgcgtctagtatttaactgtctgttttatttaaaaaagaattatgaattttttttaaaaaaatactattcatattttatcatctaataacaataaaaatacaaattaaagatttttcaaataagacgaacggtcaaacgtcatgaacagggtaaaactatacttattttgagatggaaggagtattataaattgctttaattttttttatagctaatttttaaaacatttgattaagtttatatataaaaaaaatactaacatacgaaacaaacgtatcactaaaacatatttaatggaactaatttagtgctatagatatagcaatatattttttttataaacttagttaaatccaataattaattagaaacaaatttaaaacgactttgtaataccaaacggagagagagcagagagagggagtatttaatttctttcttctagcgcgtgctaatggcgattcctcaccggccggagtgcagcgatgatcccgctggtggagctggccgacccgcgggtgagcaggatctacggcgtcgcgccggacgcggagacgatcggaatcctcaccagcgccgccaaccagaaaggggtatatatactgaatggtttactgttcgatcgtctgttaatccttgtgtggtagtagtatatattgaatgcccattggtgatcgatcgatgatcactggagaaatgaatggatggatgcaggtggaggtggtggcgaaggtgtactggggcgagccggcgaagaagctgacggaggcggcgcaggggattcccctgcactggctcgtcgtcgggaacagaggcctcggcgccgtcaag

SEQ ID NO: 9022 - DNA, 32128 bp, Oryza sativa
  unsure (1)..(32128): unsure at all n locations
cgatgcaggcaccacatcagcttaaaccactgtccaaaccaccttggaacttattttgcacttgttttgacagttgagagacccgttgtacctgatttttcggttgaaggatgaaaatcggattagttgacatgttagggaccacagatgaacttattccgtaatctaatgaccaggtacaccatgtctcggcccggcccaacactgcaagcctgtaaccgcggcgtcgtctcctccccgttcttctgctcgacgcggcgccgcggcggcggcgacggcagatggttcccggcttcagctcggcgtccggcggcggcagcacggaggtcgtctcgcgacgggttccgcttgttttgagccggtgttgtctgaggagagggggctcttcttcttcttcttccactggtggactacccgaagcctcctgcccctgacgcctgccaggtgttcgaccttatggcgccgaagcgaagcgggcgcgcgcccatccaactagcgtccagaacttggaggcgccggcgtgtgtggcggaggcttcgagcaccgcgaaagcacttccctttctcctcccgtgggggtggtcgcgctgctcgagcgtggcgtctgtgccgttgtccgtcgatggaatccttcagctcatggccggggatgcatgtcggagtttttttttttggcagctgagtgctcactgcagagaccaagcaccaattcaccaatttaagtgcaaccggaataagtctgtcacttgacaactcgccaatccattgaccccaagctcaacctcaagctcacttttggccatgggttcacagcgagttccagtgttccacagattaggcaactgatctgctgctattccacactgcttgctaggcagtgagtgagtgagtgagatgaagattggcgcatgttcagatggcatttggccacgcaagcatgatgagggttgcggaattcacaatgaaaccgggctgatggatgggagctgcctctgtgtgaaactcaacatggttttcgacgaaatgtcagatgcctacgcagctctgccgaactcgattgtctccttacatgccgctgattgagccgtcataggagcaggcacgcaccacaggttggtaaatgcttgagcttttcatttttttcccttcctgcactgcacactgtcaactctccatgcattgcattgcaagcgattgatcgtcatgcaggagcctgcctcatcttctgctatgaatgttctcaagtcaattggttaatcatcggcatcccgggaagcatagctttaccggcagattcctgaaaggagacggactttttacaggaaagggtgtccacacgcatctgattggttgcatgggaaaaagtgagactgatgagctatatcctatgcacatggttaaggttagcgtccacggatttgtcgtgcaaactaccctactgcactgcatccctgctcgccattgcagaggttagccgatctttactcaaattattaatcattccatattgaaaacaaagttatgaataaataaagggaagacaaaatggttatgctggggcctagctagctgtccggaagaaccccggcgaagtttaatttaatgactgaaagtcgaataattggagaaattagagcaagattcagaggaatgtcgtgcttctgggggtttcataattttaagtgtcttattttatcgtgccttttagattgctttttttaattaaaaagatagtctcttaagtctccaaactccctgccttgtttctattaattaaaatcggttatactcctgttcttaataggtgccagtttaaaatgcgtatagtcaacccttaaatagtttagatgcaaatgtatgcaaatagtttttggatttgtcagatgaaaataacatgtagttccaatatgaaaaacacacaccattatgtttctgatagttattatgaagtatgaacatataataaaaaagtaataatcaaatacggagtatgcgtattggagaacgtatcaatatccgaaacaacaagtaaaaaggaacataggaacatcagtttacatcttgataaagatcatgaacactaaccttttctttctcatgatccaaatatactaacaatgctacgcatgtccacactctagtgaatgtagtcatattagtatttctttagctgagtttacgagggtaaggttcatgcacgtccaagtagtcagtgatgtattagcatgatggacatgtccatttgtccaagaatgtttgtcctggcgtccgtgattttcgcttaaatataccatctcgtttttcaacatcttatattgaagtgatactctttctaatactaaataaattaaccagttcatttgagatgagcaagaaggaaaggggcgctttattctacacccacatttgtcctttgactcatgtcccatccggatctcaaatcctgtggttaggcaggttagaagcgtacaagcaagtagcacagtattaggcaggcttaagtcaaacccagatcaatcaggacccagtactaaaattgtttgaatgtcaaagaaagtcaatcgtagaccaatgatgcaaccattgcaccaacagcacatcactgtcctcatgttaccgaaacgacgggtagttgtgtaggctttgagtcacaaccaatcatctgctggcctttcgactaatatttactcaaatttcaatcatgcgttgctaactagtgtggttttacagctaaatgagtagataatctagttggaaaaggagttctttagttacaaattctgggtaccacaatgtggtctgaactctgaaaatctgaaccagaaagtagtgtgtcgttgtgcatcatgaggatttagaagccagtaggcaatagtagataaccggatagccatattgatgtctctatctggttggatgtttcctaaacgtgggaatctctgctatgtgcagttcaactgaaggaaacaaagaaaagtgcgagctggtgcgtcccatgcatgctgctgctgcagttctgcctgtgatgggggcctggatatgcaactatcgtggtagttactgtgagttctgttcttttttttttctccgcccccttcgcctttgtttcgtgtggtttattgatgcaattctgttcctgtcattgtcactcccctgcaaaagtcactttccctctacctgataattgaaaacaatgccactatgtgtgtctcgctggcttggtgattagttagtccttttctgtagttctgctaatgtggtctattcagatacaaataccatatatctatatacgaatttaccttctgttatgtgatcataatcgtattactgtatgctctcttggttgattgcacattcaattttctgaattttcttgtagtgagactgtctgccactgccagtacttcccatggtggatcggtgccaaattaggctgacaaggagaaaatttcatgccgtgtacttgtttgcagggtcagcaaaaatatcgacttcggaatcgatgaacagggtaagcacgaatcttattagttttctgtcactaaacctgagttagaaaactattaagccaaggaataaggatggaagcgtcatgctattgtcctcatgccaccaaatcatggggagtggttgaactgtttacgcacgtacactctgtaaagtggcagtgtatcttactgattcccggtgcccttttttcatccttgtcaccagttgccatgcagaagaagctgagctaacaagtcaaagcaacaagattagcctttaaaatacctcatacttagccctgcattatacaagtctaggctgattattgtaaactccatgtctgcaagagatagtgtacagtgctataccttctcctttggctttgtgttgcattttcagtaccaagaatccatcacattaccctgagtgatatgcacagagcaggtagtgtttgacaactttgtttctgctttttgcagcttaggctcctactttgtgcacatgatgagcctccaaacctcagctatggagttcatagtttcatgctcaccttgtcatctccagagttccagcatcctgtaagttccaattcatatgcatcttagaacactgcttcagttgctcagttgatggtatcattggtcttagcaatggctggcaagctgatcagctcctccattgttcttgctcttctacctctgttctgtggcatcctgcttgcaccatcatgtgaagcagccacagtagacacaacatctgccactctcctgcaagtgaagtcaggtttcactgaccctaatggcgtcctctccggctggtcgccggaggccgacgtgtgctcatggcacggcgtgacgtgcctgacaggggagggcattgtcaccggcctcaacctgtcggggtacggcctgtccggcacgatatcgccggcgatagccggccttgtatccgtcgagtccattgatctgtcgtcaaattccctcaccggcgcaatcccgccggagctcgggacgatgaagagcctgaagacgctgctgcttcactccaacctcctcaccggcgccatcccaccggagctcggcggcctcaagaacctgaagttactgaggatcggcaacaacccgctgcgcggcgagataccaccggagctcggcgactgctcggagctggagacgatcggcatggcctactgccagctgatcggcgccatcccccaccagattggcaacctgaagcagcttcagcagctggccctggacaacaacaccctcaccggcggcctcccggagcagctcgccggctgtgcaaacctgcgtgtcctctcggtggctgacaacaagctggatggcgtcataccttcctccattggcggcctgagctctctccagtctctgaaccttgcaaacaaccagttctccggcgtgattccgccggagatcggtaacctctccggcttgacatacctgaacttactcggcaaccgcctcaccggcggcatcccggaagaactgaaccggctgagccagctgcaggttgtggatttgtccaagaacaatctgtccggagagatcagtgccatctctgcatcacagctgaagaatctgaagtaccttgtgctgtctgaaaatctcctggagggaaccatccctgaaggcctctgcaatggcgatggcaatggcaatggcaactcgagcttggagaacctgttcctcgccggcaacgacctcggaggcagcattgatgccctgctgagctgcacctcgctgaagtccatcgacgtgtcgaacaacagcctcaccggcgagataccgccggcgatcgaccggctgccgggcctcgtcaaccttgcgctgcacaacaacagctttgccggcgtcctgccgccgcagattgggaacttgagtaacctggaggtgctgtctctgtaccacaatggcctcaccggcggcatcccgccggagatcggccggctgcagaggctgaagctgctgttcctctacgagaacgagatgaccggagccatcccggatgagatgaccaactgctcgagcttggaggaggtcgacttcttcggcaaccacttccatggcccgatcccggcgagcatcggcaacctcaagaacctcgccgtgctccagctccggcagaatgatctgactggcccgattccggcgagcctcggcgaatgcaggagtctgcaggcgctggcgctggcggacaaccggctctccggcgagctgccggagtcgttcggccgcctcgccgagctcagcgtcgtcaccctgtacaacaactcgctggagggcgccttgccggagtcgatgttcgagctcaagaacctgacggtcatcaacttctcccacaaccggttcaccggcgccgtcgtgccgctcctcggctccagctccctcaccgtgctggccctcaccaacaacagcttctccggcgtcatcccggcggcggtcgcgcggtcgacgggcatggtccggctacagctcgccggcaaccgcctcgccggcgcgatcccggccgagctgggtgacctgaccgagctcaagatacttgacctctcgaacaacaacttctccggcgacatcccgccggagctctccaactgctcgcggctcacccatctgaaccttgacgggaacagcctcaccggcgccgtaccgccatggctcggaggcctccggtcgctcggcgagctggacctctcgtcgaacgcgctcaccggcggcattccggtggagctcggcggctgctccggcctgctcaagctgtccctgagcggcaaccgtctctccgggagcattccgccggagatcgggaagctgacatcactcaacgttctgaacctgcagaagaacggcttcaccggcgtcattccgccggagctccggcgatgcaacaagctgtacgagctgcggctgtcggagaactcgctggaggggccgatcccggcggagctcgggcagctgccggagctgcaggtgatactggacctgagccggaacaagctctccggcgagatcccggcgtcgctcggagacctcgtcaagctggagaggctcaacctctcctccaaccagctccatggccagatacctccctcgctgctgcagctcacgagcctccaccttctcaacctgtccgacaacctcctctccggcggcatcccgggcgcgctctccgcgttcccggccgcgtccttcgcgggcaacggcgagctctgcggcgcgccgctgccgtcgtgcggggcgccgcggcggctgccgggggcggaggtgtcggccatcgtggcggccatcgccgtcgtgtcggccgcggtgtgcgtcgcgctgctgtacataatgctcaggatgtggagcaactggagggccgtcgcctccgtgtcgagctccgacggcgaggagacggcgtcctcggtggcggcggcgcacggcaagtggtgcgccggcgacggcaagtactggaaggtcgggtcggtgtcggtggcgtcgtccgccgccgaagagaagtacagctcggcgtcgtcggagacgaccagcgtgctgcacgggaagccgccggaggcggccggtggcggcgccggcgcggtgaagccggcgagcaagtgctgaacacgacgacgacccaccatggatcgcctcaagctcatcttcttcctgttaattgttgtttctttaccttgcctttgttattgtcatgtgttgttgatcagcgaagcaaaattagccgggaagaacagctttggttttgtctgatggtttggtttgctctgttccatgacgatccatgatgatggcccattggtattttgggtctaagtttagcagcccaacgtgttcgccttagggtcggcccagtaaacaaatcttccaaaatgcacaaattaactctttttttttacataacggaaattacattggctctttgcgataaaagaagatagagccacttattaaaaatattattcactaaacattgaattgggtatagaccaattatgatgagacaatgagaggtacaaattaactcacaagacttagtgtaagagaagtatttttttttccagtttaaaatataaaatatcaaactttgataattgatttatttgttaattaacacttctaaatacaaatccagccgataaaactcacaatatcaaccttttcaggtatatgcatgatacttcgatccaaggggcgaagacatacatagtgcatctagggcttgagaactaggtttgtcttcttaactagatgaataccccgctgtgttgctgcgaaaaattaaattgcataatatgtacaaataaaatgtaatttgattatcgaaactaaaacaatatgatacaattttgaacctaaaaataattgagatggtatgttttatgagagaagaaagaagacacaatttagaccatagatctttcatccaaaggctagaaataattggggtgatgtggcttaatgagagaagagagagatatcattaactacacttggtggggatgaactatataagtatataggattcacattatttagatactattaaatttttttgaaaatttcgagatacaatttgtataagcaagttcagtcctagtcttgaagattttccagtccacactcgctagcctgactctaaagatgtgtggagaccggatctaacggggggcaggggcgaggctgtggtgctagagaagaggaggagatggcggtgatgctaattcggagagcaaggggagacattagatggagcccaaagaggagtcaccttatccattgctcccaagattgaggcgaccagatctatcctctattactgtcattgctactgtcttctcaccattagatggtcgggcttgcactgccttttttttctccttcgtggggtgacaggctcttacgtgtacagacagtgacactaactaaaaattatcaaaaaaaaaatctaaaaaaatcatacatgcactttcaatagtattacatctacgtgcaaagtcgcatcttcaaattcattctacatagagaataacaaaaaagataaaattctgacaaaattgcaaccttaaaactgtcagattttttgttttttttttacggctaaaatgtaatgaatttgaagttaagattttaaccctaggtgtaatactattgaaagtacgtgtatgattttttctatattttttggtgatattttttagttggtgtgcacgtgtgtacacgcgagagcttatgtacgtatgatatgttgccactagttctcaatccctctcgtagatgaggttgtcttaaatggatcacatgttgacctgttagagatgccccgcacgtttgttatagacatttctacaatagtatcatgcatgatttacttttttattgatatttttggtcccatcggttcactaattataagcataagcgaaacggtatatttacaaataaaaaataatttgtgaattaaaacttttatacatgtgttcttaatgatctaaaaacaaaggtggaaaaataaaccacgataaaaaaaaactcaaaatcaactctaaattcaaaattgaaaattcaaattttggctgataagtataaatataaacgaaaagatgaggccatttattatatgggagtacctttcttacaaccatgtaatgcgtaatcctacatttacacgcaggtccatcaatccatatcagaattcatctccaaaatccaaatggcagggagggccagggcagcagctgcgatgcaagtcttggttgccatcgatcgtggccggtgcatgctgctgccgcctcgtccacctgaaatccgtccccgaccagatgctgccgccgccagaatgccaggtcatcacatcggccactactcatgctgacatgcagatgctgcgatgtgcactactactcctggatatattcggtcggtttttcccatggttgttttcctaaggccgccaagttggtccccttgggtactttttccggtttcttaaattaaggaattttgaatttggttggtttgcacggtttgcccactatttttattcaaatttttttttgcaaatataaaaaacgaaaagttgtgcttaaagtgctgtagataataaagtaagtcccaaataaaataaataataatttcacatttttttgaataagacgagtggtcaaacgttgcaagcaaaaactcaaaatcccttatattatgagacggggggagtatactccatccgtaaaataaaaaaaacattcaatactaattattaatttatacatgtatttgtttagatacgtaagttaggattggattttctttttctttttccttttacggtgtgtgtacgtaatttgccatcagcacccttatcaattaacttattaacaccctgtaagcggggaactctttcaattcgggttaaaaatatttaaatattcaaatagctacaaaaatttctgaaaagaattcaacgacattcatatagcaaatacatatccctctataaaatcttaaatataaacttaactcacatatcaagaaataaaaaaaatacaacgtataaacaacgcgagtgctattcactatctttttcccttctcaaataagtttaaacttaatttttggtagagtgatgaatatcaatatactcattttattttaaaattttcacaaccatttacattaaatttaattttaaaaagtgtacgagagaacatcccagtgtgcgaccttcaacactcggtcattgaaatgcaccgacaatatcacaacttattaagaagcagatataatttagtctgacatatttaaaatttgcaccaacaaatcatttatcttgttttaagagtatgaatgttattaaatacatgtcacatggtaacgtcggtgtattttctttgacgaataacactaggtgacacatcattactattaatatacatttgaaaaaaaaactacaacctaaaatactacaatcagaaaaaaaaggaaaaaaaaaacaacaacacactacgtgccaacaacacttgtgcacacaccccgctgaggaagaaacttaacactatgtcggatgcggctatgtgtgactggatgttgccgccaggtttacaatagagccacgaacacaccacctatcgccaacacttccaaataactgatcacaatgcacgcccggataacaccacagtgaagggttgtagagggagagggcaacagagaagaaagatccactcgtgccttgtatagacccaccggccaccgccataataacatcctaagcgtcatcgcagtccaaattgtctaaagatagcataggtagccacatgactttcaagagatgacgtccttaaaaaggtcgtgatgctgtcgcctattcatggacatgattttcacctggaaagttccatcagggaggtggaagatgcctcgacaatgctcccaaagggggccatggcgcccgatctctacactgttgcctgcccaggcttaacgtcggtctagactttcgtgtggaacctaccttccccttcttgccacaaccccaccatcctcaaccacctctaactaaccattgatataccacgcggccatcaccaccaccagttggctccctcacggccacccacagcctcacgtcacagctgcatgcctaccgctgtcgacacgccctcatgcaaaaggtgtcagcctgactagctactcacgatcatctctgctggcagcatgccgtgcctttggccaccaccgagccgccccagcacaagctcgagccatctccttcgccaccaccatgtgcttccaacgtagatgtcacccacggtacggtagatttgctcttagaggcgccagatcgatccgtcgctgccacggtcaaccactacctccaccaccatgactatcgttgccagatccgtctacgcaggtcgccacataatcgttgccttaggacggcgtgccgaccatcttctttagtaagcatcactccctgtcgccactggccgctccgcaatccccccgcgatagttacccatcgcgtccacggccgcaaccacatgacacactagacctggatccgatagtcctcgtcgttgctaccacactctctaccccgctgcgctctattgtccctcctcccactagctgctggccataacatgttagatctatggaaggggtggatccaaagtagaaccattgtctccctagtcgcctccattgacatatatagcgcctccaaggagaaaagagccctgccaaaactattcttgcagttgctcagcttaccagcaggcttcttcaacgacggcgaggggagaggggaaggagggaggcggttgcgttgtcccgggagtccgttcgggtcaccaatgagacgacacaggcggggcgtgtttatagttggccatatgggccgcccggcacagctcaggcccggttgtgctcgggccaagatttgtcaggccgacacagcccgacctacatgccggaccgtgccatgctgtgccggcccacgtgctccacctgcggcctaggcatgacccaataagggtcgggccatgccgggctgacccgaaggcacgggtagcccatcgtggtttctttgaaataagtctatttcccctccctactctttgggttgtgacatatatatagttaaaataagtctattttacatctctactccttgggccgttccatataatacgtctatttgtcctccctattctttgtgtcctgtcttacatatggttgaaataagtctatttcacctccctgaagttcgtgccgtgccaggccggcccaccgtgctgaggcataggcccaggcacggcccaacagcagggccgtgctagcacatgcctgacagcgatcgggccgtaccggcacgggcccgacagcgatcaggccgtggcgtgcctgagccaggctaaaatcccgtgccttaggccggaccatccggcctcgggccttatggccaactatcgtgttgaaatgtttttctgtcggtgcatttaatttacttatcagttatcaatacatgttgaacactaagagagatcactgcggacactagttggcaaatctcactgcgaacatgcatacatgtactactactcataaaatctaccagtactctagcttgctggttgattgattcatcattcattacaaatcgcaaatgcgctcaaccgtacgaccggagtacgtccgtacgtcgtcgtcttcgtcaccggtcgccgcagcagctgtagctatagctagcgatcgacctaagctagtgttgctgtcgtcgctttccaatgatgagttcttttattcccggccccggcagaaggtcgttagttttcagtgaacgcatcgagtggattcaccgcgtaatttcgacgacacaatcatattcgccagggtttcaggatcgaatcgatcgatctatccgtctcaattctcaggtgaagtaatagtaataccttttcttataaaaatgcctacttgcagggatgaacagtcgcatgtacaaggtgtgtgattaaggattccaaaatgcaaaatttgctacaggacactcaaaaaacgtgtaattagccgtgagacaccgtaaaaacatgaattggctataggacatcgtaaaagagtggtaattagctactggacaccggatacattattttattatttccggtgaaaacggagagagaaacaatcaaaaaagaccagattaccctatgtgggccacggatgtcagcctctcctctattttcttggtcaaagagcgacatggtgagggagccgcacccggagccggactcgagcacgtggcacccggggacgagctcgaggtaggagacgacgaggctgatgtcggcgaggtagaggatctgcgtccggtggctgagcatgagcgtccacagctcagaggtgggcgcaaggaggtggatgaacccgcccttccccttgcctccggcggtggcggcgctgtggaccttgcagccgaaggggcggccgatccagtcatcatggcggaagacgccgaagcggttctggagcatgcatgcccacagcgcgcatggcgtcgtggcgctcgtacaccacgacggtgtccccctccgcgatgcagcgttgggaggtgggcttggatgacggatccagtggtgttagatttgtttgtgttttaccttctaatcccccttttaattctgagatacgtccaaggtgttttggtttggccgtatccgtttgggagaaatatcccacagcaaccatgaggtcgacgccggggtcggggccctagacgtacagcatcacacgcgaagccggcttggactcgacgcggaacgacctgccgatctcgtccagcgccaggacctgcccgccgttgagccactggctgtcgacggcgatggcgacgttgatgtgttctgcggcttgccggccacctgcccgccgacgcgcacccacgccaacacctggtatgtcgcgtacagcgccagctcacctcaccctgtccccgcctctcctccctgccgtcctcgcttcctgcaacggtcgacgcgggccgccggggcggagccggaggttgcatgctcccgccgtggctgcgatgctgccccggtggagtgcgctctactcgcggcgggtgcgtcgctgtcgccgtcgccgccgagaacatcgcaagtgggagtgaacgggacgatggtagcgtgcgacgtgctactgccgggtgaggctgaggcggccggcgtgcgcagcaccggcggggagggcggcgaggaggctggagagggagtgcttgcggccggggacatttcagtacttttaacgctctttctctctccgtttctaccgaaaataataaaataatgtctctagtgtccagtagctaattaccactcttttgcgatgtcctacagccaatttatgtttttgcggtgtctcgcggctaattacacgttttttgagtgtcctgtagcaaattttgccaaatcttaattgtgtgtagtacttgatctgttatattttctcttagtttccgttaacatacttttcaaactctgttaactactaaacagagtggttcatgcgaaaattttctatatcaaagttagttaaaaatgtgaaataaatcaatttatcaaggcaaaataattaaaacttaattaatcatacgctaatggctttctcattttacatgtgttaacttaatttttatcttcatcaggatacttagttagcggaatataaagagtaaagtaatgtatattcatcatattaacaaaaggggaggggtaacggaaaataatagcatcattccaagctctaagtcgagctcgaatcgaacctagcttcagtagcccataagatcaagttggtaccatggattttttttttcttaaatttactaacggtatgtggtagaatataagtgaatctttcatcttttcttatcattttcaacttttaaagtgaactgattggggcatgtaaatcaatatgataaaaaaaaatgccagagaacttgaaagacccgatgaagcctctatatgagaagagcttaattgatataacaatgtaggtcaacttcattatttacctacaaattaaatcaagcacgccgagtttagattacattggacaccatattacatctacgctagtcccactcatttgaaatgaaagataatttcaagcacaataactgaattccccacaagaattcagaggataacacaaaaaagttcccctagctagccaacaatatcaacatgatcagagattaaaaaaaaaaaaacaccaagaactttgtcttttgctctactaccatctgcgtgtcagtataacgtgactgctcaaaactcaaaagcagtacctgacagagatccatacattttcacatggcnnnnnnnnnnnnnnnnnnnnnnnagaagtacatgagtttgcattgcatgctatacccatcagattgttgcatgcttcctctctgttcttttgaccagaaatttcatccatggctgcattttgatgtagctttggaggccaatcttttctcctgcttacttacctgcagagtatgcagaccagccttttctggctgtcatttgcattttgtcacctggatatgcattcagccaattaaatggggtcttgtgtactttggattccaatatatggaactgttttgttcacttgctgttccttgtcgtcacctcctgtgtataaaatcagtacatgtaaatcaggcccaaaaagttggtgaatttctcaagttaattccttgatgtgggtgaatttataaaattagtgtaatatgtggagtcctggaaatttcattcaggagctgtgtatgtttattgtaatttttttcttttaataataaaaattcccagtgatactcatttattgtttataaaattccagtattttcgtgctttcattcagtataaaaattcccagtgcttacatatataattctgtactatttgcataagaaactgaaaatactggtttaagcgattgtcaaattaaggcacacatacatatttgtacggtcatatagtacgtatcaaggaatttagaaaataccataccaatattaatttaccgaagtgtccattttggaccgacatgcatgccatcatctatacatatgcttctcatatttctaggataaatattttacaaattattcatagctaaaagatttgaaagttgacatcattcttatccaaaatgaatgacgagtattattaattgaaaggaataactttttttcacaaccttacgaaccaatttaataaccataaattaagaattaatttggcatcgtagtggtttcaaaagcaccaactcattttggatttggattcagagaattagttgaaacttgaaactcagaagcatcttctaatttggagctgtaactttgcccgtgtacatccattcaggaagtagaggcgagattttaatccattattaaaaaattaaaatttggatctgtaacaaaagattattactggaaccaataaagattcactaattaagtagcatcggaagcgactaatacataacccaacaaccacaaactgctcctgaacacaaaaggaagacaaattaaacaaacaaacaaataaatgagcagccagacgaaaatttacccttctttcaagttcaccaaatgaaacaactattagcaatttcgatcaccaaccttattatgtacacgcggaataattatataattaagctcagctcatgattattgccaattagtaattaaacaacacaaatatatgtacagcaaaagagagagaaattaagtactcaaattaacgctcacaagttgtgcagcggatttgatccagtcggcgagaacctcttgtcgtcgctgaagaagccatcgtcgccgccgccgccggtgccggtgccgaaccgccgtcgggtgaaggcggcgtggcggctctgatccttccagtgctgcccatgagccgacgacgacggcgaggcgccgttcttggaaccgggaggcggccgcggccgccgctgctgctgctgctgctgctccggcgacgacgacgggacgacggcggcggcgacggcattgccgagaagcgaggctcccctcagcgcgagagggacgatgatcagtgtcaccaccatggcaatcttgatgcagttcatggcactctctcttacttaattattagcctctctctctctctcacacacgtacactctcgagaagagatagaaatggagctatagcaaattatgtgctagctacttcgtcgttgtggccatgaaatactcggcaatgatggatacagtcttacataggccttctttgtgttggcagcttctgtaactactcgtaaaatctccaactacataaataggggtgtgtttagttcacggcaaaattagaagtttggttgaaatcagaacgatgcgacggaaaagttgaaaacttgtgtgtatacaaagttttaatgtgatggaaaaattagaagtttttttttaaaaaaaattggaactaaactcggcctagatcatgctcacgtccaaatttcgagaccattactaagatattttacaaagatctttaccggtagtagaaataaatttagtcggctcatctttttattagtaatttatttatattatagtctgaactattgatagtagaatgtataaaattaacggttaaaatcagttcgactgataacatacttacacaattgaatactatcagtacaaactatcataatatcactataaactagtagtaaccaaaagctgagcaactcagtttcttttctcacccactactaaccaactacttaggctgtgtttagatcagaggtgaaaagttttgacgtatcacatcgaatatacggatacacatttgaagtattaaacgtagactaataataaaacaaattacaaattctgcctgtaaactgcgagacgaatttattaagcctaattaatccgtcatcagtaaatgtttaccacattgtcaaatcatggagtaattaggtttaaaagattcatctggcaattcacacgcaattcgtgtaattatttttttgtctatatttaatactttatacatgtgttcaaacatttcatgtgacagggtgaaaagtttttacgtgggaactaaacatgaaatctttagccctcaaataggggagagagggagagagaatgtggctgtgagagttaagccgttttgttgtgtggttgggccaaacgaacaaagaaggcagctagatagctagttgctgctgacaaaaaggcctcctcattcctgaatgaatgcatgtaatgccggtgcaacagctctgatcgattggacgtgtgatgactcatgaatggtcgatccgtcccttccttgaaatttttaccggaaccaattgactgaggccgtgtttagattcattttctttttttctttaccaaaaacgtcacatcgaatatgtaggctcatgcatagagcattaaatatggacgaaaaaaaatcaattgcacagtttatataaattgagagatgaatcttttaagcctaattacgccatgatttaataatgtgatgctacagtagaaatttactaatgacagattaattaggtttaatacattcgtctcgcagtttacaggcggaatttgtaatttgttttgttattagactacgtttaatactttaaatgtatatcacattcttaaaaaaattggccaaaggactaaacacagcctgagccgataatgccaactacccctctatccaacggatgttcgcggcaaagtgatccaacggatatatgctccagctcgctgtatgtcaagaaagcttatgtatgtatcaagaattctcttttttttttccttaaacaagcagagagctgcgtgtcattttagtaaataaaaaaccaataatacattacaacccacgttgacaagttaaaatagacgcgccacttaatcaagaaaaaaagatcaaaggacactaggaataggaataggggcctaagctgtcccgacccacaaactctcaagatcattagctccaacagtacaccgcagattgccttttgcactcaaaggacaaataccatgcttacacgcttggggcatctctgaatcatcaagaattcaaaatgtcattatggacacacatgtatttaacatggcccatatatatactccatccacaaaagttacatctattactttttgtcaccaagacaaaggagaaattaaatcatcttggatattacaaaatcaaggagtgaatgcaagcatgcaaccaatgagtatttagatgactccttggattctaattaaacatttaatttatctcttcttttaagtcttgaatgcataaagactaaaaaaaactacttatttagaaaaactcaaatgtgaaatatgtctaacttttgtggatggagggagtacatcggaaaccgaacgtggaagtacaccatagaagattcaaactgatgacgacatcgagtaacaatatttgttaacaaggtttaactaaaacctatatccctggaggcactaattgcttatgcctctctgagttctctccgatccaatataattatagcgtatcagaattacaatgatcctctagcggatgttgtccgtagccatttcctcttacttatgctaagtcactatgcggtttcaaccggtatgtccctttatttaagagagaacctatgaccttaagtcgccatgtggttacaactggtgtgccgaacgtggaagaacaccatagaagatccaaactgatgatgatatagaggcaccatatttattaatgaggttcagcagaaacattcatccctaggacattaattacatgagcttttccccgatccttggccggtgttagccattaattccctctcacctatgctaagtcaccatgcggttacaactgatgtacctccctatttaagagagagcctagggtagagtacaactctattgctatcctaatacctattataacttcaagttttacactgtaatcgactttgtacacatattcaacacaatctaacaacacactcatttaagagtctcgttatttcaactttgacggataggatatcatgcacccacaactccatcacgacaacttcatcacgataccagcagtgtctgattaagaagacccggtcatgcgtcgacttgtcttatagtagtagattattataatcatctcctttggttgaaaccttaagaaagtgggtgtttagatcgagtggtgtaaagttttgacgtgtcacatcggatattatatagggtgtcacatggaatgttcgggcactaataaaaaaactaattacataatccatcagtaaaccacaagacgaatttattaagcctaattaattcatcattagcaaatgtttactgtagcaccacattgtcaaatcatggagcaattaggcttaaaagattcgtctcgcaaattagtcgcaatttgtgcaattagttattttttagcttatatttaatactttatacaggtgtttaaacgttcgatataacatggtgtaaaattttggggtgggatctaagggccaaagtaacaaagtgtgcttagaagagagccccttgagctacaacagtgtatatgaacagcgaagctgatgcgaggatctacataatctctgcacaaagtgagaactacattgactgaggagtactacaacttagcaagtgaccaatgcattgctgcatgagagtgtgtgccggccaaatccagagctctccctagatagctcacattttgcaacagcagcagagctagctagctgcaatgcaaccatgaagcgttccatccatcagcagcagcatctgccaaacttttctcatatgcatttgcagcttcagtctcactggtcagctgcagtgccatggagctgactcatggctgcatgcatatgcttgcctgcttgcttgctgtcccagaactggaaatcggaggctagctactgacggccattaaaatcgcagaaattccggttattacaaagtctgcatgtacagcaccatcactgtgtgcactgcaagcctgcagcttgaacacatgcatcgcattttggtttttgagcttagctagccgaaatgcatcctccttgtcccattgctagctctgaatttttctgatgcatcatgttcagacatcgtgtgtgtagggctgtagcttgccttcggtggtaaggaggggaacatggttcatggctctgctgcttgtgctgcatcaggaattcaggattgtgttcttgcaggatagtaggcagagacaaagttaagagtctgaagtcttaacaagtttgtggctctgtgcatggagattcacgcattgggttcttgtcatgatgtttaattgttagttattgtctctagcaaaagattcatctaagactctaggtcctctgattacagatgagccagtttagcagtaaaaagttaaggtttaaattttgcattatatttttgtagcatgctattgtgttagcatctttcttggatacattttataaacttgacaaaacttccagaaccaaacatgttacttactccaaactaacctacacattaaacttaccaagccagatttgacttctgacagaagcaaaccaaacatatctaccaaaaactctggagaaaagaaaaactctctgacacaacagactatatcttaccaaaagataaaaaaggaggggatagagaagtcacagatgcaaagtacaacccagattgtagcaatgtatcctccttatttttaatcatcagagtcacccagagatttcggtagggcacacaaagagtaacttattttgtcatcaactaatataactaaaataatactctagttaaaaaagctgagttaatgtctgaaacatccgtttcttcctcagttcatcctcatctccctattttggagttctgaaaattattgtatgtgagcataacaaacaggccatttcatcaccttggccctgagagctcaacagcttccaactgaattgaattgcactcatctgaagcaaaatttacaggggatgacagcatgaactccggcgtgctcggtttcgatctctcggcatctttcagagtctcccatttctccacaactgaaccatcactctcttgcagcattccagcaatctcagccatacttggtcgttggtcagggttgtacattgtgcagagcaaagctatcttaaccatttcctccaactcagcaatgacatagttgtctctcagtctactgtccacaaatgaccttagcttatttccttcaagaagctcctttgcctgcaataggtatgcacgattgtgtgtgattaatagcagttcatggcaattgaaataaactaagaaacattgtttttgagaattattgaagtgcatgtgcataaataagatcttgtacagtggagttacttatttccatatttggccaaagtttcacactggtatatgtgttaacaaatgttaatcttcaatttttttctccattgatattttttctctcaaccaagataatattttcataaatgtgtttttttgtcatatttcagtttgctgatatactattttgtaccattggattgtattctattggcatgaacacaaccaagtatgtacaatattaggagttaaagctatggaacttgtggaaatgaactaaatcaaaacatcacacttttttaattatggaacagaataagctgaacttgtagagggaaaaaaaacagggagtagctagtaatttacccaatcaagaattcctccctcctgatactcatcctcatgaagctccatcgttttccgaccggtgattaactcgatcaacaagaatccgaagccgtaaacatcggtcttctctgatgtttggccagtcatcaaatactctggaggaatgcgtcccattgtccccctcactgctgtgacagcatgagactcaccatgatccaaaagttttacaagtccaaaatctgccacaactgcttcaaaatactcatcaaggagaacattggaggcctttatgtcgcggtggataattttcggatcacattgctcatgcaaatagaccaacccgcgtgccgcgcctagcgctatcttccttctccttgtccagtctagagtaggtttaccacccacatattctgacaaagtgaggaaaaacagttagttcaatttgctcatagaaaatgaaaatacttagttcagaaaacattgtttgtgtgtggcaatgaatgaagaacttatacatcattttcatataattcttttcaccagtcaatgccctattgactcagtttcatactaacacaaatatatgtaatgaagtctataggaacaaacaaaaacaaacatgatgactctaatctaaagaaagaacagaacaactgaaaataaagaactctgtactatatatcttttggctttctcccaaatgccgggtcaatgtatttatattcggtctaaaaatactgaaaataaacatgaatgtcagtctgtcagagaaagggtaaatcccaaggacacttaaaaaaaaaacatctgattgtttagaaacatcatgtatcaactaatagataccttttgttatacatcctttggagggagacaataatgacagtacacaagatgcacatagtttttagcacttgtaccattaacagtataatatgcatagaccaagaaaacaaatgtgatggtaaaatatagaccaccttacataaacatttgcaaataaggcaaggacaacatgtataatcaccttacatatggttagctaaggtatattatgttattatagtgttccatctttgattggtaggctatcaatattttcttttcattttgaaaaatcaaggcaaatctcaagtacacaccaactttaactttgatatattcagaaagtgcactatagttttttaatgaaaaaaactaacatgtagtacatatttttgagaaatatattactgccttgtataattaacatctatactttacatccattagaaaatataggactttgagaaaaataggactttggcatgccccatgtgtgtcagtgtacatcatgcataaatgacaaaagaatatactgaagcatgggactaaccttgtaatttagaagaaacagttccatttggcatgaaagggtatacaaggagcctttcagtgtctgtaatacagaacccagtaagacgaaggagattgcgatgaacaatcaagcttattacttcaacttctgtgtggaactgatcatccccacaaacagaaaaacaatctttcatccttttaacagcaacaattgtgccatcgcgcaagcgacccttgtatactattccaaatcctccctgccccaaaatgtttcttcggtcgaagttattggtagcttctttgatctccttgatcatgaactgcttcagatggcctaggtatatttctggtcctggataaatatgatcacattcaggaatcagagtactgcacagtaaaattaacataactctatagtcatgctattgaagaaatagttaaaatgcctaaactgaggaaaacacggtatttggctagagcccaaatgttgtatcatacttagaaattgttggtgtttttaatctaaaaagacaaaaatgggaaaactatacataagcatatatgaaaagcaaccatgcatgggcatgactagtatcaacacaaaaatatgattagttatgtgaaatgttaatgcagttcgacccctctgcactattaggattttcttatcagcattgaattggttctcatatattatatccagttgttaaccatgtaccaaatggtagcaaagctaaatcaatggtcaaagggaaagagatccacacaaaaatatgaatatcaaacttttcgagtcagtgcacatgatagaatatctttaaaaaaaggtgcagaaagattataatatatttttctagaaagtctaatatctaaatgtcctactgcagatcaagattaacaagctctggatctctccctcacctatacttttcagcacataaaaaaatgccatggccacccatatcccactcatgcctctcttcggacacaatcggcaccacctgtcaattcccccacctacctatctcatcttcaacaccataattagctcctcgtgaccaggccacccatcctagggcagtggcggaggataaactgaaaaaaggcatgatggctgacacaacattgccacaatgatgcttaacggcaaacaccccgtgtggttgtgccacgtgccctagcatgcaccaccgggcgctcaacggcgaacaccttatgcagctgtgccacgtgccgccggccactcttggctccgccgcacctagccgccacaagcacctccaatctcccctgctcggtctcgactatatatggcggcgctaggatttggtacttattgctctgacctaccacccatggcccaccaactagtatcatatataatacctatattgaaccaggcccacgacccatgagcatatggtgcgctgtcgcctcacacaggcgaaaggtgcatccatgggttttgttagctagaaacgcgaggtcgagaagggggcgggggggtgctcgttggcaaatcaagactatattgtgacatgccatctgctctgtcataagggctgaaccagccatgggccaagctagtgtttgcccatttgatcatggtccaacttgtactgtagtccagatagcctaagtcttggtttcgcacatacaactctcatgctctatacccttccgtattgttttgtcattccccttttgccacttcagatgaacatgacctcaaccatcaccatctttcatatcacacgctctacggcacttaataataactcaacactttgaaccatcattggtgaactcaagcacagtcaacatccccacttgtcacaagcaccgacgtcacatattgctgcaccccatgctacttaccctaaggatccaaagttgggtaaccactaaccaaaacaccctagaacctgtactatgacacaaaagaatatacaactctatttcggtcagtcttatctttatatatagtgtaggaagcattggcaaacaactctaagtaagcctacctctgctatgcatgtcaatccatgacaatgttcgtggcttgatctctttagcccgattgaatcatgaataaccgttaaccacgacaatgtcgtaccgtcatttcaaagacatgtactctattttccttaattctaccccaagtaaggtttggtaaataaaatgttataattatataacaataagagaatgaaataatgaaagatatcatcatggaccatcataaaaatatgtgaattgcaaaataccattgtgtgcgagaatgacacgtggcactagatccatatgtcaatagcacgtatgatggtattgtccaactccatgatttgttttagtgtttaaagaaaattggatatattggcatgtaacttttgatgcattggcaaaaaagaagaagaagatgctaaggcagcattgtaggcgagcctagtgcttgttgtgatctcatgaaggctggttgtgagaaggtttttcattctagctaccttggtgttttatgtatgcgatcagagttccaatcataaatcattattgttttccttctaacttagtatcgcgttcataggaacatgttattatgtgctcctactcactttggtatggaaatatgtggcctgagtatcttgatacaaatgtttcagaccctcgcaagattactttttgtacagaagttaatgcgctaaacctgtaacaaaattagctaacatgtagaacctcaagagaactctccactttattggacttaatgcaaactttcctctaatatcacagtgcaaaccctccaccaacaacattaaaacataaaacattattatgttgtatataagtgccaaaaatggcaagcactcccaaaagaaaaaaaacaatcagggtgactccaaagttaacctattgatattttgacctatactgcccccttgcaggtagatatcataacaaatcttgcacatatatgcagtactacttgagatgtcattaccatcgaaatcagcaaagatctggtgtcgcctacgccactgcgaaatagacgcgacaaatccagcaatcaagaaaactattagaagaacagctgctatgtagaatgaaacacgccgagcagttcctgccaagccttttcctgtgaactgggaagagaaaatgactctaattagaacatgcaggagggcatgaatgcccaaacttgcttgcttcacacaaatttgtttaaataatggttcatatgcagttaaatgtcccagaatttgggtggtgaacaatttgtattactgattggttcttctatgctgacagcaactggttcttctgctgcagaagggacagcaatcgtctcttctatcacagaagtacaggttccttcacaactgaagttttgtatcaaaggatttccacgaaggcttatcaagtatgacaagtgagaaaaacagagaaaagagaaggcaaattagtggtaacccctgagagataatgttgagacaggttgcactatttagttagaccaagaaagaaaaactcattctaaatcacttacaatacactattcgcgctaaaaactggtgctggaccactcaggttgttaaaggatagatccctgaaatagttcagctcaagctcaatatcacaacaaaaaaagtttacaaaaacaatgaagcaataagtagaagttggcaaggagaattatacaggaggacaatgctgggagcagtggctagtgaatcaggtatagatccagataaattgttgtggctcaatctcctggaggaatgaggcaagcagaaaaaaaaatcaggtggtccaattcatgttcatatctgttatgcaacaacaaaataacaatgccttcaaatcaaaaaacataagagtattttgaggcattcttagtattgtactaccaccggtattatcactagtacaaacaatcagagccattatgcaacaaaataacaatgccttcaaatcaatagtcataagagtacttttaccgtattctctaccaatagtattctactaccagtatcatctctagtacaagcaatccgagccgttgatttatacgttctactaccggtagaaataattattctacaatttctacctttattctacaaccagtagatcaggtgatagtagaaacagatatagtccattggatgaaaaaaaaaacatggaatgtctagattgattatacttccagcagacaccactataaaagtagtctaatcataaatgctaatcttacatgaggaagatgcccttggaatgtcccagtatgcttggaatagtgcctgtgaagtgattatatgccaggtccagcgtttgtagcaccttcagcctgcctatggtgtcaggaatagggccagaaattgcattgtgttgcaaaaacctgcacaaaattcaaaccaaattcctcatttcctgagattatctgtctataacagtgaaaaaagccttgtcttggaatgtctggattcgaaaagagacccatgctcagtgagaattgatgtttcacattttgtccaaaattctcttgttccaaacaggggtaaaacaatcgcatcgataatttatactacttaaaatattggtattggtggtgttcatttgcacaccatccctactagtaacatctgagccccataatctataatattacaccacattttaataagtcctcccctatttcactataggctcccccaaatttcaaaattacttacttgttcaataaaaaaatcatagtattacttagactaaatgagtgcttattaaatgatttaataagctagaaattcaatttgggatgagtttgtttcctaatgttcccaactcctcctttctcccgtttttcacacgcacgcttcccaaactactaatagtgtgtgttttgcaaaaaaaaaattatagaaaagttgttttaaaaatcatattaatctacttttttaaaaatagctaatacttaattaatcatacgctaatgagtcgctccgttttacgtgatcgaggaaatagttcccaactacaaccagcgaactcagccttgttttccattgcaaggcacggctctaggctagtaatctaaagattatatatacaggttagggtttcacattttggaaagaagaaataaatagagggccttgaaaaaaatgggggtgggggggggtgctggaggattccaaaacttcagaagatctaacgaattttccaagaaaaaaaaaagaaacatgtacatatttttgctgaatttgaagaaactcacacttagttcaaaacaattttatatttctggtgggagccacttcctgaatggatccactgtagatccaggctgtgtttagtttacgttaaaattggaagtttggttgaaattggaacgatgtgatggaaaagttggaaatttatgtgtgtaggaaagttttgacgtaatggaaaagttagaagtttgaagaaatattttggaactaaacacggcgaaaattctgtaaactttcggttgggaagaacgaattccagatgaatcagaacaaaattaaatttcccaaaattcccttgaaatttctaggtctcaaacggaacgggcaccgatcgagtaaacagttagagagaatcaatccgtacaggagtcgcagccgcctgagtttcccgatcgccggcgacagcgtgccggacagattccggtgagccagatcgctgcaaaaccgaacaaaaaaacggagagagatcgatccatcagtccgagctccggcgaacccgccatggccggcggcgacaagcacaagcacagaagaaaatggacaactagatagctagtcagcacatacagcacggacacatggccggtcttggagcaggtcaccatgctccagttgcacgggccgccgccgccgccgccgccggcgacgaccacgccgcctgagccggcgttccagtcggcgaggacgttggccgtgtcatgcagcgccgccttgacggccagcaacgcctccgctgcaagacgcacgcgaatgcagcaagaaaaaccgggtgagtgagtgcagcaagaactgaaaatttttcagttgcaaattcgcaatatatatatatcaagaaaagattgatatatttggaagaacttttatcatcatgattcaagcaagaaagaatagcatgagctaagacaccaatcaaagatcaaactaagatgagaaggcaaggcttgcgatcaaagaattttttattttattttctttttgtgggtgttcagcaccttcaccttcaccttcgccggcgncggcggctggggaagaaagaacatccggcggcgccgcgggcgccacgccggcggcggcggaggaggcggacaccacgaggctcagaaccagcacggcgagcaaggaagcagcagctctccgctcgtccatggcgtcgcgcgctcgttcgtcggcgtcgcgctcgttcgtcggtgactcggtgtcgtcgcgtccagagcgcgctataggctatagcccaaagcgaaccgctcgtgcgaaggaggagacgagacgctcgcgatcgaacacttccaaggccccgcgcgcggcgcgcccgctactggacgcgacatgaaacggaagcgagagcagcagcagccgcagtgacgatggcgagagagagagagagagacgcggttgatgccatcgcgcgcgctagctagctggccacttggcgcgctcccccgctctggccgcgccgctcgccttgtccgctagcgccgcgcgcgcccgcccgggcgcgccatggcgcgccgcccccccagcgacgtcggttaccggtggcgcgccgcgcgcgcgtgagcggcgccatagcctgtggctgctgcgatgacgccatggccgggggcgatgcgcccatgcgtgacgtaggcgcagccttggacttctcttctgacttttggagcttcagtaaaaatgaagaggagcaaatctggcagattgtgattttttttgttgttggtgtaatcttgtgattaactcactgcatcagttataagctcaagctggtgattgatgatgttgtgtgtgtttgcttgtcttttgttaaagggaaattgtaactgttgtgatgagccatgaaaatgtggggtgaactgaactgaaacttttggggaaaggtatgtcaaaacattcagatgttgcaacaatctggttttgatgcaactgtacagatgttactttaccgacagatttacagtcatgaagagatatcaggatgtgctgcattttctaatgtaaagtttaaaaaagtctcctcaagatcatattttttttttgtcttagcatacaaccacaaaaatgtggtctttgtgaaacatggaagatcagaaaaccacatatacatataggcctaaatagtaaaaaaaaatctattggaatttttcaatcatgcaacaccaattgagttccagtgtattcacttaagttgtctatactatcatcaacaaacttttaaaaataattgagtgagtaggttatttaataccatatctctatatcttttacacaattgtcacttagtgaagagacaggtcagcgatgagactcgtctaacgcatgttagagggacatgtgggcccatagaaagtgagccccacataatcagtaacacttctccgttgttagaggagttgctttcgctcatttttctcacttattctatcatcatgttagcaaaacaactgcatggtatagctaagaaacgtctttattgttgttgtacatgttataaggaaccttatatcttttctaatgtaaaatttaatgtctcctcaagattgtattcctttcctttcttgaacaaaaccggtttgagatatctcctgagcatacaaccataaaaatgtggtctttatcaaacatggaagatcagaaaaccacatatacatgtaggcctaaacagtaaaacaaattattagaatctttcactcatgcaacaccaattgagtccactgtattcact

SEQ ID NO: 9023 - DNA, 3375 bp, Oryza sativa
ctccacataatcagtaacacttctccattgttagaggagctgctttcgctcatttttctcacgtcttctatcattcatgctagcaaaacaagtgcatcgtatagctaagaaacgtctttgttgctgttgtacatgttgtaaggaaccttatatcttttctaatgtaaaatttaatgtctcatcaagatcgtaaattcctttcctttcttgaataaaaccggtttgagatatctcctgagcatacaaccataaaaatgtggtctttgtcaaacatggaagatcagaaaaccacatatgcatgtaggcctaaacagtaaaaaaaattattagaatctttcactcatgcaacaccaattgagtccactgtattcacttaagttgtctatactatcatcaagagacttttaaaaatttgctatatacaaaatgataatagagtgagtaggttatttaatatcatatctctctatcttttactcaattgtctcttagtgaagacacagcacagtgatgaggcatcagaggggcatgtgggcccatagaaagtgggccccacaaaatcagtaacacacgtctgtctttagaggagttgtaaggaaccttatatcttttctctataccaagtcatcaaggttatagtttggttgtttctttaaaaaaaggttattgtatttttttggtaaaatttgctccaagacatcatagttttgatgttataaattgtcgcaagctatggtattggatatggaggttaataatacatgtaagaaactttctaggtatggattattttttttcatgtggtttatgctaagatgatacccggagtgtcaactgtgggtcaattgaatgaatctaccgattattgaaggggaaaaaaggtgcactttttttgggaaaagcaaaaccacatgcaaaaggaaagtttacgtatacacatgtgtgcaaacggtttaatgatgatttgaaatggttcagttggtaagcatagctattcttaaggctaaacacaacaacttgaaattcgataataaacagatataaaaagcactattttaaactatttgaattgatccgtttgagaactttcacaaatttcgtcattttgcaacaggcaatggctaacaaaaataaactgatcagttgctctgaactttgttcatatctggccctgagcataatcatgctgttgagacaaatttaaggccaacctggttgaatttatgaagacaaaagtgccagagccaagctactgctttgaccagtaaatcctagcgcaatatatttatgaaactataacattacaaaatcattttttcgagataatacaagagttccatgcagcttatactctcaacaagctctatatagttctatgctgtacattcaaaagttagatgacacacaagtccatcatatacctcaatttacagtagtgtagtttttttttgtgtgtgtgtctaaattaactctaatatttcaccaaaccatgttttgcctgtctgatactctgatcttgaactttggtaccttcccaattcacagctagcttaacaaaaatttgcattcgcaggagtttccagtagagaactctagccacatcactaacagcactactcgtgtttgtgtattatgcaaattccttgctggtgacatcatcttattcaaactcattctgatacccaatcacatttagaggagaacatcatcgttgtcatctccaaggattgacagagagaatggtgcaattgcgacattgaatgtagacgacccagctttgtcgatgtgcttcatctcaaaatcaccttcctaaatccaaaagagaattcaggtaagtttgctttgcagacatgcaacacgcaaacaacctaaacaataaataaattgcaggatataactagtctttcttaattgaacattactatttcttctttcagcttcaatcaaaacaattgatctagataccatgttaattattgggcataaattgatgccagctatatgcaatcaagagatattagaaccatacgaatctcttgcacagctagaatctaaaaattactttacaataacctatttacaagtgtgacaacataggttgtggaagatttagatgttaccattctcccatttggtgtgtttaatgggcatgcagatgagtactcaaaaccagtccttggaaatatgacaggttgctctcccacaacacctacacccctggcatggcaatggagcaagtctttattagctttaacatacggttcttttggtaaggtgagagtacaatagagacttaccaaatgttctccgtccttccatttgcatcagtgacaatccaatgtcttctgagaagctgaacagggcgctgagaattatttgtgattctgattctgtaggcaaagaagaactggcccttcaaaggctggctccggctttcaatataaacactcctgacttgaactctaatcccctaaattcaacattaaaaaatatcaggaaatctagttaagctcaatgaagaatctgagaaaatatttgatctacattaactaaagaattattacagaacaggtgacgaaaccaacggaggtggttcatctgtagtgcatgagattttcgtggaaaaaaagaatggggcgcctgaacatatgaaagaaatgaagtggtgcccaagggccaacgcacacagttataaccaactcaaatagattcttgatgaccttcacgtattaatctcttattttccatatcctgccttagctatttttttaggtcactacttgatacccaagttccctggtgaaattgcgtgaccagctgggggttttaaacactaatatactgccatagacaatgataatgtttcatagcctcaagttttcaaatgaccaaaccatttcattcaaaactatgatactttatcgagtgaaagaaacatgccagagttgtagtataacatcactaaatcattggattgtaagataccagggtagtagcatcactagaacattttaggagggcgtgtggagccaaaatcttcagttcatctctgtacttagcagcatcctggaaagcatgaaaacagagaaaaatcataaacatggtgaataaaagatgaagaaagaatgccttctagactgacaaccagggggtatgaaaatatctacacaaatcactattggcatatgattagcgtaaggagcccaaattcagcactatgtaatgatgaattcaaagttctggtcatgaaaacacaactccaactattacaagtagaaaagtcaacagtgaaggaagtaagtgaaacatgtgtattgagatgatttcttgacacttgagatttcctctcattttccgatgttatcatacaatata

SEQ ID NO: 9024 - DNA, 3162 bp, Oryza sativa
aacctctcctcctcaaccgccttcttgagcgatcggcggagacgaagaactggctcctcctcctcgaatgacttgagcgaatccctcagcctcgccgcctccttgtaatcctgcaaccaaattattccaattcgcagtaaaccccaattcggatggattcgattgcaagttcgcttgttgaaagaatccaatggagctcgtctcgtctcgttacctcgaactgggcggccacggcgagctgctgcttgagcatggcgtacttctggctccgcatcaggaaggccgccgccttctccatccgcgccgcgtcctccctctcctcctccacctcctcgccgccgccaccactccccggcgagttcgagttcgagctcgagttcgcatccggcgacggcgacgacgacgacgccgcggcggccagcaccacccggcgcggccccggcgacggcaacctcgcggttcttgccctccgccccatccacaccgccgccggcgccgccggtgccggcggcgagctcagcgccgcccactgcatcccaagaaatccgaatcgaccccccaagaaatcgaattgagcgcctcacgcagagagatcagcgaggattcttggagagggtggcttggccaagattggctcctcttccctcgccgtggctgactaaaaatgggcgccgctcttggcccccatttctgtggctctctccatctccatcgccgccaagaaacgagagggagaggagtagaaaaaaaaaagaaaagaaaagaaatgtttgggcttaactggtgcggattagcgattggcgcgtcattattggatcagataagaacgatcgacatgttggaatcgcacgaaaaagatcccggattttgggtgtgggcacaggggcagccacgactccgcgattgcgatcgacggagaaaaacaacaggaaatgttttgtatgctgttagtgttaggtttaatagtatagcccactactggcatcaaatcatctatagccaacgtaatggtcaattcatataatagttgcttactatcctattaatagctggttccacctgtcatacacacattacgtcttggagtccgtactgcagctagctacagatctgtagtccgctgctcttctctctcttactttatctctttaaagtatgtttatagctagcttatagcctgctattgtacctgctcttagcttctttttgtgtgtttgattatgtggctagatttagggtgtgttggtaagttgggattggaaacccatctcctccgcacgaaaaacgaagcagtccgttagcgcatgattaattaagtattagctatatcaatatgattttttaagcaactttcatatagaaatttcttttgtaaaaaaacgcaccgtttaatattttaaaaagcgtgcgcgcggaaaacgagggagaggggttgggaacttagagcaccgaacacagccggcatgttcttcccactcatttctcaactaacatccctcgttttcggcgttcacgttttttaactgctaaacgatgtgtgttttaaaaaaaattacataagaaagttgcttgaaaatcatattaatatattttttaagtttttttactaatacttaattaatgttgcgccaatcttttactttgtgtttccatgtgaggaggcaaggttaactcaaccttatcagtctagttaccccgcacgcagtcaaactaatttaagtttaaaatatatatgattatactagtaaaatataggaagtacatttgcccttaagcgtaacacaatttttgtgaatgtccatgataaaaaaaagataataaaattgtccaatagattggactcatgaaggtcacaactatccgcccctgcttgtagaccagatgacacactactaccaaataaccaaagtggaggtctgcatcatagagaaggttctcttctcagttctcaccatggccatgaactagaatgccactaaggctgtgtttagtttaccgtaaagtttagattttgtttgaaattgaagatgatgtgactgaaaagttgtgtatgtatgacatgttgatgtgatggaaaaggacttaagtttggatctaaactttagatctaaacacagcctaagttttggttggctcatgatttagatgatcaagtgaatacttgttacagtgggtttaagatttggtttaagaaatagaatgagtttatccatcatcacttcttaaaaccacacacttaggttaaaagaaaggtatattgcatattgggctacttattgttgccaatattgtatattagatcaagaatattcgatctttagactttgaactagataattgtacatatgttttacgttggactgttcttatcttctttgttgatctgaaagctgttgacaccttctaagttctaacttgaggtttgcccctttcctactctcaagctcaggcacgtatgtgttaattagccccaaactcaagttctgcccttggccccgccaccatgttcgacctcaagcacaatctttatttattaacctgagcttaaccttgagtagatttggaggggagtaaaataaaagaagtatattagtcatgcgacctaacttgagtgatatgattgactcatagatatactcctactcaagcaagtcagcaacgcctattagagcaggtacaataacagactataagccagctgcaaatatattttaaggagataaatcaggagagagaagagcagcgggctacagatttgtaaccagctgtagcacggacttcaagacgcagtgtgtctatgacaggtgggactaggtattaatagtatagtatgtaactattgtataaataagctattagattagctatagattaattggagctagtagttggctatactattgaacttgctcttagtgcatagctcaaggcatcataaatatgttaccactatcagtgctaaaatgtggtggtggtgggtgtatagctcaacttacgacatcataaatacgtggggaggcaaccgatgaggagtgagaactgacaacattaatacttattactcacctgatggcatcttttcctccatgaagaggaaagaatgtaaccacagagaacaaccgtagaaaagcacgatgggatcaatattatgattgaaattga

SEQ ID NO: 9025 - DNA, 10274 bp, Oryza sativa
tcgatgaatttcaaaatttgaataagtactcttctaaagtgtacaactcaaaatttagaattcttttaatgcaatgccaaaacacgccatctattttagaaaaaaattaatttttaataatgaatttggatgagcacttatccggattcctcctcaatatttgtaatttccctttttttcttaatggagtactcctgcagagatcccggtataggtgtacaactccatacataaatgccacgtcgcattcagtatgtggggcccacaacgccatagccgccgggcccattccctgccactctgccagtgcccaccacgaaaaaagaattgaaaaaaaacactgtaaaaaaagaagcctttttcccctcataaaacaagtttttttccctctctctttagtctcagaagaaaaaaagaagtttttttcccctctctctgagtctcaaaaaaaaaaaaagaagtgttttttttcctctctctctgagtctcagaggctccccgcgcgcggagccggagaggcggagagcgagacggccaggtcgccgtcgccctctctcctcccgcggcttccagtggcctctcactcgcgccctcgcctcgccgcccactcgcgccgcagccgcagccgcagccactcctcctccataagtagcagatggcgtctcctccaccgcgctctcgcgtccgtgtccgcgcgcgcgttccgcgactccagggcggcgttcgatcgatttgatttgatttgaggcggcgccattgttgtgaccaagaaaccgtggacgcgtggttgtggaacgcggcgtggcgaggcgagatgcaggccgtggcggcggcgacctctagagcctgggcggcctccccgcggcggcggcggcatgtcgcctcgtgttcttctcctcctcctccgacgacgacggcgacgacgactacgtcgtctctcaatcgatgcccggtcgccggcgcgggcgcgccggtgctgccgctcggcattcgcggggggcgcatgctgctcgcgcccccacttctgtggaacagcggcgccgcggcgaggaaggcggcggtggcgacggccgcggcggcctcgccaccggcggaaggcggcgggaaggcgaacggcggcgccgtcgccggcggcatttcgcggacggtgcagctcggcgccatgatcctcgtctggtacctcctcaacatctacttcaacatcttcaacaagctggtctgcacatatatttttttcccccaattcgtcaatttccttctccttctcgacatgttctttttggtctctaatttgttcatggcggatcttgttggaatccatggcttgcaggttctgaaatcggtgcccttcccgtacaccatcaccaccttccaattcgcgtccggatcattcttcatcaccctcatgtggttgcttaatcttcaccccaagccaaggctctcccttggacaggtaacccactgttcttgtcaaaaaaaactggaataatggaatcttctattatatactaaaagtccatgagactttctacaaacgctctcaagccgccaagtggcgctctaataaaatagagaaaatcctagaaattctaagaaaaaagaaaaacaactaccctttgattttcacttaaattggtgagtccaatattatacaccgttagataaaatcgatcttaaaacaaactaaatatcatgggtcccacctatcttcctcctgcacgttggcaggtggcaggtggagtatatacgtacgtatacattatacgtacgcttccttcctttttttcttttttttttctttttttcttttccatttatatatatatatatatatatatatagtgcatatattttttaaataatcataattttacaaaacaaagaatctaccatcatataacaaaaaatcttcctttcaaataatgcactattttaaaataaattttacacaattatattatgtacctattaaataaacaatatctatattaactaatttatacgtgcacttaaactgatggccccattatataaatcatcggatctattttttattacattggtatattattctcaagtaatgcactgtttcaaaataaggtctacaccattatattgtgtacccattaaattaacaatttaaaatatatattaactaatgtacacttacactagaactggtggacttattattataatcatcgtatctattgtttgctaataaataaagcgtccgaaattcttttttttttgcccgctgcacaatgcacatttgcacctttgcctttcgcatgggtgacaaggtgtagtgtttgagacatataaggtgatcacaaccaccgtagagctaccgctttgccatatatcaaatcatatatggagatgattaattttgttaataacatgaaaagaaaattaaaggtgtgatgcagcgagagaataattaagcaccatgggttatgtttttctcaacactaattagctctgtttaagttgaaaccgagagttgattatataataattataatgtatttgtgttatgtcgtatttggattttgtactatttgttcgtaaaggtgaaagggatcattatgttataaatgtgagcgtaatattgacgaatattaatagaactcttactatgataagggtgataaagggagtttaaggccctttatttttttcccgattccatattttggatttttgtttgcacactttccaagtttctaaatagtgtcttctttaaacaatattctaactttttagaagtcaattcatttgttatacccttaaatagctatcacataaattatataattcattaatttcagctatcctgaaccttaagtactacatattttttttcatgcgagtcatggtgataaatcattaaagtcgtaaaattaatatgtaagagttactctgaacaattgtaaataggtgtcaaaattaattgctattaattagacatctaatggcttgcaagccacaaaattaatttcactctacatgtatataaagatggacgaagttggaacaaatattaccatatgtcccatacatatatattgcacagttaatattctaattacatgtgttaagtcatttaaaattcatgaaaatgctctcaagctgcgacgtggtgctctaataaattagggcaaatattagaaattctaaggaaaaaaaaatcaaagtatctatttcttgattttcacttaaatcgttaggtctaatattataaaccattacattaaattgatcctagaacaaactaaatactacgaggtcccacctctcctcccgcggcatacgtacccccctacttacatgggtacgtacgtttcccctcccttttttcattttttctccttcttttttttttaccatgcatatgcttccctccctttattcctatatcatacgtcttcatgagacgatttaatcaaaagaattttgagtatcttgcactcgcatttttcatttgtggccatactacacggtatatatatagatggactatatgataattaactagcaatacctttcaataatataagtgcccgtgcatacgcgcgggccaccttcctagttattagaaatgtcttatattgtggcaaaagtttgtgtattggaatactacaatacaattctagaaatgtaatgaattgtggtaaaaaaaaatgttgttagtgcagtatgcaaagatcctgccattggcattggtgcacacgatgggcaatgtgttcaccaacatgagcttgggcaaggtcgccgtttccttcacgcacaccatcaaggccatggagcccttcttctctgtccttctctccgtgttgttccttggggaggtacatgctttgttcatgatttttatattttgtcttaaaaagaggagacatataaccaaagagactgatcggtttatgctttgaaacaaatcgtgtgtttcggcagacaccctctttcttggtcttaggttccctcgtgccaattgttggtggcgtcgtgctagcatcgatgaccgaagtttctttcaactggtcagtggtatctattatctttaattccaatgcctaagaactgaggagtccttgatgctttgacttctgtcttcgtatttgtttaagcaatacaatgcattttgttgtaatgtagtatcgtgcaaaacttttgataaaacaggataggattttggagtgccatggcttccaatcttaccaatcaatcgcgaaatgttttcagcaagaaacttctggctgataaagaggtgattttcccaacccatgaagttgtgtagttcctcctacaagaatatttttcagcacaaaatgtatattcggacatttacagtatggtaaataccgtgaagcactgtatacctttacgcaatttgttcatatcgcaggaaacattggatgatataaacctcttctcgataatgactgttatgtcatttttattatctgccccactgatgctgtctgtggaaggcatcaagttttccccatcgtacctgcagagcaacgtgagtgtttgggctgttctgtattatctttgctaaccaatgttttattcaaacactgtctttttgggcatgtagggagttaatctacaggaactatgtatgaaagctgctcttgctggcacttgttttcatttttaccaacaggtgggctaaattccagtataaaaatagtttttatggttgtccaacggttcttagaattttgtagtaatttttatggtttgtctgcatggatccaaattttctagtggtggctagtaatacatgagtgtatctgcaagtttttttaattaccatggtcaatctctttcggattttgtttaattaccttaaccaaaattatttttgtttctgaggcaggtttcttatagtttattggctagagtatcacctgtgacccattctgttgccaactgtgtcaaacgagttgtggtcatcgtctcatccgttctcttcttcagaactccgatttcacctattaatgcccttggtaacctcacaaccaaattcaactgatcctaacagctcgcttttcaatttacccgtactgaattttgtccttttttctgcattcaggaactggcgttgctctagctggagttttcctgtactctaggttcaaaaaagctaaaccaaaggctaagactgcatgagtcaacatacacagctgcaatttaactagaagattcaggtttatctcttcttgaggtgaaatgggccgccaagcaatcacttggcttctctccaatttgtcttttgccagcttgtctgggtcttagaagcttgtgtataagatttttctcaggaaggtagtgatggaccggcaccaaaataacaaaataacattgtcagaagatttctcaagagaaatgaattttggcacatacttttgaaattcctgtccaagaatattgcctccttttttactggttcacttaaaatgtgagtagggatttttattcattccttttgaatttggctgaatgctcaccagatcagactacagtttgcatcacacaaaaagaaagtttagaagcttctatcttccgcctgttcttttttgtaggccatgaaactgtagaaccttctctctctgttttttttccttggtaatgggtgaaccagactggattgatactctagctggtaattgacagccatactagccagtcaacagaagatgactcctttgtggatgagaagttgggaatacattcaccataaaaaagatcaaagttgaaaggaaaatgttgaaaagagaacatgaagcaaagaagctgaggaggtccttgtcctacttcttgttgagagaaggatggcgcttcaatgattggtctatccaactattcaacctagcaccactagatgtttattttattttcttttcttttttgaaaccaaataaaatgtttattgttatagtgaataaaatcccaatttcaagggtgctactattactatctggtgtagaaactgttcctggattgaatttttgcagtctaattgatgatatgacagacaacaatacagtctcaaaaatatgtaacgccgttaactttttacgtgatgtctaatcgttcgtctaatttttttttaaaaaaatataaatttcatttattttgttgtgacttgttttataaaaaaaactataatcttaacttatacttttacatgtttatactaaattttggaataagaggaattatcaaatgttatgaaaaaaaatcaacagcatcatacatttagggacggatggagtatatagcagaaatgcaacaaaatcaacaaagttcaaatccatagtgtgaaactagcaaatctgtcataacaaatagcaactcatcatgatgtttcactgcattaatgcagttgttattgtccaaaataaatacagaagccataaactagtgtggtgttcttattcaaaagtaaaaaaaaccaaaataaatctcttctcattgacgataaagcgcacagagaggttaatttagctcttctttaagtggtcaaaattggcgggaggtagtcggatttggcgccaaggatccgcgcctgggtgtccgggaagaactccacgccggggagctgcgtgatggtgccgtcgccggcgacgccgacggggtaggtgagcaggtggccggggaggtcgcgctccggcccgtcgccggcgtagaggtcccagcacctgtccgccatggcgttcaccttgcgcacgcagtcgaggctctccggccgctggaacgcctcgtcgacggtaccgaggtgctcgtaccacagcgccatcctgaacccgtgcacctgccccctcgccggccgccccgccgccgccaggtggtgcggctggtacgctcccatggcgatctccgagtccctcgccccgtccatcgacctctggttgatgttcgccgacccgacgatgatgtactcgtcgtccactgatgaacacacaaccaaatcgatcaagaaatgcatccaaaaacaatcgtggtaagatcaatcaggagatatatacgaaccgatcatcatcttggtgtggacgtagatcatgaagcggcgattctgctgcgcgtggaagtagccggtgtcgggctcggcctgctccggtggctcgtactcgccggcggacttggcctcgcggttgccgaggcagaagaaggtgaggtagtccttggggtcggcgtcgatgcccttggcctggatggcgtgggcgatgtcggtgtacatcatctccatagtgcggcgctgccagtcaaggatggcctggacggagccgctctccgggatgccctccggccacatcggcacgacgacgtagacggtgaagcgctcgccggcctcgatcttgctcaccaccttcatggagagctccttggggatgaggtggagcgcgccgacatcttccggcttgacgccgtcgttgggcttccagcagtaggagctcccgaggaagtactggttctcgatgtagatgaagctccgcgccctcctaatggcggcgatgtaggcgtcctggatgctccggtcgatgatctggtccttgccgctgacgaggccggcgcgggcggcgtcctcgggggtgtccgggaaacgaacgcggcgccgccgtcgatggagcggaacagctgcacgttccacgactcggcgtcctccgggaacatcgccggcgacggcgggatgaccgtctcggcgaggtcccggagctggacgaggaggtccttgccgccctgcttgcgccaccgctgctcgaagttgtagagcacgtcccacgccacggggccctcgaggcggcagtggatgtcgtgccacggctcgcgcggcccgcccttggccaccgtcgccgtcgcgaagttcggctggtggaagtcgtcgtggtgcgccgtccccagcgtccggaacagcgagtggaacggcgtgtcgtacctcccgtcgcagaggtccagcccgccgacgaagctcaccaccctccgccgcccgccgccattgccgccgccgtggcgcgacgacggcatgtcgtggtcgacgacgacgatcttctggtggtgcgtgaacatggtggagatctgcaggtcctgcacgatgctgccggagtcgtccgggttgcgcgggcacagcacgcagttcacctccgtgccctggaagtagttcatcgtctcctcgtcgtgcgtcgccatgagcccgtccttcttgagcatccccaccgacgtccggtcgtcccacaccagcatcagcaccctcacgccctcgccggccttcttcttcagcagctcgccgagcgtcacgccgccgccgggcttcggcggtcggcgtccctgatcagcgcgatctccgtgtacaccgaccaaccagtgatatagataaaatgcctcgcgcccttgatgggcgtcgaaaatgtcctcccagcaccggtgcggctcgtagctccggccgccgtcgagcgggatccgggggatgaacccgtcggggacatgggcgtcctggtacaacgtcaccttgcatccttgccgctgcgagaagaaggtgtagggcacgccggggtacttgccgctgcggacgccgcggccccagctccgatccttggagatgtcgaagtactggagcttgacgtggaccttgccgccgccgtcgccgatggggtgcgcgcgtcggtgtcgtcgcagagggggagccagcggtcgacctcgtcgccggcgaggacgtcccggacggggaggtagccgacgccgaggagggaggcgccgatggggttcttggccttgagggtgaaggcgacgtgggtggcgaggtgggcgcagtaaacgtggaaggactcgtaccagcgcggcgcggcggtgtcgtcggcgagcgtgcgggtgcggccgacgcgggccttgtcgaggccgatggtggcgtacaccttgctcgtccccttgcccacgcccaccgtgtcctcgatcccctccaccagctgcgtcacattcgcgcaaatgcaaatgcagcttcatcagtactcctacagttttctaaatatttgacgccgttgacttttttaaatatgttttatagtttatcttatttaaaaaaattaagtaattattaattcttttcctatcacttgattcattgttaaatatagttatatatatgcatatagttttacatatttcataaaagtttttgaataagacgaacggtcaaacatatgctaaaaagtcaatggtgtcaaatatttagaaatggagggagtaacagattctgagtgaggatatttaaatttgaccctttttttatatctcagtttgtaagttgattttgtgaagtgttgtatatatgctgtatgaatgttgtcaaaagaatttttcataattatttgaatgggtttttgacaaacaagagacatcatctcgagggatcaaaagagtttaccgaggcaaagcattgcaagctattttttgatttgatttgaaaaatataaatttcaacaaaacactagtactccctccgtcccatccctccgtcccaaaaaaagacaaaccctggtttccgtgcccaatgtttgaccgttcgtcttatttgaaaaaattatgaaaaaaattaaaaagacaagtcacgcacaaagtattaatcatgttttatcatctaacaataataaaaataataattataaaaaaatttcatataagacggacagtcaaagttggacacgcaaacctagggtttgcctttttttaggacggatggagtatgtttgtagactagctcgtcctatagattgaaaatgtatgcacatgatgatgctactgatggtaatttcaatatgattatgactcgaatatcgccgcacacatttccattggatagaagagagaagagaggattagcaaaaaaaaaaggaatagaattggactgtagcaaaaggagcaaatcacgttcatgcatgaatggatggcaagaaccacttccggttatgactgttaaaacaggcaccagctaaaatctaaattataaaacgttgatttcagtttttattccattatagtctattttccagcattgctttctaaaacacaaacaacacacatatataaaataaaatcatcaccataaattatattcggttgctttcgctcatttttccatgacttatcagccatgtctcaaacgatcagggtaaaacactagacaactcgttcgttgtacacgacttgaaagttgaaatcaatacggcaaataatatactccctccttacttaaatatttgacgccg

SEQ ID NO: 9026 - DNA, 11355 bp, Oryza sativa
ggaggaactggggcgcttgggagcttggcctgctagggttggagagcgattccgcctcgaagatggtgacgtgcatcgtcccatggagcaggatcttcgccattgttagattaaactatctatccctcaacacgatctcgatgatcacccctgcacacatacaaaaagggaaattgtgtttaccatgatgcaaaatctcatgctcgatcatagacaagttcatggctagaatctatacataaatccgtcagataagaaaaaaaataaagatgattaattatctgcaatggcgaacgcaccgattgatcgaacagaaggagaaggaacagggagagaagaggagataaggaggaagaagaggaggaaaggacggtgaattaatttaggaatttctagggaaggtgatccgatcatccgaaaataggaagtctagtgttgcagcggacggcggaggcaacaggggagcggagcagccgggcatccaccatccatccatcgctgcatttttttttcttttttttgtccccggttgcgccgcgccaacgtgctgacatggaacatcaagccctggagtttgtctcgccgagcatcaccaaaggtcctcctatttcatcctcaaaactgatttggagagattttagttaaaaaaaaacactccaaccctgctaccttacatgatttttggagtgtacaataattttttcaaccatagcacaccttctgcactgtatcaaaagatcgaaaacggaagagtcctcttcttcgagaagagtttttcccgcagcaatgcccagacaagcaaataatactagcaaattcgcaaaacaatatcatagcaaacaatatgtgcgggttggaatacttgtacataagtagtagtattaaaaacttgcaacacgcggaaggacaagggcctttagcctagtggttacaagcctcaatagcaccttaggtcctagattcaactttgcgaattttctaatatttaacggctttgtgctttcaatggtaggcgacgtactcgtcaacagcgaggtgcctgtggcagggtttacattaccggttgaccactaaatttcgagtcccatcggtatcacaattttcgataaattttaactaaatttagaccaaatctattgtttaaccttcgaaattccaattgaaacttaattccgagccatgtcgaaacgtcgaaatttcgcggacatgtgtcagtgtgcgtgtccccatgggagcgaattttccaggatttaatggacctatgtgagtgtgcgtgtccccatgtcttcgaagatgctcataggggtagggtgagtatacatgcgttgtgagtgtatacgtggtattgtgtagttctaaaaaaacttgcaacacgtgatttttttccctttttgcacaaatatcgatgtgttctaatggtacagaaatcaaaattacgatgtagacaataagggcatgtttagatcccctgtcaaaatttttcaccctgtcacatcgaatgtttggacacatgcatgtagtattaaatataggctaaaaaataatcaattgcacagattgcaactaatttgcgagacgaatcttttaagcctaattgctccacgatctgacaatgtggtgctacggtaaatatttgttaatgacggattgattaggcttaataaattcgtctcgcagtttacaggtggaatctgtaatttgttttgttattagtctatatttaatacttcaaatgtgagtccgtatatccggtgtgacacgccaaaatttttcaccgttggatctaaacacaacctaagtttgcaatgtaactagatgaaccctgcatgttgctgcaggagttttgtacgataatagtagaaataacacgttggatagctagatgacataattttatatattttatataattttcatatttgatcaaaattttttaaaaaatataatggtttataacaatttaaatcatatatagattgaccatttaaattaatgtgaaactaatgtgatgtggcagaaggaaaataaagaagataatatagattattcatccaaagtaatatgaattcataagagaagaaaaggagaaaaataattcgaaccatagatcaatcatctaacggctaaaaaaattaaggtgatatgtcttaatgagattagagaaatagtattaaccacacttagtgagcatgattttatagatacacaggattacccacatttgaaatttcttttttttataaaaataaaacccgagacaaatttttaatagtctcgtttattatgtgctactaccgtgtgtaaatagggagtataaggaaagtaacatctgtcataaattagtaacagcagcgggcatttggtctagtggtatgattctcgcttagggtgcgagaggtcccgagttcaattctcggaatgccccattttttttccagttctttttttttcttaacctgcacactcccgctaacagcaacgcgacacgcaaactcgccgcgctgctgccaccgcggcgcgcgcatcgaaacggacgaccgcgacgcccccacccccagtctgccacgccgcagatcgccggggcccccgcacctgctgcactgcacgtcgtcgtcctcctcctctttgtcctgtcgccgaatatatcctcaccgtgcccatgcccatcacgcattcacgcctcacggagtcaatagcgtgaacaatggtgtccatggcgccttcctcctccgccgccgccacccgccgccttccccttcttcttctcctcgccgccgtcctccttctccacccatgccacgccgccacggtccgttcttgccttcttgctccctctctctctctctctctctctctctctgtctggtcgtctgacgcgtgcgtgcgtgggtgttcgttgcaggaggcgtcggcggcggcgaggcgggagtgcacgtacacggtgcgggtgaagacgagctgcgcgtcgccggcgcggacggcggacattgtcagcgtcgcgttcggggacgcgtaccggaacgaggcgtacggcgcgcggctgccggcgggcggggcgtcgggggcgctcgaccggtgcgccgtcgacgcgttccgcgtcggcgggcagtgcgggtacggcgtctgctacctctacctccgccgcgccggccgcgacgggtgggcgccggagtgggtgcaggtgttcgagcctggcgccgccgccggggagaagccgtccaccttctacttcggctcgccgctgcccgacggcgtctggtacggccacaaccgctgccccaaggcgtccccggccatggcggcgcgccggacgaacacctccgcttcacctctaggctagggtagctgctcgctccgcaatgtactagtagtactacggaattggcgattttcggaattcggatgcatccatccatcactcaagaataaacagcctcgtgtgtgtgagaaatatcggaaataagagctttcggatgacacatttatttgtctttgttcttttgtgttcaaatgataaactttaacttatcgaattctactaaattttgttagtccgagcaaaatttagtcatccaggaaaaggtggttgaaagagaaaaatactgcattgtagaatattgctgctccctccgtttcattgtatacgctctctcaaaaatcgttaactcaaaggtgagaacatttaggcctctttggcaaagggttttcataaggttcaaattatgaattttttccctataggaaaagaaagaaagcttttcatagggttgtattcatatgctttacgtttcatagaaagtttatagaggaatgcaaactctcttttgttttcttccatcgcactatcaaagagctgtaatcttttcttgtaggatttaagaatcacactacaatttccagtgctcctatcgaaaatattctttccaacaaacaaatggctatcccaaaatcacttcgaatttcttaggattttctcaaattacaaggctcctcgggacgtaggattatcaaaacgcacaaataggaaaaatatatgaataagatgtcatgtcacatacttttgattcctatagggtattaaacacacaggaatttcagattttttgtgcatttggatggtttgtaggaaataaaactcagaatttttggaggttgttgttttgtgtgtcagatatagtagacagacaaagggatactgcatgggacttcagactcctttggatttggctaatcatggtgcatgataagaaaaacataggaattgattgccatggctaggccaaatcctacagaaagtaaaatttcagggatttgctaaagagcatgtttagttagtccataggaaaacctcaggaattgtgaatgaaatacttcattagaataaataaaatatgagagataaagagacatgttgtcttggccttctcaaaggaggaaaggaagcgatcctacagaaattttggaacccagtcttacaatccaaaggaccttatagggaattttctataggattttaattctttgaaattccttggttccaaagagagcttatgcttatatcctatggaattgaggcataggaagcaattccaaaggatttttatcaatcgcattcctatgatccaaaggagctaatagggaacttttttttttctaaggattgaaatcctccaagtttcctttgaaattccttcagcccatagggattttggattatttttaatatgaagtctaatctctaatatccacttcgtgacacaggattatagaaaaataggaatatgaaaagcataagaataataggattttaaaacacaggaatcctgaatttagttccttttataaaaacagaaatagagaggaactagataggtaaataaagcacaacatttttcaaaatatttaatgagtatattaaaaaaaatcaagcattaataccagcacatgacacccctctacatcattcaaagcatttattgcaaaatgggtactcccaaaataatatacatatcaacatgagctatcgagatcaccgtgggcagcaacaatcagaagcgagagggatgatgcagcgtctccaaagtgtgcaggtttgcaagatcaggagggaagcaaataggattgctcatgctttagctcaaatggctatgaggtctagatcgtatgaggagtggaagttgtgtcctcccgcagaaatcttagacttgataaatcaagaatgcaattctcttttccgtaatcaataaaattccctctttgaagtaaaaacaaaaacaatatacatatcgcatatattgtaaaatagagagaatccgtgaacacatttaaagatgaggaagctacacatgaccacaaaataaattcatatcatgtttgcaacatacatatacttctgtgccgtgcggtttggtttgagccattgaaaaacatgtgtgttgtaccgaagaaaatgtgataggtgcccgtttataaaatccacatgtagagacgaagaatcaaaacctctggtagctaatcaacgtcacttagactgccacacaggagcacaccaactccctactagaagtagtagaacgccacgtgtgcaaaccaggatttggatcctctgcatagaggatgaatagtaccgtgtttatttaaggtacccggtagccattcgatcgagatcgaacggactaggtaacacgctgtgatatttgtgatgttgtagccaccatgatttaccacatttcagttttagcacaggacacattttattgcactacaagagattctcttgatttattttaggacgggtgggtagttttctgcgttttcttttgtatttttggttgaaacagaagtccacggaagtcaggaaccagtttagatgagacttttgactttttactattgagctctatctattcacttattcttatactaaccgaatcgcttattagcaaataaaaatatatgtttgtaggtaattattttatatacgtattacaaagaaatactgtaaaataaatttagataaaatgccaaaaaaaactcaatttcaaactaagttgtaaattttaaattttgatctgcataagcatgcgaaacaatgagaccttttgatgaaaggcctggttttgttcccaaatttttttttcaagaacatcgcatcgaatctttggacacatgaatattaaatatagattaaaaaaactaattgcacagttacagtaacccacatataataataatggattaattaggctcaaaacattcgtctcacggtttacagacgagttaatcccttctaaacatctaatacgtcgtctaaaaatttccttttcgcaagctaaactggccctttgcattcgaagccgcaaagtgcaacaaagaaaaaaaaagtgcactttcctggccggctgcactgcagtgacctcttctcacctcccacctcctctctctctctcccctttcctttacccgccgccgccggcgtccaagaagcgcgggggttggtagggcggtgaccggcggcgaggtcaaagggattgcttgctgctagtgctgggcaggtacaaaatagtcgcttactcccattctctcactacctcaattccacctgctgctgctgcctgcgacaccgtattccagatcacgccgtggaaaaaggtctctcatctttcgtttatttccttccctttttttttctttccctcttatttatttctttcaggttggttctttttctgccaattcctgaagaatcgcgcccttttttggctcccaagattcttcccccctccatttctgcgtcttttccacgccacggtgacggcgacgagcttgctttttttttttttttcttttttggggccaattagtgattctttgtccggccttgcgattgctggagttgtgttggggatcgaaaccgaggtgagccgatgagcaagaggagttgcggcggcggcggcgcgcggttgcaatgcgcggcggcggattggggcggctgcttcctcgcgctgccaccggcggcggcggcggcggtgccctcaggcggtgacaccgatggcggattcaacctggcgtggactctccaccagtcgttccaccctgcctccggcctcttcgccagcgtcggcgtcggcttcccggcgacctcctcgagctcgccgtcgccgccggacgctcccggagacccgtatgccaagtatgtctcgccggagatcgagcaccatgctctgcccggtcaaagtgtggaggtggagctaatggagaaggggaagaagaacaagaagaagacgaataaagcattcaagctcaagatcaaggtgggcaatccccacctgaagaggctgatcagcggggggatcgccggcgcggtgtcgaggacggccgtcgcgccattggagacgatcaggacgcatttgatggtggggagtaatgggaattcgaccgcggaggtgttccagtccatcatgaagcatgaagggtggactgggttgttccgcggtaactttgttaatgtcattcgagtcgccccgagcaaagcaattgaggtaaccgactgatttactgatcatggtggagtcatactttttttacagtgtttatgtgtaatgtatattgatactgtactgtgctttgtttgtgatttacatacaatgggggaatcctgttaatggatttttgttttacaaaatatgtaacccttattcttacaaaatggtactccctctgtcctaaaatgtaagcatttttagctatgaatctttgtctagattcgtagccaaaagtggttatattttgggacggaggtagtaagcattaatgtttgttgcaaatcaatgtttgtttctttccgcttttcgtgtgcttaattgatcctgtaaacggcaaaatgtgttttctcccttatgcttaggatacattatgcaaattgttaggtatgtggttcaaataaatctaggtatatcttttatattttaagattaacccctgttacccaagaaaagctgaatagctcttttggcatagcttaaaatttgttgagagattgtgccattttggtattggataccatagagttaagttatataggtcagtgtgctagccttgcgcagtatgcaatttcggagctagtgtaaggctgaaagcatcgatgtaatttctgttataacacatcatttcatcagcgttgtgctatcttgaccttatggatgatattaatgggaaaaaatagtgatgattatatacccaaaaacaagaagcagtttgcagtttagtccaccggtacgtaagaattgctcttatctgttgccataacatttccctgctcaagctggtctgaagataagtagcttgaacagagtatggtcttcataaatcactatttttttttattttaacataatagaaacttggtatttgctttctctccagtgaaccatacctgataatttacacaatattagacaacagctgagcgcaaaccgaaggcacatacaagacaaaactaattatatccttttttttttttgagatttccattcccagaggtattggcctgattaaaccaaggttttgatctgcagctaaataattcctatatctttatgtttgagtgagctgctccaaacctcaggcaacttgttgcatgattcatgtaagaaaaggtttgtatgtttcaaggaagctacagtcagaaagttcttgtattgattttttatcgtaattaaaaatgtaataagggctataaaaaggctaattctcatgcttatttgaagtatgaaaacatcaggcaggtccttgcattattgttggctttcttcaaattttcatttcttttatcaagaaaccttttctggcattcacagttagagggttgaacagaacacagttgggtgtttaatttttatgttctgtttgttgcttagttcacacatgttggatgcgcatggttgtgtatatcatcggacaactacgatataaatgatggatgcatgttgaaacataaatagctagttgtacaagtatttgtgcacatacatatattaatatttggccgtcccttctttttctgcagctcttcgcttttgatacagctaacaagttcttgacccccaaatctggggaacaaaagaaggtcccactccctccttcactagtggctggggcatttgctggtgtcagttcaaccctctgtacttaccctctggaattaattaagacacgattaaccatacaggttagttctatccctctgtatgcctccctgaaactagagccttttaacttcctgagacgcaatacacgaatgtcatacgatggttgtgccttaaaatgtgcagagaggtgtatatgataactttctccacgctcttgtcaaaattgtccgtgaagaaggccctactgagctgtaccgaggtttaacgccaagtttaattggagttgtgccatatgcggcgaccaactactttgcttacgacacccttaagaaggcctacaagaagatgttcaagacgaatgaaatcggcaacgttcctaccctgctcattgggtcggccgcaggagctatctcaagcacagctactttccccctcgaggttgcacgcaagcacatgcaagttggcgcagtcggtggcaggaaggtctacaagaacatgcttcatgctctcctgagcattctggaggatgaaggggttggagggctttacaggggtctggggccaagttgcatgaagttggtgccagccgccggtatttcgtttatgtgctatgaggcttgcaagaaggtattgacagaggaagaggatgactgaatagtgtgtccttacactcttcagagcgcagttttgcaacttttttgactggaggcatcttttgggcttgatttggaatcaaatcatgctggaatcggatgaaactcgtgtagtttcttaagaatttttaccccaactctgtgctgtcagcttggcctgataaaacctgcctctttccccagttttgcttcaggatatcatatgcagagaacatgtccaataactgatttctgctgagtttatgaagtggttgaaacgcaaatgggcagtcataattcccaggtggtgaaacaactacgagactctgtaatctgtgtgcagctttgcaagtgcatgaaaggttcatttgatccatttcctctgtgtttgtggcctctggtttatctgtcgagttaagatggcatcaacaatgttgtaacatcaagaagtgtgttctcagtgataattttttttcagagctcaataagaaacttccaaactagcccagcccagaaagcaggctaacaatgtccatgtccatatccagcccatttgtctgacactacatgggcttaagtgggcctatcgcagcaaagctcgctgaacgcccataggccgaaaccgtagcaggcttcctcacttatgtacctatagcttttattatggaaattacaataatagattggggcagagctaaaacgaaatggaggagcttaccacttatttgttttactctgctttataccaagtttatatgtataattctataaaagaaattaatgggctgggtttgtgggtgcctccttgattcctcatgtagctccgccccccataatacgcaatactaatttctttcaagaaaacgacaactctctgtaacatgtggtatcgatacatcgtttgacgtaagagaaaaagttgtaattttgtatataaaaataatgtgatacttttgtagtagtttcgtgaaatgcaggacgacataagagaacaaaagtgcaacaacttttctttttatctctagttttatatatgttcaaatcgtagtgtacagatcggcgcacctctaaataaatatatcatgcatgactcatgtaacacgaggcacgacctaattaattgtaacaaagtggctaaactatatgttcatataggtccaacaaaggtactcctattgatcatataacgtaaaggaacgataacatcgtcatcagtatgtgtatattaattggtttctcgaataaacataactatatgtatattggttaacacaattcaatgtttcaggttgtagcataaagtacacatcacggcccacatactcttggaagccctagctagagtaattgaaaaaattccaaggcaatttgacaatattgatattgcaacatatatagatttatcattttcttaagaagaattcggagttctttcggtagacaaacaaaatagacaagtttcagagaatatacaatagctttatcattttttcagatttcaacttcagtagtatttatctcttgtgatttctctaactacataactatactattccatccgtttcacaatgtaa

SEQ ID NO: 9027 - DNA, 14587 bp, Oryza sativa
  unsure (1)..(14587): unsure at all n locations
cggaggaagtatatagactcctgattttgcaatattcattctttttcaatattctgatattgcataaccgttggctgttcaaggtgcatgcacccatcgaggtgttatccaactcaacgagcaaattattatcactcatattatttcttcttttttttactttttcttaccttttgttatacatatgtcaccttgccttcgatcaacaggttgaagtggaactttagggcccgatccaaatacaaatcaaatacattttctttttgttttttacaatttaaatacattgttcctgcttgctttccctcgaaatttatgtgataaggtgatgcaaaagcatgctgctgaggaaagtgagataactctgatcgcttagaataagattgatatttatctctctagctttctattgtccaacggtatggccgtcttatagaaggatcgaccttgcattcctgagtcagattacatatgaacacgggtgatatttcgatcctggtggtgagagactaccaacatcgagacatgcacagggatgacatatattgccccttttttttaatttttttttgtgaatttgatcattcaaaacttgtcaaataaccaataaatttcgggcgaaaaagcaccgaaattcccaaaatttcaggagccactgaatttccgaaaatttgttggaaaacaaaagtgtaaaccctgaacatgcataggagtcggatgaatattatattacatatttggattgcaaaacatgcaatgtttttcacatacgtgctactagctagaagctgtcatggcactaacctagttgccgaggtggaaaccaggatgacctacctaaagattaaggatgcctattagtttaatgcggttatgatacacaatcaccaattgattctaatgtttgaaattaaacaaattcagttagggagttttacaaagaccagtagagagttagtgcgggacagatatctccattaaagtggcagatatgtgtcaaaacaggaaaaagaaccgcgacaactttatatgggataacatttccagttaagtgatatcttgcagaaaagctaaattatactatatgtttattgatcctatgtatgtgtctggccccagttgattcatctgtctttatcattttcagacagtatagactggttggaaatgttaaaagtaattttcaattgattcgacaccgtacgtatctggctagatgtatacagggaattgtaccctggatacatgtgcaaaaataggagatgtggttccaaacagtccggataattaatatgcatatcggataaatatcttagatggataatgtgccggatagtatttgtgtgatactccctatgtcgcataataagttgatttttggtgccttttgttcatcccaaaataactttatttttaagtaattattattggagtttgtaaaaaatagggaataagtacgttgaaaatagataaaatgggaaatatctgcattgagattttaataaaatggaggtattctagtctttttagtgttggtatgtatggaatatgtgaaaaataaatttattttagaacagaaaagggagtatgaacttatcgttttatgtcagatacggtggtacaatttttctgatcttgttttttttttatctgggtccaaatgaattactcacatatatgtatgaaacttatttcattctaaatggcaaattaattaatataaatgttaaaagtgtacctgtaaccgtagctaatttagttatcaacaacacgtgtacgggaaaaggcaacatcaatgacacggcgactgacaatcgagattgagtatacgaatgtatccttttttttagataatgatacgaatgtatccctgtcaagaaaaaatatattatgaatatataataacccatcatatacacgtgctgatggaacatctgtgcataaagccgaatttggtttcattttctccaattaaagattcgactcgttttaatacatcattcgactaaacatacgttgcacaagcagcacaactaacacgattttgttttttcaaaaaaacagttagtcagctttttgtcttcttttatgatcaaacaagaaaagggactatctaagaaactttgcaagtattttaggtgaaacacttctaaatgtaaccaggaaggtagcccgcgcattcgcgcggacatgtatcgtaggttgtatttcaaacactataagggtgaaatataaattagaaaatatttttaaaatataaactggaaataaaggccgcatagatgcactgacacttatttgttgttctagaaaaagaatagtaaaataaatcatatatcattatatacactgtaagggaatgtaaattatcttccaataaaaaagaaatatatttgctgtaaaatagatggtatattttaatatactactaaatataagaataagaatatctctcatatttaaataaaaatcattttgtcgtggtcatatataaactcccctattgttatagttttaaaagctatgtgcatttttaataaatgaaactgcattgtatattattaaaaaatcatcaacactgcttaactcgatgcccatgacttatttccacatctatgtataaatagtctaaacataccacttctaccggataatacgatagcaccgttaaaaatagacataaatgtctctctaacggatgaagtcgataactacaaaagctttcttatgtaatgccctgaaacatgggtcccacattgatgtagaagtgcacctaaagaccatcctatcgcaccattttaacacttagttcactataggcacacccacaaaggattgcattagtaagaatgtcactttagatacattgtctacattggtcttttactgacaccatcttaactcaaccatatgcatatgcctgtgatatttacaatggcatagtaaacactacaccctgcattgaaggacagggatggaaaaaagaggaggtgatgaaaataattataatttttgcctcctacttatttctgtgtggtattatttttaataaaatcgtagtttaaagactattgacaacaataagtgctggcgtttatgatttttcttattagtatttctttctgattttactattaatatattgatatatttttgtgatttattgttttgtccatagtatatgacgtatgtaattaagtttttttttgggaaagtgagacgataaatataggcggattggttttccatctaataagtgagaaagaaaaaaaaagaatgatgtgggcccaacgttgtacgtacgtatcaaagtatggacgtacttgtttttttatacctatacgtgcacatacaatgtgagtttttgaggtaaatttaattgtattttttataatagatctaatagttataaatataggtccactgcattctaaaattttttaaagcgccacataataacttaggagtgtttttagaggtgctatgtggcggcttaggaacatttattggaagtttaatggacttttagtagataatagatagataatagataatagatagattgaagattaggaaagggaagaggatatgtggggagagagggagtacgtacgttacgtaccaactggaggaggaggaggaggggaacgtaaaggaggtggggaccggtgtggaaaggaggattttatttttttatttgatctaatggttgaaaatattggacccaccaatttaaaggaaaatcaacggttagacttttagaatgccacttggtatctttggagcgtttgtaggaggacacgtggtggcttaggagcgcttataggaaatttaatggacttttagtatataatagatagattataatgtaattgtgaggtaattacattgcaactcatatggattatattataattgggtgactatatatgaaactatgaatcaaggatattgaataacaaatgattaaaagcacgtaaatgtacgagcatatccgcttaaaaaatattgtattttgcaaagtttagttgcaggcagtgtgtttggctgcctccatatagagccattttgaccgtctgcgaaaatattttttttattagtggcatgctgtcacaccccgaagttttcctcccaagccaaaattgtaattttgataaatgaccctaagaaaatgcaggtgaaatcaggagaaaaccctaagaaagtaatgcaaataataatcggatttgacatgtggaatttttcttgagttctacatgtcgaaactcattaacagggatttttagtggaattttcagagctctagaaataattttaaccaattaaaattgagcaagcaatgttttaattccagggaaaatcctttttcctttttttcttttttcttttccctccctttttcctcctttttccgaatgggccgccggcccattccctccttccttccccctcccccttactgggccggccgcaggccgaggcccagccaggccgcccgccgccctcctctccgggtcgccgacaggtggggcccacctgtcgggcccgtctcccacctcccgccgatctcgctcgcgccgccgcgccgcaaccgccgccgcgccctcgcctccgcctcccccgggccacgtcgaccacgcccgcgcgtgcgccgcgtctcccgcgcccactcccctctctctcccgctcgcgcccgcgcccgagatggccgggattcgaaaatcgaatcccgcctctctctcttccccactccctcacgtcggccggcgattcccgcctctcccggccacgtccggttccctctccccctatttaagcatcggcgtcgctccctctcgctttttccccatttcgccgcactctctcgagcctcccatcgctcccgcgccgtgcaaccctttgccgccgccattttcgctgctccggccgccgctagccgccgctaggctcgccgccaggccgcgccgtcgccgccgtcggattcgcgtggccgagatccaccccgtccacctctcctccgtcgaggttcgtcgccggagccctcaccccctcgcgcacgggtgagcatcacctccaccgccgcgttcggccatggtttccggtcgccgtggtttatcatcctctctctaatccctctcttctccttccttagggcaccccgaagctcgtccgctcgccgacgtcgtcctcccgtggcttgccgtcgccgttcgccatcgtcttcctccgcgccggccaccctcggtgaggcacccctcccttctttttccccttcctctcctcttagtgtcgcgcgccgtcaccttcgactgccgccgccgcctcccgtgccgccggttgccgccgtcgtcggccgcgtgccgtcgccgctagacctagccggccggtcggttttgatgccgagccgagccggcggccgcctctatcgccgcccgttccctccccttcctagccgccgttagcgcagccgcctccgcatcgcctttgcgccgtcgccttcgccgccggttgccgtcgccggcaacccgttcgcgcgtgcgccgtcgccgtcgccgcggtcggtcggccggccgtgagccaagccgagccggtgccgccgccctttctctcccgcgccgctgaccagtgggcccgcgtgccggcgccccttcctccctctcccgagtcgctgaccggtgggccccgcatgtcggcgccgcgccccgtgctgacgtcagccctggttaatattgcgcaataaattatttaaggatttttgttatagtaataaacacagagaatcttctaaaattcatatctaattcatccgagctccgtttaatcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtactttgagatagtcgccgaggtacctccagcagcagagcaaggcaagtcatgcttgtcacttgatcatattgatcctatattgcaaatgtcctaatgttttctttcaaataccgcatttgttttgcaataatactatgggatggttacctattgttacagccatgctattttgataccatgctcctttgttagcttgggttataacatgattagagttaggactagggtttgcttagccatgcttagttcaactagcacacaatggggagatctcatttaaaacctagactataggtttttatgataatgttggattagtgacaccgctttggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccgggatgtcgtggtggcatgtcggcgcacggaaacgtgtcgtggggctgtgtcttgtgggtacagttgtacacctctgatcagagtaaaactattcgaatagcagtgcccgcggttatgggcggtcaaccagattcaccgtgattagtctcaccctagtgtaatcttttgaatttggatagtttaggtggatggttgggcctgtcgcaacgtgggctagcgttggacagcggatgtttaatattaattaatttacaactgttttcgcattcaatttctgtttataaatgctcgttttatgcaaatgaaccactctagctcttctttgttaattccctgcatcatacccctattccggtatgacttgctgagtacagtgggtagtactcagtcttgctctacttttcccaaccccagagttcgagttcgggtcagatgaaggtttctccgaggagtaggctttgtccgtgctgtcgaggatgcctgtggagtggtgttcccgctgcagtttagtcaaggcttagctccagttaccttttgttttccgctgcatttttgtaagacttttatgatgtttgtaagacgtggatctgaatgtcaacattgtcgtttgtgtacgccggctggtcctggacggggattttaatgcacattctgcttggaattctattcgggaatttctgggcgtgacacatgcgaaggtgtgggaagagtttttttagccatttatataattacaaataattatgattttttattgaaataagatatcttattgtaaacaagaaaaatcaaattttacaatggtcttaaattgtgaaaatatttaggtgattttatttggatcaatcacggaaaataatagttaggaaaaacagaactttcatgaaagagagaagtagtactccctccattccaaagtatgaggggcaaccacctattattatcttctaatttagatcaccctaataaatatatagtaaagtacaccatcggttcttaaagttggggcgtggtgtcacttaagtctatgatgtaaattcgacatctagatttatgatcttgtttagatcttgtttaagtgaattatcgtaggtccaaggcccgtctgaccagcgtgaccgtaactttgcacttagcccctctacgcccggtcgacccacttctctcccaaatgtcttctcatcttcattgttttgatttagggttgtggtgacagtgacaggggtggtagtggagacgtggctatgacggcgacgacgagggaggcggtagggtggtgctgacgagggaggcagctagggggatttaatttctgaagtgcgcctgtagggaaggccatagctactcgaagcagcacgtattcttcaagttcacggaggaaaaagcttgatcacctgctaattcggtgaacttgctgctgcccttaacgcgtctctggtcaccacggaccgcccatgatcgctgacgccaccctaattgctaccctcggagtcgttgcaatggtgcgagttggagggatgggggttctagtgagagtggccgcgggtagaggagatatttggggggggggaggagaagtgggtcaaccgggtgtggagggcgctaagtgcaaagttgcggtcatgctggaccgccacgtagaaaggtcaaccggatcagacgagctttggacatgtgatgattcacttaaacaggatcatagatctagatgttgaatttacaagatcatggatctaagtgatactaaagacagacggtttaacgagattagagatcttaaggttgaatgatttaaaaaaacaaattttagagaggaggaaggatctagttaattgcacgcatgtatatgcgcatcgtattatgaaatatcgaaaaaaacagttgcgccctatattttgaaatgtaagtagtacctatgtgtctgaaaaatgaataaagcttaccaaaagtaagagtaattgcacacaacttagtagatgggtatgatgtaatacaaaaaaaaacttgagaattgaattttcaagtgcaacaatttaaagagtggtgccaatattaccttacaaccttggatatgtaatatataagaattaagttgctcatccaatctgcaccacatgtttagatatttttccttcaccttctcaaatctcaaccaaaatacaaaattttctaacagtgtaaaatttaattgaatcttaattactggaatgataaagatcaagtatgcctatataaatcgacgcaggtatatacttagaaaaaatgctctaaataattaagtatcgcatcacttctaaatgtaccaaaatcgtatccatcatgtaagttattgcacttgtgcactcacttattaggttttaatagattgcatttatatgttaagttgttgcaatgccatactcatttctcacgtttttacgattgatctcacctacctatcgtggatctaatttacagaaaaatatttgatccgtgaaactttataatatattattagtagtttaatttaaaggtaaatatcagaaaacaaactacaatgaagaaacaaaatcttaaaccagctctgtaattaagttttaaaatttaaaaattgagactgtggctaatcgatatgccaaagccaaactagctgtactgttggccatctcgcgcttgtataatggattactatattttgaacaacaaatcaagctgaaagttatatactcctacgaactagtatacgaagtggaagcagatgcttaattaaacagactgtacgtgcaggcaagaggccaaactagcttgttgcgacgacatatatatttttcgatttaatgtgtgtctagttatttgggtgtaaagtttctgaagtatgcggacatatatttgaagtattaaatgtagactaataataaaacaaattacagatttcgactgtaaattgcgagacgaatttattaagcataattaattcatcattagtaaatgtttaatgtagcatcacattatcaaattatggcgtaattagacttaaaagattcgtctcgcaatttacttgcaaattgtgtaattgattttttctacatttaatatctcatacatatatcgaaatatttgacgtgatgcctaaattttttttaatctaaacaagcctcgcgggaagtgtccggaggtttcgtggtcgatatgtacggccaacggcgtacatgttagtattatattaatatatttcgattcgtatacggtattcccgttgctaaattgctagcgtacgtggcgtgtcgtcgcattcgccagcggaacacgtggcatgcacggatggccgcgtggatcggggtggacggtgcacatgggatgacatggattatctacgtgtcacctagtgtgttcggcacttctcctagcttcaactttacgggtcgttttggattgaaaccaaaatgtgaccctaccaaaattttggtaactttaatagtaaacatgctagtttggattgaagccaaacaattggtagcgcccacgctcaatttggctacattctagaatcttcttcactctcatactaaattttggctttatattggtattaaaccaaacatagattagctaactttgctctaccaaaaaattggtagtgccaaaatttgcctagattttggtactaccaattaattggtagggtagagaaccaaataggccctacgtttctgtgttaggatgtgttattagtccaagttcccaatctcactcttgtgcgtatacttttcgaacggctaaacagtacttgttttacaaaatttttctatagaaaagttgctttaaaaaaatcatattaattcattgttgaagttttttgaaaactaatattaattaatcacgcattaatccattgctctgtttttcgtgtcaaaaggtgaggtgagggttgggaaccctcacccaagaacacaagattttgaataacacaagattgagaaaatatataaatagaaaaaacacaagattttggtatgaatataagtctgaaacagagaattacaaagcacatgataaacacaataataatcgtttgattggagcgtaggaaaaacgtagcatatttccataggaatgtttcataggaaaaacgtagcatgtttcatacaatgactcataggaatgtttccatgaggttctacctcattatagaattccttcaaaatttgcatggcattaggtatatcataggatttcatatgatttattcctttgattcaaaggactatatagaaacaaattgttataggaataatatcctctaaaattcctatggatttcctttcaatcaaaggaggctaaacagtttaaaagattataggaaagttgtctaaaaaaacatattaatcaatttttatgttttgttaactaatgcttaataattaattatgtgctaatgagtagcttagttgtgtgtgttgccccggggggggangggtggggggtggtggtggtttagttttcaactctccatgccgaacacagcccaaaactcattcattgtggtttttagatttctggcaagcttttccctcttatagataaattattgcgggaatgctttttaaacttttaaaatagtaagtttttttaaacttttaaatagtaagtttctagaaaggtttgtaggactacttacatgctttttgaaaaacaaagctttataacaattactccctccatttttaatgtaggacaccgttaactttttgagatacatttgaacattcatcttattaaaaaaatatgtaataattatttattttattgtgacttgatttattatcaaatattcatttagaacgatttaaatagttttatatttacacaaaaaattttaataaacgaatgatcaaatgttgataaaaaaggtcaatgaacgtcatacttaaaaaataaaggtagtaatttatttgttttttctcaaatattactattaaattaaaattctatcttttttaaccaacgaaccacgtaagacagtgcaatgtctcatactgatatagcataaaaaaagagtaaattttactttggtccacctaaagtgatcaaagtagcacattggactagggctaagcctatatttttacttctttgtaccacctatgtttaccacccgttgcaagttggactgggtttatagtttgagtcacctatttggctttggcccgattgacgtgagcagctcgtcctgtatgtcccgatgccaaggaaactccccatcttcttcttcttcttcacatctgtgtgcagttgccgccattgaactcacagcgagcgcaacatttgttcctctcttattcttcttgttgaagcacaagcccatggatagagtcatggaggcgcagctacttggtgatggcatgggctttgctggtataggacactgagacgacgcttcccatgcgttgacgcacaccgccactgatgcgctttacgtgcttggtatcgctcccatcacgattcacgagcatacgctcagctcctcgcgtggatcaagctgaagccaaccaaatggctcaaaactgtaagcccagtccaacttgcaatggatggtaaagataggtgttgcaaagtgaaattataggcttagttctagtccaatgtgacactttggtcactttaggtggtgcaaagtgaaatttactctaaaaaaaattcaagactagccctgaaaggctatatttaggaaaaaaacacaacacgccacaccgcacgtctatgactccaccacactcaaatctatccatgcttttaggtaggagagggagaaggcgagagagaaggatgcatccactctcccccgcgcagacccgccaacatggccatcccaaaagcgccggcataggaggacaaatcatctagattagagattagtgggaaagggccttcaaacgacacctccaatgaggttacgacgccaagggtgtcgccatcgcctgtcccaggagcagggcaattttcacccgaataatcccctaggaaggaagaagactccacaccaacgtctccaagaaggttgcggcgccagaaagcgctgccgctgccaaccctaaacagcctggactttctcccaaagaacctttggccctcccatgccacatctccatcactcccaacagccgctaccatccaaaatcccttcaacgcatggctaccgcacaagtgccaatcgccagcggacaccatacaggaggccccttctcgaggaagaagccgaagtccatgcacaacaccactctgcaccaacatcgcaatctcccaccatcgcctacatcgtagctcgttgctacgaaggaggagagctgccgccatccggtgaaccatggcctctccctccttctgcacagaccacaaacatagccaccgtcgctgtcatcccgtcgccaacactcctgtcggcatgaaaggagaaggggatgggggctttgggggaggactgccaccttcgtctccacacctgaacagcgtgcagccactccccatcccacccacaatcgttgtcgcctatcgttgccacgagccacatctctggggacattacgtctaggcggccaccgtgccactccctgcctgcacgctgtcaccgctcattgcatcgccccgacgccgaccaccctaccaccacttaggatctggacgggaacaccagatccggacgtacgttctagatccttcacatccacccactgcaccgccacatcctctgccactgccactatcattgtccctgccatcgtctaggcacagaggtgcccgaccacaccgtctttgccactgccggttacccgctgagcggatctggaaggctccggcctcgatagccatggtcgtccgcggtctttccttcgctgcccgccatcttacccgtcacctcctgttgcctcgcggcctcccaccacaactagcgcaaccgcccccctcctcccaagcccccctccccaacttctcctcgtcgaatccaaccgcggtggccctaatctggcccgtcttcatcatgggcgcctaggtgccccaattaattagcttgcgagcggtccgctcgggcggtggcaaggcggaaggaggaggagggggcggtggtggccgggcgtttggggacacctggtttccctgacactgggagcaacgtgagcccgtcctcatctacttatctctttagaacaatcaaactgagctcgtatgggttggttcctctttgtagattacgttgtagaataaaagtagtatccttaaaaaatcagaaaatattatgttgatcaaacgtttctctctctatcattatggtttgttgttggtgtttacacccaaatttggcacttggggttgaaatagggaaaattgcaagatttggtaatctaccgatttcctccagaagggccgatctgaccggcggcatgtggccggtctgaccgtcaaagtccgaggccgactctgttttcgtcgggtgtcgggattccttactcagggggctatgtttcgggttccttttggtttctatcccaaattgaacgtggaggagggcctgtagagggcaagaccaatccctatttaagggacaaggccagctcaattgtaaaatatcaaacaatctatacaattaatcgaatcgttcttttacctttcattactttttagccatgttttctactttaccctaattttagtccatctttgttgatttgcgccataaatcgtctgccatcgctgtgagagtacgattacccctttgtaggttcgtcccgtaaaccttccgtttgcccacgtgacaggtaattatcctcatatcgatcaaaatcagcctcctctaaatcggctccgctagccggtttagcttttcttcctacaaaacccatcttgatttggcctttggctatatcagggtggttggcgactctatatcaccgtaaggca

SEQ ID NO: 9028 - DNA, 16226 bp, Oryza sativa
  unsure (1)..(16226): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctctgctgaactcaccattctggatctatcacccatggaacttcagaattttatttacaccagatgaccattggtgatagtccaaacctacatttaagtccagcaattttgatttatttatttttcttaatttgcactaattatgttctgaacacctctcaggctgtgttcattcaaaggtgttgggaactaatctctcgcacactaaaacatagctatccattaacacatgattaattaaatattggtaattttttttaaaataatttttcttaaaaaaacttttacaaaagatacaacctttaactgttctgtttgggaagcgtgcatacggaaaacgagtgatgagttagaaaaatactctctttgtcccaaaataaaccaacttcgtatgaaatatgatacatcctaatactataaatgtggacatacgcatgttcagatttgtaatactgggatgcatcagatcctatacgaggttgatttattttatacgagattgattttttcttttttgcggagggagtaggaaaaaacacagcccgactactttcgtagcagtggcatagtattatggtggtgtttcagagcttaaactagtttagtccttgtcacatcggatatttggatgttattttggagtattaaacatagattaattacaaaactaattgcataaatgagagttaattcacgagataatttttttatgtctaattaattcataattagcacatgtgtactgtagcatcacataggctaatcatggattaattaagcttaatagattcgtctcgcgaattactccagagttatgaaatgagttttgtcattagtctacatttaataattctaattagtgttaaacatccgatgttattgggactgagtttatacatatatcacgcacaagatcgaccacgcaaaccgtgtccgtgaaatgcaacacacgctgctcattgacttttttttttaaattgacgattggtaaagaaactcgatttttttccgcttgcgcagtggcatttgggcccaaaggcccaagacacacacactctctctccccctcgtcgtaccactcgccacgccgccgttgcaggagaaaccctcgccgccgccgccgccgccctcttctccgccggtagccggtacgcgacggcgaccattttcctctccttccccgccttcttgaacggtttccccaattttctgaccgccgatttgtttgcagctcgcgcttctcggcgacatggcgagagagaaatccaagaaggaggaggagggatccagtgcgacgaggaatccggcggccgagctcaccgaagacctcatcgtcgacatcctctcccgcctccccgtcaagtcggtctgccgatgcaagtgcgtgtccaggcggtggcgcggcctcatctccgaccccgaccaccgcaagaagctcccccaaaccctcgccggcttcttctacagcagcgagaacgaatcgagcttccccgatgaagaaacatttccaattgtcatttgtgaaacattggttggctacctgttgtatcgaatgattaatgctggtgtttattagctatccactgtaggcatgtaaaaattcaggatgttaatcagtgcttatgtttcttacaatttgacctgtttcaattctgataacattacacccttgcgctcttgtacattatcaggtttgatgcttgctaaaatcatgtgaatatacggtgaaaatgcatgagttttcatattgaagaattcagaggacgtggcaataggcttatgtgactttatgatgaaatgcatgagttcttagatagatagaagaaattatgagaaaatttcatgtttataccttgagaaacttgatgcatttgcactatgtgctttttatttgtaccatcaggttgcacttgggcggttgagcctgaagcagagcaacaacaatgcattctcagaaggaaccgaagaacacttggctgcagtcagacatcttctcaggtatgtactactgctatttagcagagactgactattggtgcagctataaggagtgtggagatcttcggcttgtcagctacagtgatagcgacatagctggggatgttgatgattggaagaaaagctctattctttgtataaagtcctatctgctggttgttcaggaaggagaaagtggtgaatctatcatctgtgaggatgaatatttcgctgcagcttgatatggtcatatggcttcttgctgaactgaaggatgtggaggcaggcaggtgtgttggttaacaggtgctcatttgacccaaaatcccaaactgaatcaaattttttggtttagaagttgatgtcctgatctgaaattttgatgaacaacatgcagggagagggatttctgttggtttaatcgtgctcctccaaacaccttctctactggagattctgattcaccgagcatttccttaacaagcgaaatgaaaaaacttagttttgactgccaatcgtatctcagctttttgtaccaggtcctatttgaattgaaatttcagatatgtttttgcaggttgtgctcgacgagctggtaattaataaatcaaagttatttcagcgaactcgattactgacaaagaaatgctcttcagatcacaatcaaattcagtatgtgtgccacgtgagtatctcaactcctcacacctattcctctccattcagtatcaaagctatctctcgttaaaaagttctcatcttatctctctctctctctctattcttatatccatcggatcgaactggatcatgtgttgttaatgagccttaggtccgttcattagcatataattagttttttttatctgagcatataattagttgagtattaactattgcaacatcgaacaagagtttatttaatttttaaagaaacttttatatagaaaaaatattaaaaacacaccgtttagctttaattttcggaaagcgcactaagaaagtaaaacctaacccctatatgcacattcgaactcaaccttgtagattgtcgtggtagacccagataaaatttagaatattgacaaacctaagtatttgatataaaattttattttaaatattctttttctttgaaacacagtacaaacataggctcgtaaaacgcacactcatcccaacatagaattttaatttccaaaaataacttcacaactattttatattataagacagaagtagtatgaatatttagtgtctactcatacttgcagtagtactgtgagactctgggtgtgtttagttcgtcaaaagaaaatttttgggtgtcacatcggacgtttgaccggatgtcggaaggggttttcggacacgaatgaaaaaactaatttcataacttgcttggaaaccgcaagacgaatttattaagcctaattaatcagtcattagcacgtataggttactatagcacttatggctaatcatggactaattaggctcaaaagattcgtctcgcgatttccatacaaattgtgcaattagtttgagtaaattgcattggtggtacacaaacttgttagctgggtgcgatttaatacataaatttgtaaaatgctcgtttcagtacatgaacttgtctagttcgtgcgaacgaggaccaaaataacttggtaatgttaattttacgaagctgattaggatgtgacgtgcatacgtgtagtgagtatgcataagatatgcaatatttataaatttggtctctactttatccttcatcatggaaatgatgaatttcatatatttctaaccctcatatcattgctaagttttttctttatcttttttctactatcactacatccaattattattttatcagagaggtgtatgtctaatagcaaccttctcagatatgtatttacgtagtattctaatcagcccctaaatcaataagattagccatgtagtgttcttttcgcctttctccgcacgcatcagacaagtttatgcactaaaatgagcattttacatgttcgtatactggattgcacccacctgacaagtttgtgtaccggcaatacaatttactcaattagtttctttatctatatttaataatctagagtatacatatattcaaagagtgtacatatattcaaagattcgatgtgacgtttttggaaaaaaaaatattgggatctaaacaaggcctctggatggctttgcctcactgtctgaaagtgctggacctacagtacacatagcaaccgacaaagccgtaccttgtccgtgcatgcatgcaaccgacaagcaggatggatgtatatgctagggggacaccaaacatgaatgaactcatcacacaattggcaccaagttggatggatcaccatggatgtgactccctccgacgatatttctagcgtgttttgtggcctaggatatccgagtggtcatggtttcatcaacctagttgcagaggatgatatcgtggttgttgagataaatatatggtgggtttgggatgattacaaccgctctgagtatatacttcctccgtttcacaatgtaaatcattctaacatttctcacatacatattgatgttaatgaatctagatagatagatagatatatatgtctagattcattaacatcaatacgaatgtaggaaatactagaatgacttatattgtgaaacggagggagtatataggttgagggcgtgaggcacgctaacgttttgttatgattgtttgttttgtattggagatacactatctatagcgagattgtttgctccatacgtaaaatacgcagattcgttcgtaagaaagtgatgtgaaatgtgatactcattgaattctagagaagctatatatatatataggattctactaataacgtttgcatgtatgaaagaactattgtattcgattaacttgttacatattcaatgaatatggatttataaagatatatagttgttggcattatcttaaaatcacatcgaactatagttacttattagatgtttgtatggaacttctccattcaactaatctagattcctttttagataaatatcaatttacataattttccacatatatatgactatgaaatatctccatcgatttctgtcgtctagatcattttctttcacggaggagttattttctttcacgcttcttcttgttccaatttaccgagtcacttgtctccacacatcattttcattcagataagaacgtactgtacgtacatccacgaaatgccgcgtaggcagcgtatatacatgcgctagactgatagtgtgacgattagctaggaaaagtgcgtttacaatgcgtgaattaaggctgagagatatttctaattaatccagatgggaacaataatcgacttggctttcagtggtgatgtcgcaacactgaaaaagtatatgtcggaaaaagtctgttgatcttttccccgaattttgttaaagttcgtgaaatcactgtggaattaattcaaaccatggcccctgctctcgcctccccctgtctccacttgcttataagtagaaaatctcaaaattcacatagatatgagaaaaatttccatcaaaatttccaaacatactcttacactaacaaaatatatcgattgaaaattaagacatgactcattctgcttaatttattctttacttataacaaaggggattacattgcccaacaccatagtactcatgtacaaactcccagtgagcccaatcgcataacctgacaactgatctagcaaaccacaaccgttcattgcatttagcgatgaaagagagctgaccactaacccacatacatgctatttaagtggaccaacccaccaaccacgtactccatccttgctataaaaaacaaacctagaatcagatatgacatattatagtactgtgaatctggacatatatatgtctagattcgtagtatgaaggtgtgtcacatccgatcctagattggtttttttacgagagaagggagtagtaaataacctattttggtgagtttgtacatcagcctacttgcatccctaattgcattgcagcccacacaagcatgtacacaatctctcctgcctttaggcgcacgagatgtgtgcctcctcgccgacgtggatcgccttcgtcgacgatggcacggcgcactgtgccgccgccgccgccgttgccggaaagaggacgcctgctgctgctgcttgatgacggcggccctcttgcaggcggccatgacgagcggctggtcggcgccgaggggacgacggggaggttgtcgcagttgcagatctcgatcatgaagccatcgggatcgtggaagaagatttggtccacatagatgccacctttctccacacatcgttgtatgtaagggatgcctagctccttcagccgccgctccactgccaccatgctctcacactgcaaaaccgaccagctacatgtcaagtctagttcataatccaacatggcatatgtaaatttgtatagcgacgtagcatattttatagtataaaatttggtacctctcataaaatttattttttggacctcttaaatactgtaaaatttctcgcgcaaaatttatactaaaagttttggtatttttttggacctcttaagtactgtaaaatttctcaagtttgtaaaagaagttgctttacattactgggcttgtttttaatatatatttgtagcatttcctttggtgtagaaaacttttacataaatagtgggtgatacaacggctagatatattttcatatttttgatgtctgaaaattttcaaaataaaagagatgacatagacgtagagatacctcaattacctcttaactaggaataaaaaaaaattaaaaataacttttcttaattatctgatgtgtaagtttttcctcgagttgtaaattaactatgtacttatgcatcgggacaaaaaaactttttcatgtaatatgatgtgtgtcgtcgttatcgtcgtcgtcgcctgtctgccaccttcatcttcgtgtgtgcgctatgagtcagcaacgttgtcaggtttatgataagatgacacagtcacacacacacacacaagttgctcgtgataatatctccttaactaattggcaagctagtgatcatatgcatgcatccacaacaatcagtgatgcagcatcagcttgtccattagtatataatcactatttcatgtacagatcatagatcagagacagagaccgagacagagagggagacatacagaggcagagaatactaggtcttttgcatattaatgttttggcatgtgaagctacaatgaaatgaacaacaataattcagtgtgaaataagagatacaacttggcctgccagatccatgcaatgcatctctgatctatgtaagttggctaaagattcattacaattgtaataatcaaataaccaatctgcctttatcatatacctaattaacaaaactatatatgtcagtttggtgccaggaacagaggaggctctgcttgatctctttccatggcctcccattgtagcattgagaattgtcatatttgagaggttaatttgggaccaaactatacatgtacgaaagcatgcaacacaatgaatgcctctgataagttgcgataaaaaggatttggaaagggagcttagtggaaaggcaatctgtactccagatgagaatggacgatggggattacctaactaacagctgtgctgtgtctagctaaagggcaaaatgccaagtgaggtaggacatgcaaatgtgtgcaatgtggtccttttctagagagttctaaacttcaattcggaatgaggtggtcaattttaggaatgaaattcgatctaaaaggcttggaccggtcctctatatataaaagtaaaaagatgtaaagagccagtaaaacgaactgctccctctgttttagaatataagaagttaaacagacaaccttgtccagattaatagtactataatatatcctatccaataaaaactccttatatttcagaatggggaagtaacaaatagatagaaaagaaaagaacacacgatctgattatttatccttattcacgaactaccaactgatataataacctattataaaatgcatacctaaaattaggcgtattacaaatgactcgtaactgcagtgtgcctacttatatgaattttgcatgaaacatttaggacccctacatggcaattatcaattgtcactagaattttgttaaccgtgcaccatggattggcctaccgccagccagacatctattgggcatctgtcaatatctggtagggtaaggtagtacccatagcattttatttacttcaactgctttacacggccaaacagaagaaggcggagtcatttgttcaggcacctatttcaacgataaaaaaaaatccaattttacttgctcttaccgtctcagcatgcttatctttttatcagatattttcttccgtagcacattttttttctttgttttcctccaactaatctttccaacaaaagtcaccatttttacctcccaactaatctatcctactaacggaggaaaaaagaaggaatttaggagcatggacaagcctaatagttactgggactttgctaatgctagctgaagctccaatgtcaaataggggattaatgatgcattatcattttaataagaatctaaaaatagcattgtaaatactaactctgtcccagaatatagcaccctaaaaccggatgagacgtatcctaatactacgaatctagacatgcctcatatccagacttatcagacttatagtaataggatacgtcccattcgattttaagttattatattccgtgatggtgggaggatatgtttaatgatgttaatttggaagggaaatggtagaagtagccgtggagatatgaacagacaaaagtccccggcaactttggcaggccataacattattaattagtgtcctatgttgttagccgttgatgattggtgcgacgtttcacttatacgtactattcgtccatatacatacggagtatgctctaaaatatttatgtgtatggggccgttttgctgacgttgacacggatgctaacacatgtgccaacaaaatagagacgtgtcgaacaggtaattagttagattaactttgccacgacacgaaaagaaagagatgtgtcgatccaaaatcgcacaaggcgtcgatcggcagtgcatactctgttcggccagttaaccaatgcaaatggaaatatctctttgagaaaaaaaaattcatgctgatgggatcatgaaggtgaatgggatgtgttgcaatatttgtagtgatatgatccaaatctcgtataccaaacgtacctggaaggagatgtgattatctttaggattgatctctgttttccctggcaggctgtcaggatcttcagcctgaagcagatggataccaatcccataattaaacagcctgccaataattaaacgatcgatgatattattgcgttgcatgcaccaatcagaccagaacaaaagaagagaaaaagagaaaaacataagatgtatttttgaacggttatactgttaccgacgttttatataaagaagatatcctattttaaagaagaaacgagatcaaaactgagcgaaaatcacgactacgacaaaccctccagatcgaagggaaaaacattggatgtgaattgtgtgtaccatgcgccgtcgaagtcgaaggatccggggcgacggacggggaagaagccgagcacgtcggtgtagaaggtgagcgactcctgcaacgacctgcacacgatgctgatgtggttcagcgacgccagcggcagcccgctgcccctgctgcccttcgccgccgccaccgccgccgtgttcaccatcgccgccgacgatctcccgctagctctcacgtacactctaatctctcgattgattccaagctccggcgaattgaagagatcaccgagcaaatcgagctagcaattaattaggaaaactgagctcgattgctagctagctaaattaacacggcacggatgaactgagctgttgatgattgtgatgatgagcgatgatcgagaagggatcggatatggaggaatcgggcgggtcggaggggattaaatagggctcacgagatcggtgccacttgacacgtgggatccacgtcaccatcctgctccgcaaccatggcagtctaagctgtactagctaagctagtggatggctaagctccaaattaaacagtactccactccgtattgtctacgaggatccaatacattaattaatggattaatagtgccgccaaagatgaattaatggattccatgatcacggcagagctaagagctaactcatctgtccaattgaaattagttccctctcctttagaacagagaatttttaacaaattatataggaattaaattttgttcctgtaaaaagattgatataaaagagaattctaaggtctcctttgaaatgaagaaagagccatcgatcaatggatacgatggaagttgattaattggagcatagctgcaggaaggtagctagctgcttccagacgttacgagacggatcaccggaagagaaggctgtcacggctagctagctagctcatcatccctgtacaatttgtctattgctggatcacacatattgacaacactgtcggtgtaggtttgttcctctctcgccgccgcaaggtccagattttggatttctctctaccgctttcttcgagctaaattccactttctttattttaaaatataagccacaaccatcgttaatacaaagatcaagatcacctagatgcgtgcaaataacgtggtgttgaagttgaacgatagaggatttaaaacaaagcgaattacaggaagatatgttagttaaatgcatgcaaaagacatgaagagaaaaagagataagtccattttatacccccgaactcttgcacatttgcctaaaatacacatctagctaaactttaaagccgggtattttgcatcccctagcttttagttccgtgcagttacccccctccccctccccctcccctcttaccggtttgtagtccggttttaaccaacatggtgctaatgtggcagtctactcagcactataaatataaaaagcttatgggttccttatgtcacactctcctcctccttctccttcccctttttcacaatccaacgatcctctgatttcatggagacaagattgatgagtgactcgccattgctaagctcgtggaggaggagcaaggtggccggcaatggtgaagctagctcgcgaacatcaattgcgttgaccgcacaatctcattggagacaagcccatcgctcgctgaatggaggcggtggaggtgcacctggtggaagaggagctagctcggggtggcgaggagctccgggtgacggtacattgactaggcacagatcaacccgcacctacagagacaacggcatgaggaaattgaagaagcaagtagccatgccgcacgcacgcatcaacctaccgctatatgtctagccgacccggagatacttcaccgtcgtaggaaggagctcgtggtggaggcagggtttgagctcctccccacgtgactggcttcggtgggggaaactcggtggacctcctcggatccagcaaccccttgccgagagtggagaaggcaggtcggcagggccgcctcgagctcgactcccttcatagctgcttctttcccatgtcgctggcttcgctgccttcgttggagcatgctgcccgcattgccgcctacactggagcatgccaccaccttcgccgacgcgtgccatgctgctcacccctgtactttccctacgccgcgagtgaagttggagggctcatggaggaggtggcggcgaagctttccgctgggtgtgagacggtcctcacctgtagatggatgtgtcgctccgaaggggagaggaagagtgggtgagaaagggaaaggaggaggaggaagaagaaggctggactagcactagaattagaggaggatgcagctagcaagcttgctggtggcggcatgacaccagtgaggcaatgagaggtggcgtgtggggggccaacaaagggaggggagatgggttacagattatatccatgcatgaatttaaaatgtttcacagttagtgaaaaaacagacgattgacaaatagctagcccctagaaatagatattgtttacttgtagttttaagaccgcgactaagcagtttcaggaccttacatgtcgtgtaaattgtacaccttatatgtgaagacattgttaacgccaaaatttggtaagattctttagtggattaggttaaggaaagagcacaatcaatcgatggaaacttatccagaagagaccgagtttaagaaagaatcgtgaagaccatggcatggcagtttaattctatctattaattagacaggatttggtaatttccttttatctttaggaagtgtttatttagtgtccgattaggacttgtatctttccttttatcttaaggaaatatgtgtcgtgtctgatatggattagtatctacccatgggtataaatatatacacacaccgggtctctgtaatctatctctcgatcaatacaacttcagcgcattgccaccctttttattttcgtttttctcgatgagttcttatttcgagttgggctgcatcggcttcgatcaccgacgaggggtaaggcttgttatggctgtttgcatcagcagggctagggcctcgacactctaatcttatcgatgtaaacacctatttatcacatatcttagttaatctaagtcaatgtttcaatttagttgtattagccagatcttttttagggttttgttagtattagttaaattgtttcattggtctagattagctaaatgtatccaccaccctgaaaatcagttaaaggcttgattgtctagatattatatttttttcatacttagtgctgtatcaattgggtctgacctactaagtcgtgcttagaaccataatctctagcccgctttttgattgtcaataagggtttcatcggggtttcagctgatgagttatcaggacattgcatcggctcgcaaggattacatataagttagatttagccgatgacaacaaagagttcattgattatctaatcatatggatttaatgacattggacctccagccgatgtatgttttaaccttcggatcagtgcttattccatcatacctttattagtcgattggtttctactggtttatattattgtcttattacattatcatcagtagactatctttatatcattatttactcaagtgtcaaaatctacatcgaacatatagccgattgttcaaaaccctatcgacatcggttaacatgctatattggcttatcggccgatcgactctttgatcttcaattcatctatcttatcggttgcaggatcaaactgattggcacgcccacacttcatcgatattttggacctgcactggagctaagcagatctctcaggctgttgtgttcgtcgacttaattcacaccaacacatacctggcaccatcgatcgagcgcgaacttttcgtcaacggacatgtaaatggtaaatggcaacatattgggtcaactacaggagataaggggataactaggccagaaggagaggaattgaagccgtatgcctcactcatctccatcaaaatatatatgtgggtgagccatcctgatggtcacagacataaaagccgatgttttctaaaacatcaaggaaatggagttccgaaaaaaggcttgattctttggccataaacaatggaagccacgcttaagagtggtcttaggaaaagagtgtgccatgaaggacgaggccatttctagaggtactagccttacaatgcacaacagtttcacttggactccatacatttctatgtcgctccctctattttccgttcaagtactctttgcatagcttttttattgagtgaagtgtaccggcggtcctcaaacttgtcgaggtgtgtcatctaggtccctatactctcaaattgcactttaacgtccctaaactcgattatgcgcccattagtggtccaaaccagcctcgggatgacttttagctgacatggcatcgtgacgtggatggtgctagccagctgcgggggtaatattgcaaaggagccctcctttttttttccaaatcgtcacgcacatcttccctgtgtcccctcgagttcttcgcgtcagagacgagcggcggggaggtaggcgacgcaaggcggcgattgccggcgaatactccatccttgctccttgccgctgccgaggagtgatagttatagttagagacatactcaaaaatctgggaagatacttgtattttgtcttttgtttcatagtttcctgggatggtagaagtaatctaatattttgtttagtgagatggtacatgcaactcacagtggtttaagctccagtagtgatctggaatataattgtgatgcactgcaatttatctagtaatggcactgcaatttatctagtaatgtatgtcctgtctccagtagtaatctcagaattgtgatgggatttagttagctcatttttctgggattcagtaagctattttttttgagattcatgtgaaatcaggttaaattttctcatgagaacaatatagcagcaaaggccatttcattccattcagcaaaggccatagccatatcatatcattgcacaaattatgccattacatttaatccatgtcactacatttctcaacacagattcagccgttcctaaacaaagcatatatattgatggccaaaatacatacacagcaagctacaaaacatttcagtagcagaacaatttcactaccaatttctatcaaaacattcatcttctttactagctgcttgtcctcaatttgttctgcaacctgccttcctccaactccttcaccttcaccatgcaaatctatcacctgccttttgcctctcgatctagagcaagcttgcaaataccctctcttaatcaaatattgctcataatattcctcccaataccaaaaatcacatccagtaccattccgctgcacacaattgaacaaaatgaaacctaattggcagagtaaacaaaaacatattgaatcaatgtggactgacctggtgacttgggcaggtgtaaaagatgcgtccgtagttctcggacgtctttgccttacgccgaacgatcgtcttcaactcgcattgcgggcattgaatcagagggagcgcaggcttccccatccgccaagacgacaccgatgcagtatatcccccatccatggcggcaacgaaaggacctactggggctgcgtgatttagatattgacggctagggattcggcagcagcaaggagcaaggatggagtattcgccagtgatcgccgccttgcgtcgcctgccttgccgccgctcatctctgacgcgaagaactcgaggggacacagggaagatgtgtgtgacgatttggaaaaaaaaggagggctcctttgcaatattacccccgcagcttactagcaccatccacgtcatgatgccacgtcggctaaaagtcatcccgaggctggtttggaccactaataggcgcataattgagtttagggatgttaaagtgcaatttgagagtatagggacctagatgacacacctcgacaagtttgaggaccgctggtgcactttactcttttttatttgttagctgaaacattacaaaacaaacctaagatgacaaatttaaagtaataacacctctctctctctctctctctctcttcaaattctgcat

SEQ ID NO: 9029 - DNA, 736 bp, Oryza sativa
ctctaaattcccaatccatcctaaaaactctccccaaccaaacaggcctttaaggatggaaaagatgctcaaatttggaagtttccaacttcaattttctgtcgcaagatatatagcaaatccgaaacgtacagacagatatggttgtatctagaactagaacaaacccaataaaacactttgcactcttaattgtaatattctagctacatgagtggtaactagcttttatgtatgatcattcatccacattgatgcgaaagtatgatgaccggatcataaatttaattgtactcacgtacctcattgttgttgatgatatttgggacataggtgcgtggaaggtggtcagttgtgctttcccagagaataatttgggcagtataatcataacaacaacaagaaacgctgccgtagctaaagcgtgtagccgtaccacatctgaaggctatcttcacagcatgcagccactagcagagcaagaatcacagagattattttaccggagagcttttaattctgagaattgctgcccgcctcacctggaagacatctctcatgccatcatatcgaaatgtcgtggtttaccattagctataatctccatagctagcttgctagcaaccaaatccgattcagaggaccagtgggtgcaagtgcatgatactattggtgcttcactaaactcagaggctcgagtgaggaaaatattaatgctcagttattatgatctttc

SEQ ID NO: 9030 - DNA, 267 bp, Oryza sativa
gctcttggcactgcacttctctgttatgtaacaccaaaggagcaccttggattgcctaaccgtgatgatgtttagacaggcatgatatcctacaaaattgctgctcatgctgctgatttggcaaagtgccatccgtatgcacaagcatgggacgatccactaagcaaggcaagatttgagttaaaatggtgggatcaatttggtttggatttggatcctgtgaccactaagtctttccatgatgaaacattaccatcggagggtgcc

SEQ ID NO: 9031 - DNA, 7569 bp, Oryza sativa
  unsure (1)..(7569): unsure at all n locations
nnnnnnnnnnnnnnnnnnnnnnnnnnnnnnnnnnnnnnnnnnnnnnnnnnnnnnnnnnnnnnncgctgctggcaaacaattttttattggatgatatatcagtactgataccaggcaccagattatcattgacaattcgaacctctgtctcatgattctcatatttttcgttgggttttactcttctaaaattgctaacaaattagcaaattgcagggagccgaaggatatcctggtctcagcctggcacttcttcagaattatagagcctgatctttcatttcaagaagtgttcgaggctgcctgcgatggcaagttcttgaccggcgctatctgggatcacattattggctactggaatgcttgcaaggcgaacccagagaaggtcctgtttctggtctatgaggaccttctgcgagatccggcaaacatcgtcaggaagctcgccgactttcttggccagccgttctcatcgaccgaggaagaagctggactggtgacagatattgtgaggctgtgcagcttcgagaacctgaagagcttggaggtgaataagatgggagaggcatcgttcgccttcccgaatgcgtcatacttccggaaagggaaggccggagactggaaaatccacatgacgccggaaatggtggagtgttttgacaccatcgtcaaggagaagatgcatggatctgggcttgtttttgcttgatgcatgtggtggacaagaaattactaaattattcaactcttttaatacttttttttaaaaaaacaagatctttcaataaataattttaaagggtagtccaaaatgaaaaaatagtaataaaatgtaacctaaagtgaaatttactcaaaataaactaatcatcaagctcaagaggttgctcgcattgctttggctgaatcacattattttaccaatgtgacaagattgtacaacttcttcttggagacttagatcatcttttattgttctgttctgaacagaaatagacctagagctgacatgaatgatatttttccttttaatgaggtcattagctctttgggttttttgaacttccaattaaaggtatggcttacacctgaagttacatgcaacatcaacctttgttgtatctattgaactctcccatgaattggactctttcctaccctaacacaatggtaaagccattgtcaagaatagtttttcggatcatatcccttgtgtggtgcatattgtgataaatatacctaaagcacatacctttagatttgagagttactgggtggagcatgagggcctttttgacttggtgcaaacaatttgggataatcatggcagtccccttgatcctgctaggaatattactgctaagcttaaggcattgagaaaagaccttaaaaaatagagcaaaaatctttcaaggttgcaagaattgatcaagaattgtaatgcaaccattcattttatagacagtatagaagagctcggagatcttactgtcttggggtgaaaatacatagtctttatcagaagcaaactgatgacctacttgatgtataagcaaacatattggcagaaaatatgtactattaggtgggcaaaatttggtggggagaatactaaattctttcatgctatggctactgaatcctttaggaggaattctataacatctttgatttattgcgcataaggacatattttttctttgttgatggcatagcttaagaaacctcacacacttcttacatatttttcatcaattgcggcaacaattctaggattgatatatgtcttgaaatactcaattgcatttatctcatcaataatatttgctcgacacatggaagaacacaacttgccataataagcttgagtagatttactaccttgcttgaccatgcttcaaatggcgaagtgaaattagcgcatactctcttgggataaattcttttctcatcactttctacaaatcttcctaagacttggtaaagcacttatgaggaaatcgtttccaccaagtacatgcatatttttgaaattcaatagtagcttgttgcaactactcttcacaaaagcattggtagtcatgttcaatctccatttgatttacccattcaagatacacctcgagatcagttcttttttataaaatgtgtgatcagtgtaccttctttctgccattgttagtacagcaagtagcaaagtagatgtgaaaactctcacatcctcaccctctctgaccaatcaaagcttttatgtattccctatgggttacaaaattaatatgtgagccggtaattgtgtgatgtggttaagaaagacaatatacccaaattaacgtaaatggcgatttctttatggagcctcgtgggataaacatacactaagaaatttgaaatatagttgttgtaaagatagataacaatttaaagtagaagtttattgcctagtattgatccaaaatgattggaacagacacaacaacggcacgcacaaagaaatattgagtntntgttgtacggtttattctcagaccataaaaaatgatgtgaactagccgccaacccatgcattgcatgggctattactattgattttgtggatttttttgtgctgaatatgttggtaatgagaatccatgataggtacaactccctatttattaatgctaaatttatatctatattatagcggattatgaagtagagtgaaagaagagtcgtgtaggttacaatttgttaattattaatttttaatttcgaaattaaattaacgaagagccatattgagaaaccaagatagatatatagaactccatatttcacaccagtaaccaaaacttatatggcatgtttaattatttaacaggaactcttagtttgaaattatttgattcttcacaccttttaattgatcgatctgcataaagtgggtagatggtcgattattttggaagacggttctatgtatgtattttcacacatgctattaaaatttcatatatttgtaaagttaacattagtactaattttaatgcaagttatatatgagaaattatcatttggatacgtatagtattcatattcaaatgaacttctgaaattaatagttacaaaatatgtttttatagttcaaatgaattaataaatgcaactttattcatacttcatggttcagtaatttgaaaatttagtaattctgagagttaaatttttatgagaagctaaggttacaatataataatagctctgatcatgggtgtagctcaaaagcaagataaagaaaacctaagggcatgaattaaaccaaactaatagtaagtgcttgtgaactacacacacaaccaactaatgatgccttcgcttgaaatttattagttaagattgcaaaggaaaatgcatatttaaattaagacaaaaggaagaaaagcacctaacctggtttgctcacaaaattggtaaattaatcacaactattactcctgttttgcatccttcattcacccgcctatgaccatatttttaaagaaatcttccacgatcaccatgtcattgatctatgctaatatgctttctagatggccatggctttgttgcacgggttctgcagcagaactgcatacatgatgcaagcatatgcctgtcattagaagcgtcacttaaattatagatggtggaatctggaatgattaacgaaactatacttcactgtgccggcgtgtggccaggagattcgaaccggcgatcacgaaggagatgtgttcatctcagcggccgctcgctcgggaaggcggtgtttctgcagcagaaactactactgcaagaatccgccgagtttgatgcccgcgatctaatcatcgtcaggaagatgcatcgtccatgaagtatcgattttgttgatcaacatggcaacatcttaacggccgcgtgtgcatgatcatgatgaaaagcgactggaaacaattgaaacgaccgtgtaagtacgtaggaagttagagatggtgagatacgatatggattggtcaatacacttgtatatcaaatgggcttttggaacacgtatgtaataaattcgttctaaacgaaagcccatgttaaatacgcgttataatatatggtcatgatattaccatcgggtggattaatggtcagatctttctaattaacgtgagagcttctaaaaagtgccaaattagtataggaatagattgctggtattaaagtctcaaggtggaggttggaaaaataacttgttaaaaacgtaacaaaccacagctacattcacttgcctccaatgaagggttgatatcatacactgtcgacgtttgatgtcgcaattctgatatttgcatagtatggggatcgtcggtgctaggatatacgcgagactgaggtaaaagagacggagacgaggatttttatacaggttcaggcccctgaattgtcaggtaatagccctacatcctgttggccggagccggtcgttgctcttattcaccataatcatataagtacaatatttgaggtagcctatctaactgttgtcgacatggcagtctgacgatctgactcgtagtcgacaacagggtagccttcctcctcgaatccgtgcccggcgagatcagagatagcggtttcgtctctcctgacagtatccagagacaccgtagggtactagccatgcttatccctgaagtcgatatccggcggcgtgtcttggcgtatgtaggcttctatattgatcttctgtcttgatctattgttccgtagattgtggcggtgttgattgaggtggtccccctctctcttccttaggggtcttgtatttatacccataggtgtccccttgtccaagtagaactagggaaatcaatatggatacaatccgagtagtccttgtcgtttccatgtagaactctagttgtctttccttatccggaactccctcgacgtcagtttccgtataagacatggtatgtggtggatcctgccgagatttagtcaactactattaggtatgtggtatccataaccctgacagtagcccccgacttcgatgcaaatgaacgagttcatattctcaaccgcagactttggaggaactgttatcgagcttacgtgaccgttctcggtgagtttagagataatgttagacttcctttatcagcctcgtgcggacacctaaagggttagtctgagtcaatctccgacgtcaaccaagaaagtacagagcgtacgactaagtctcccgtcttgctgtaatcgagaatttggattgaagtcaagaaatttatctcggcgggtacaccatctctccattccgtattccttgtcgagatccaccaaccgttctcgagtgatcgagaaggcacagaatttgcgacggagctttgtcgacatttgtcatactcgccttagtcgatcttggtgtacaaccattgagacatggagccttcgtcaatgtcgaatagaattttccagtgttttgtatatgagcgtcttctctcttaccgactccgaccagtcagtttgtagagtcatacactctccctagcccccagccttgtcgtcggagaatcgttctcggatgataaggctcttggacctttgacctgcctcagttgaataagcactgatcctagctcccagccgtgaagttggaaaactcaatttccgattacacggtttggttaatacgcacggcgagaactcttacacgaccagatcttacatggtcttttgtttctacaggatccgacaaggccttatcggctctgggcgtccccagccgaagttcccttaggttcctcggaggccttgtcaagacggcgtaaagggacagtaggataggtttcaacgctaggtgttatcgtggcaagggatctctgggtaaaacccttggtgatattgtgtatctgatgtcaactttgttggagtagaggaccaggtggtagtcgcaactcgaccactagaagtagaaatagtgggagaatcgctacaccgctggtcgagaaccagatgtagtctaaactcgaccactagaagtagaaatagtgggagaatcgctacaccgctggtcgagaaccagatgtagtctaaactcgaccactagaagtaaatgtacgagagatcgctacgattgactggttgagaaccagtgagtaggtgtctctcggtcatttggagtcatggtacgaggaccgcaacgctgccggtcgaagactagtcgtagctgtttctcaaccatctgaagtcatggtgcgaggaccgctgcattattgctgtagtcgtacctcgaccatctgaagttaaggtgcgagagattgctacgttttactagttcgagaactagcgagtgagtagaattatctctcgaacaccaatggaagttgcggtgcaagagattgctatgtactggttcgaggaccagcgagcgagtagaattatctctcgaacaccaatggaagttgcggtgtgagagattgctacgtactagttcgagaacgagcgagcgagtaaaattatctctcgaataccaatggaggttgcagtgcgagagattgctacgtactggttcgaggaccagcgagcgagtagaattatctctcaaacaccaatggaggttgcggtgcgagagattgctatgtattggttcgagaaccagcgagcgagtagaattatgtctcgaaaaccaatggacgtttgcggtgcgagagattgctacgtactggttcgaggaccagcgaacgtgtagagttatatctcgaacaccaatggaggttgcggtgcgagagattgctacgcactggttcgaggaccagcgaacgtgtagagttatctctcgaacactaatgaaagttgcggtgagagagattgctacgtactggttcgaggaccagcgaacgtgtagagttatctctccaacaccaatggaagtgctagagttggtttattatgtgcgtctcatatagccagcatgactcacacacccaacttgtagcatatccggatgtccgttcgcaatcatgtctggtgatcaagccgacggcgttcgcgaggaattatccgttaacaacctttcctcgagtagtccaggcatgaccggtgctatgagataggtcgttgctcttcgttggtgggttgggggcgcgacgactttgcatttgtcgagatcgttctcgataatacggtgtacttgaccacaacctactcgagtgctcagttgttcctgaaaaatatctttgtacatatatgccggatgtatctacaaaattagtagatcaatttaaaaaatcaatctcactaattacctcggatgacgtgcatgtgtcacgtcgggatgtcctcggtcggtcatcgtatgtatcggtgctctgagtgttggcctccacgtgcacagccgtgcatacagcacttgtgtgcatgtgcgtgctgtacatgcagggctcgtattcctctgagacttgtccaaatccaaccgagagatattgaggcatcagccgacgagatggcaatcggactcgatttgaagacaaggctatgccgattgatttgttgatgatgatttcgatctcg

SEQ ID NO: 9032 - DNA, 7798 bp, Oryza sativa
tcttggcgtatgtaggcttctatgttgatcttctgtcttgatctattgttccgtagattgtggcggtgttgattgaggtggtccccctctctcttcctagggggtcttgtatttatacccataggtgtctccttgtccaagtagaactagggaaatcaatatggatacaatccgagtagtccttgtcattttcatgtagaactctagttgtctttccttatccggaactccctcgaggtcagtttccgtataaaacatggtatgtggtggatcctgccgagatttagtcaactactattaggtatgtggtatccataaccctgacatacacgatctgaaggactaccacataatcacaaacataacctcagcagacacattcaaatataactataataaattaaaacaaaaccttataaaacacattcaaatataactataataaattaagtggcacgctcctacgacgctatcccaacctcaagcaaaacagaaatcacctctcccatctataaacaacattgttacttcagtaattattaagtttaacactgaaaacgaatacattttaggaaactacagaataatacctacaactttcgtgtagaaaccatatttttattctgtcatttatatggcctaaagcgcacatcaaaacaagcttcagaatctgcccaagatttcagattgtccacactaaagcaaccatatctggagttctactctcctaatcaaaatgtactttaccaatatggaaagataaggaaaacctctacaacttccttgttataagctttcgcagcaaaaatcgttttgatcctctaattggtgaaatacagagagacagaaaatctgacagcgccccgaactaacgatccaaaacacagcacctagaacccatcctctaaccctcccaaaacgatgaactaaaaccctaaaataacctacaacctctgctacaggagaggaatgcctcacctagggtgtgcttggagaacttgtgagaatatgatgggaaaaccaacccaccactcctcctgctcctctcctcttcctcgacgatccatttttccaatcagattcttgattagggctatggttctaggagatccatggagtagggttaacaggggagaaaagaatacatgagttccatgggtgccaagagaaaggtgtggcggcgtcgagtgggaaggtgggagtcgcccctccctagggtactagttaggggaggtgggctgcactggtaggacttgcccaatttgattcggcccaatttcaatcatgatatttttattttaatttcagggtgttacaaaataggactcataacataagaaacccaccaaactagggaaacaacatccccatacaactgtaaaccctaatcttttcaaacttgaactccaatctaaatttggcttctctttccatacgcatacaacaccacgtgtatgtcatatgaaaaccttcacctacacgtgcattgttttctagcctaagcatcccacgtatatccttgaccatctggacctcaacttctcccaagtctagtcccgatccatcactagctatactcccatggcctcaagcaacacctgcgcacgaacaactaaaaaactccatatccgtatacaagtccgcaccgacttgactcatatcagcacacatagtatcacatatgaataaaaacaatctagtagtcataaacatgaagcaatctagaaattccacgaaaacaacccgaaaccgattccctcctggagtctgctggtcagaccgtcatgctacccggttagaccgctcggacacctccggtctgatcggcgcccactgctcggtctgaccggctccaagtgccaacattctgttcaccatattttccgaaagacttacctttgacaaatgttcattatatagattaaatcaacatattgatttcacatgtatttatattgatttcatatgtatttatgtatatagcgtatggcaggtgtaagggtgctgacagaaagaaaaataatgggatttttaaattgattcagtccaataaccctatacattctatttgattctcacgagtagaggtcacaacgctaatctagcctataactttgtcggcgagagctctaggcccgccgagttgatgacagaaagaaatgtttccttattgattgggcatacagctgcagatttaccacaaagaatcctctcatgtttcacaaatagtactgccatgacggaattaatatcatactaaaattcacccaggtttgccatttgtttttttgactgggttgtgtttttttcaacaaaagatgaggcagaggcatgtgaagcatgttagatcacgtggtcatgtgcgagactcgagctctgtagtcagttaattaagaaccctgtcacttgtcagggtgtggatcatgaggaaataatcaatagcctattaaacttgaaaggaatcaaatggtgcgacaaccactgtgcacaggtgaagactacaccttaaagtcaaatggttggattagtctctcattagcataacagcaattgagatagctgctactgtgtgtgtgggagaggaacggagctagagatggcaggagcaatcgtgagtgcttcagttggggtgctgaatccccttctaaccaagctttcctccttgatcgagggagagtacaagctgctcaaaagtgtgaagaaggatatcatctttttgaggaatgagctcagcagcatcagtgtcttgcttgagcatctatcgaacaaggaggacaagcttgatgggccgaccatggagtggaggaacaacatgctcgagctagcttatgatattgaggattgcatcgacctcttcatccacaagttgagttgtggcgatgccaatgccaactttgttcgcaagataggaagcaagataaagaagctatggggaaaacaccagatcacagagtgtatccaagaactgaagaatcgggttatggaggaggaccaacgtcgcaagcggtatcagatcgatgatttcatctccgagccaagtatggtggaaattgatccccgtctgctggcattgtatgaggaggtggagaggctcgtagggattgatggtccaagggagaagatcgttaagtggatcatgcacaaagattggtcatcagaacaacgcaaagtggtttcgattgttggttgggtggtcttggaaagacaactctagctaatgaattgtacaagacaatacaaggggattttaagtgtataacttttgtgtctatttcacgtacccctaatataaggaaggtcttggttgatatgcttaaaggacttgggagcaatggagatgtatctgaagatgagcagaacctcatcagtcatcttcgaggattcctgaaagataaaagttacacaaatttttatgttttctaatttttgtggaacataacagcgaatagagatttcaaacatagttttttttctcttcaaatacagaaataggtctaatatattacaaataaaatcacgatctagcacaaccactagcttcggttgatgagtcgatcctcatcccatgcgcggatacattttcatttcctcccccacacgtgaatcgtgaatcttaacgcctatctgacagcacaaattaaatttggagagcttttttactgtccttgaggctatgcagtaccaaatcatgaccgttgatctggcttcatctaatggacaggattcgtcggtacctcatggtaccgctccttctgtttgacgcggtaccgtgggtgggagggtaactttgtaatttcgcgtgcgtcatctgttatcgtgtgagggggaaagcttaaccctaaatcggcgagggaaccgtacagcggtgttgaacggcaaggcggattggtcgagttgaacggcggaaggccggctatcggagtttcatcggcgacggcaagcaaggcggccttggggcgacagcgggcgaggcggccttggggcgacggcgggcgcggcggccttgatgcgacgacgggcgcggcggccttgctgtgacgacgggcacggcggccttggtgcgaggcagcctcgatgcgacggcggggcattggcaggatgccattcgccggagaactcggcgatggttgtagcggccattcgtcgtgaggtcggcgatgtttgcggcagcgattcggacttggtggggattttggactatttgccatcctcttgaatggcgtattcccaaatgccatcttcccaaatgactttgacgatttaccattcggtctactgttttgtttctaatttgccacttttcaccaccaactcagcaaattgagtagaaaatgagttgattgcccctcatatctatccacttccttctttcttcttccttccatacgcaacaccggcgtgttcagctgactggccttctcgtggcatcctgtgcattgccaattccctcattccaaggcattcaacctcgccaacatcccgctcattacctccgagtacaacatgacatgcgtgtcagaaaggttcaccgatgaatggagctgccacggccatcagaaggacaacgacgccgacgtcagcgtaggaaagctgtcccgtagacgtcctattcatgtgctaccttggggagatcatgctcaccggcttcaattactgacctgttcagttaatgcaccaccagccatcaagtttgtcgagtcgcttcatagccgacattatttctttggctcgactcgtggtggacagggatgcgcatccggttggcactaatggcagctgtgttccagaagtttctctgggtgtctatccatgtgcgcgggtgccactccactggcgagatcgatcatcggcacaggacgggtggtgtcaggctcgattttgtgtgatgtatgggctgttgaacctcttgtagggtagcagcagcatgagcgatgccaccgccgcagaagacgccgaagactgctccgccacatcactaatgcctgagagcaagaaggaagaagggaaaggagaaatgggaggggtagtgaggtcattttctactcaatttgctgagtttgaggtgaatagtggtaaaatagaaacaaatcagtggacccggatggcaaatcatcaaagttatttgggaagatggcatttgggaatacgccattcaggaggatggcaaatagtccaaaatcccgacttggtgtggcagaacatgcagagagaggatggagaccgatcgaaaaggtttgtgttattcgttgcaatttgtggtttttattcaatgtttgggcagtatattttggatgggtgatgatggattgaaattagggaaacaaaaatcttacagttggattgaaattagggaaacagaaatcatacagaatagcttgaaagacatattttgaaagaaaaatttcaatacattttgatccagatacattgttttaacacacaagatgcagtaccaacttgcctgcattgcagcaagcaatttgcctaagatttcactgtatgtgtatgagatacataagactaatctgaaaaagggaaaaatggtgtgtttgaccttttaattccaccgcttttgcatttcttcagccgtacttgtcctgagtgtaactgtcatgtatttatttttcaggccttctccataccatttagcgagcagtacataaacgaacaccttccaattgaagatttgcttgtgactgtggtcggatcaactgtttcctacccgatgagactaatgaaatcgaaagataagcaagcaaccttcacaactggatggaataagttggttggagacaaattattcgagctatgtgatgtttgtgtcttcatgttcagtgagaacgatgctgagcttactcttagccttgagctcctcaacaactgtgaaggatgaacaacatctatgtgccccctcccccctaatgtggtattaggcgaaatctagtattaagttgtttcctgccatatgtagtattatgctgtttgttctagctgcaccatatgtaatggatgctatgcactttgcctaggttatcagttaagacttatcagtccattatagtgcaccatgtgtaatgtatgctatgttaatccgatgtaaaatatctatcagtcaattctagtgcactggattgcaaaactgatgcccctgtatgtgtgtctattactatgcgccacctgtttgtgtgcattttgtgatggacctgagaattttgcaaagatgatcacaacaatggaatgttatgctcacttcagacagtcattatggactgcataacttttacatgctcaaacagatccttttacataccgaaaagcaaagttagtgatgacaggcatgttcagttgcataactaatacagaggtacttgatgatctgtgtttgcaatttaacagagctacttgcgtgcgcactgtaataattcctactcacaccacatcatcacagtaaatgaaagaacaaaatcatcaaagtcatcaaggtattactcttacaggaatcatcaaggtcatcaaggtacttgctgatatgtgtttgcaaacaaacagagctacttgcgtgcgcactgtaataatttctgctcacaccacatcatcacagtaaatgaaagaacaaaatcatcaaggtcatcaaggtactcctcttataggaatcatcaaggtcatcaaggcactcttacaggaaaaacaaggtttccaaagaggttatctaagcatctccttacaggaaccaaatcaaccaacgaggttataaaaccatctcattacaggaacagcaatactcaatattaatagcatggtcagcatctccacctttaatatgtttcttcttcagcttcacaaaaaaattgtacatgtccctggaagtaaaaccagtagcctcataaccaccatggtctctctccattatatccatcacttgatgctgatgcaaaccaacatctctcaattccaccatcttagcctgtgctgcaggagttattctacgatgtgagcgcaaaaatggcacttgatcagctttacacaacggatggttatgattcgattcaaacctaacgacataccaatttcctttttcctcatcatgttttatctcaaattgagctttgcaaccacagcgagataatgcccgtggctccctagttctgttagaactgtccatatatacctccttcctaaatcctctctctctagcatactgattgtagaattgaaaaccatgatactcactaggaaatttcatgcccataatagtagagcatactcttcctcctcaatactgctaccaactgcttccattttacacggcgcaatgaacctgcccaaaaaaaggaccaccttgattacttcaagcattgctgtcaatcataaaaactagagcttcctaatctaccacacattatcagatgcagcacaaatcaaattacctgcggctggtcctcaaaattagtactgtcagcggtatatggggctgcggatgcggcactgtgcgactggatgcggctgcaggcggcggcctgtatgcgacgggaggcgcggccggctcgatgcgacagcggacgccgccggctcgggacggcggcaggcacagcgccctcgatgagacgagggccgcggctgtctcgatgaggctggatgcggcagcgcccacggcggggcggcgggctggatgtggcggcgcccgcggtggcctcgatgccacggtggccacggcggccttgttgcggcggcagccgcgccggggtcgatgcgatggcgccgtggcgggaaaacaggctcgatgcggcggcgccgggga

SEQ ID NO: 9033 - DNA, 2736 bp, Oryza sativa
ttaagaaatgccatgctctgcgggtattggatctgtatcggtgtaggaacctggatagctagcatattaacagcctaacataccttttgcagttgaagtatctgaaggtttttggtgtaaatgttaccgagctgcccaaggatattggacggctgcagcaactagaaacactaactattcatgcaggagatgtcgacgaaataaacattccgtcaagtgtttgtagactgcaaaaactacagcgcctaaattttaattacccaatgagattgccagatgaaattggagttttgcaagctttggaggtgctatatcttaatagcattcggtacagcataaaatgtttacaagagctctctgttggctaaccagattaaggcagctgcgcatactttgtcctggaatttatgattttggaggtgatgtagcaaggttccagaggtacaaggaagccttttacttcactctcaatgagttgggtaaaaatagccttcgatcattacatgttacttgttctcctgagttttcagatacattgatggattcatgttgcagtagtgctccagatctcaaagagctttttattgatggcatggaatatctaaattttcggatcggatggtctccctttgtaatcttgcctctcttcgtctctggaatattacaagcattgatcagaaagtggtcgtcctccttgggcatacccaagcttctctatcttgaagtattcttgtcccgaggcctgggggatggactcactgtaggctgtagtggatttccatgtctaaaggagtttattttcgacaacagtcgcctgcattggttgttgtttgaacctggagctatgcccaaaactccagaggctttgttttagtttgtatgcacgggaagcagcatcaaaccttgggctcgagcaaagctatgtgcacctttccagcctccagcatctcaccttctatctttgctgtaccaatgccactataacggacgtgaaagcagtggaagctaccatcaggaacgtgatcagcatccacacccgccgtcccactctcgtattgcggagatacttgcaagatcgaatggtaaaggaagatgaagaggagcagctaaaagacagtacagatggatgtggagttgaagagcaccatattcagtagccactgatcacagttggaaatcagaagcgctggaacccaggtattggttcatcctctcgtataagaccatcaatctgctgggctttacatgtatgcttgtttgttgcattttgatcatagcaactgacctacgatcgcccttaattttgcagtgttcttcaggaattcagacaaagtgcaagctagctaaacatttattatgtggtcctgttgagttaatcctagctagcgccgcacccattctcctatgtgtttcttcgtggcacttgatgtctgtgtgtatggggatcgtgtgtgcttgtacggtaggctctaacgcttgttcatgtgggagcgcgtcggagttagtatgcgtcgtgtggacatgtgctttcagctgtgggatggcgtggctcagtcggaaagcaaatcctggagggcgcaagaagaggagagcgctcgatgtgggatggcacgatctagtaagaggctcccaaacctttattgcatatttcctatttgagttgataaatgacagggccgcccctgagggggctagcggtgcggctgcactgggaaaacaagaaatattgtacaatcctataactattaaatcctatgcaattcagtaggtcccgaaattcttatacaattaaatcctagaactctaccatatctttcaatctatctattatacactagaagtccatgaaacaccctataaacactcctaagctgtcacatggcctcctacacacactcctaaaccaccacgtgacactctaataatttataaacaccggtcctatccacctccttccccttccgcataccagcctccaaaataacaaaatcctagatgcgctctgatctccctattttcatgctacagaatcgaattcggttgtaaactttagtaaagctaccaattccatatgtgcttcttttacgaggaaatcaaagaatccttattattgctgtctttgccgagatcactgccagcgtaaaccggaatgcctttggagccttggacagagattatcatgcatcgatcaagcacttggtactcattagggtatctgcacccagtactatatctgcattaccattgacacaggtatatggcgatgcttcctcattaagatatctgaagatatctgcacatatagagcaagcttcacgatcgcattgtttttttttcaaaaaataatcaacattagtttctatgtttttaagttatttctaatctaatatcattggaccctgtaaatttgaagggttgagaatacacaaatctaaaagttcatttagaccaagccaccaaggaagatcgatatatgatcgttgcatctgcagtaccgtaggtatttcttatttccttgcaattaagaagatctatatgtggtctcatccacaaatcaaaaaatgtttaaagcaaggaattctgtagcaaggcatccgacggactttgcataattaaaaaaaagagtaaaatacaccagcggtatttaaacttgtcatgaggtttcacttaggtccacgaacttgcaaagtgcacatcaagatccctaaacttggtttattgtatcattccggtcca

SEQ ID NO: 9034 - DNA, 3235 bp, Oryza sativa
agtatgttagtacttattaatttaattttcttaattaattaaggtaattaaaaaattgagatacataagtatggatcatgggcttattaattgctaattttgaactttttaaattaatgaaatagaaaatatcagttcaagacattaataaaataaaactacagcaaccgaagacaattaggacaggacatgtattttttattttttttcaattaggagtaaaaaaatattattacttccttagacttacaaagaaaaatttatgttttactttcaacaaattttaacaaacatgtattttacatataactaatattttttaatattaataattgtagcacatgcaatgcacaggttgacgcttctaaggcatgtgatgctataaatactcccaggtcaccagtaacactctataataaattatagaaaattttaattagataatatatatttaaaaggtaatctgttcctcccaatctacggggtatacaatggaaaatttgtaaatgttcaccaaaaaagccaaaagtacacaagtaaactattgggaaaaaatatacagcttattactgttcaccaaaaaaaggaaaaaaacatattgatgataaaaagataaatcccaaaaaacttacgcatgtaagtactacaatgaaaaaatcaacgatctgaaaataggattttctataattttgagataaatatatattactccaaaacacacaattcaactagaggaccttgtccatctttttttaattcatctaattgccgtattccttcaattaaatgaattattaacgactaataataattatattgtaatgctaaatacatgacaacatatggaaccaacatataataattaatgatatgataatttttcaaataattgtataacatattttgtgatgtcaaatatcacctgacaaatatacaatactactttaaatctacttgtctaaaaaataaaacaatagaatttagttgtgtttttccaagtaaatttgatttaattttagtttgtgtgggattaagattctctacattttcaaaactatttggtatttccagctaatgatcctgctataatattaccccttaatctatcacgagtatattggtcaataggtatgttttttctataccaaatagttttggcaacaaattaactactcatgatatacttttcttagagttgaagatgttaggcataattgttgatgtatgtcatgtacctcactaatgtgattataagtgtacttgaacaaattagttattgcacatattttctaaagaaaataaatctaccttcttttcaaatgatgaagaagattataaataattgcttatagatattacttagatatgatataatataaagctaataggttaatgattataaaagcaagtaatgccaaaaaaacaatttctgaagaaatcgaggtatatattctccggttaatatttcgcttttagtgtctcaaatttagcatacgacgcatgctcgcgcattcgcgcgggctaccttcctagttattatatacttaaaagtccactgaacttcctacaaacgctcttaagccgacatgtgtcctcctacgaacgctcctatgccgccacatggcattctaataaataaaaaaattcattaaatccggtggacccattatttaaaactattagatctatctttgagaaaaatccaccgctaaaactgggccccactaagtacctgtacgtggatggatgtatatatgtaatgtacgtgttatgaaacaacagggtgatctcatccatataaaaggatggatcgcaaccgaaggcaaccgtgcctcttccctaggcgcttcttggcaacagatgcaatggttcccaaccatcgtgtctccggttgccaccccttctccatctataaattgtaccgcattgatcaataaagaaatctgctcattcattccctctacattcttgtgttcaattctctctctcgctcaatcaattctattcacaatacgttatcagcactttcgctctcgcgaaggagttcgcgaagtttaagaaggaagaacatcactttttgatctacaggaaaagcgaatagaaaaacaacggaaggtacgatgcctacctttcattggatcatggatgccgttctcggcctccctcgccatcagcgcgcacgccagcttcgctatcttcttcgtcgatcgatgaggaggacgcgttggggatcccgcggaggcagggctagggttgtggccgccgccactaccctcgccgccgtgtgactgcaactccagttgtggttcccccgcctgtccttgtcgcacctcctcctccgcctccggttgccgaagcacctcgccggatccttgtgcagggggtacagtactgtgcccaccatggatggacggcggtggtgacactgcctggcaagccgtgtgatctctcactggagatggagtcgctgccggccccgttcgtcgccgctccatcaccaccaaccgctccttcctcacctctatcaacgtcgcagccgacgccaagctttcgacgctcccccactcccgtgccaccaggatttggtcgtaccggaaccatggcggcgcgcacgggggagccgcctctctttacaccgtctccaactcgtggccacgtcggagccgccgctgcacgccgtcccggcctccgccatacattcattgccgttccccatggctccccgagccgcatggtacccaatggcatggggggggaacggtgttagggtctggccggtctccaactccgatgaggagtcgggaccgtcggcctaaagccggccggcatgccgccggccgacgagagggacgcggcggcggcggatagtggacggtggcggtgggaggtggcggtggaagcaaggcggcagcggaaatggagggggtagcggcggcgctatcactgaaggtggagacggcggtggaatcggcggcggtggcgtcggcagcgcccccgcggcggcgtcggcggcgccccccagcggtggaataggcggcgcacctcaacggcgtcaacggcgcacctcggcggcgtcggtggtgcctcacggcggcgtcgatagcggcgaactggcggcggtcagcgacgaaatgacggcggtgggcggcggcgtgtgcagcgaaaaggcggcggcggcggcggtgaaattgtgggggcagttagggttaaccctaacacccccctccccgacgcc

SEQ ID NO: 9035 - DNA, 4772 bp, Oryza sativa
ccacccaatttaccatttaatttttagtttttcatttactttcagcagtaattacattttagtccctatgttttatgtaatttagtggaaacagttcatcagttcttcacattattatgtaatggccctatagaccacttatgttatgtgttaattaacataggtgtttattcaaataccctgtttcactaaatttttttgttgtcttaataacatgccttttgcatattatttcaagacacgctctactttctcgctttattaatttacaaaattctataaattttgtattttgatttagcaaattctcttaattatgtacaacataattaatggaggatttaatgcatgttccacttcacactttgactcggaaattaatcacatgtcaatggagccctatactttggtcatatcgaccataacttaggcagcgagtatcttgcccatcatcaagtggtctacattttgagatgtttacccgatggagtcctacaaattggccgcactagtcataacctaggcagcgagcacctcgcccatctcacagaggtctacatctcacgatgattacccacatgtgttattttccgagaatatgttttgaaaaatgagattatttgaattttggttgagcacaaggtagtggagtcctattcaccagaatatatttgcctggagaccgtgttttaggtagcaagtataacttgcccactattaagagatctactccactgtttaattacttggagattatccacattgtgccacctaatttcgaattctaacttgaattgtcaagtttattaccggcatcttttcgaaacattacaaaatatgaagtcttacatttcgcattgagattacaaccttaatatcatgtttttattaatttacctctgtaaattgataatgttaaccatgattgtagggacatggcaacaaaagagttcaacgaactcgtcctcgatgggactaactattccatctgggcttccgatatcaaaatcaattttgcctctcgagggattttaagtacaattgaggaacctaatgatggggacctgccaattgagcacaggaagctcaatacagccctttttgttttgaggctctacattcacaaggatctcaaacatgaatacatgttagagacgagccctcacaccctttggaaagctctaaaagagcgttatgatcagcaaaaggaactcatttggcctgaggctaattatgagtggattcatttacgcctacaggactttaaaactgtggcagaatacaaccatgctgttcataacatttgctccaggttgaagttttgcgaacaagagccaacagaggcagagaagatagagaaaactctatcaactatgcttccagaggacaagatactgactcaacagtatcgcgctaacaatttccaaaaacattctctgcttatacatacattgactcaggcagaaagacaccatgagctttctttaaagaatgcccaacagcaccccccgggctctgctccactgcctgaagtgcacttcaatgtacagaataatgctgagaataagaaaggattcaagggaaattcttccaataatcctaagaatctgactggaaagcgcaaacgcaacaacaacaggcgcaaattcaagggtcgaaagaaaggaaaagggaaggataaggcaccacaacctcgtagcaatgttaacaagcattgcaacaggtgtggatctgacactcatgtcgctaaagactgccgcatcccgaaatatcttgttctattgtaccaaaaatcccttaaggacaaaaaaatcttctgagaacccaagatttgaagcccacttcaatcttacacatgaagagtgccctgaggttgcaagttctcactaggctcctgttgaaccggagagcaacctcaatgttctcccagaagatgtcgctccactctctgcgatggacgatatgttcatcgaatactgctcaacagacccacttagagatttactgtaatctcagtgcgtcccacttagagataaagctgctttaatctcagtgtgtttgagacattatattgatatcctatagtttgtcaaaacaatattggttgtaataagtagataagtactaacttccttatattataaggttataagacttgctagtcattagagtatgtactattaacctatgtaaacgtcatactatgtatttgatgttttcattattatatgtatgtatatattgtggataaagaattcttcactaagcaattcttctttcactatagatgtctaaggatatcactccgattggagaggaattatgtcttgtggacagtggtaccacaaactctatacttagggagatcaaatagtttcaaactctcaaaaagagagaaagcaaagttttgactatcgctgggtgcgatactgtaatagttggctcgggacaagcaactattacactcccaatgggtacacaaattacaatcgaggatgctttattgtatcctgattcaacccgtaccctactaagttatagagatatccgtcaaaatgggtttaacatagaaacccatatggataatcgagaagaattacttctcttaaccaatcaaaacggatatggcaaacgcatttgcgagaaaattccatctctcacatcgggattgtactatacatacattaagcccattgcacatgttgcgtacaaagtaatttttcaaaatgttgatgcattccacatttggcatgatcgacttgggaacctcgatatcgggatgatgagaaaaattattggcaactttattggtcatcatttgatcactgataaatttctcaaatcctctgatttcgtatgcactgcatgtgctactgggaaactgattttgagaccatcttatctcaaaattagagccgaaccacttaaattccttgaacgcattcaaggagatatctgtggccctattgtgccaagatctggaccgttcaggtactttatggttttgattgacgcatctactagatggtctcatatgtgtcttctatcgacacgaaaccatgcctttgccaaactaatgtctcaaattataaggctgaaagcaaattaccttgaacataggattcaatcaatccgtatggacaacgctgccgaatttacatctcatgctttcaatgattattgtatggcattgggaattcaggttcagcactctgttccatatgtccacacacaaaatggttttgctgaatcattgatcaaaagaattaagcttattgcccgaccattattgatgaattgcaaattaccttcgtcgtgttggggttatgcggttctgcacgctgctgaccatgtccaactacgactaactgcatatcatgaaacttccccaatgcagttagtacgtggaaatcctccaagtacttcccatttgcgtaagttcggatgtgctgtatacataccgatctcaccaccacagcgtactgctatgggcccacacaggaaagtggggatctatgtgggattcaaatctccgtcgatcataaagtatttagaacccttaacaggtgatctatttactgcccggttcgttgactctatctttgatgaggaacatttcccggcattagggggagacttcaagtaccagaaagaatgtcaggaaattgattgggatgcccagggtattctagccccagacccacgtactactgaaattgaacttcaagttcagaaaattatacatttgcaaaggcatgcaaataacctgccaaatgcatttaccaattataaaggtgtgactaaatctttcattcccgctcaaataaaaccactcaacttccactcactaaaaagagaggaagaagtatggccactcagcgagaaacaattgctaataagcaaagaaagacggtaaatgcaaaccaacctttagttggtacacaccaaattgatactgtatatcaagcagatcgtgatagtctgcaacctagctcggtggttgttgacgggtcgtatcgatcaattttcaaccgtcaaatttaccaaaatagaggagaactagtgatgcttgcaatgcgtatgtttgttagaataataatattctactagtattaggtctactaaccttttgctgagaatgacaataaagtggaggaaaatcgacatcaacacaaacgataaatcaatcggacgatgtcgagaaccagacttatgtatgaatgggccaagaactcagaattgacacgatgaattgggccaaaattcacaagtctgtggagtgaagcaatagaggaagtcgccagccgaagatgggctggtttgggctagcccatggttcggccgaacccccatctccaccgttgaggccagggtttggcatggacgtccaagattacaccccaatgacggttggagggtacttcggacaattccccttccacaaccgtcatacctacctctatataaggagctcactctcttcactttaacacacacctcaagcaagagctctctcattcctctcaagtttagtttagtagtatctagctagtggaatagaattagaataggaatcaggagtccggaagccttcggaagagtttgggtatggctctagtagcttttctttcctcttttgtaagctttatacttttattagaatacttttctaaatacatttctggtattgaaatactttccgagtatatgagtaccaactttacattatgttcatgttatactgaatatactgctagcttatctgggagatg

SEQ ID NO: 9036 - DNA, 7492 bp, Oryza sativa
agtgccaaaagcgctctgactggaacaaatggaaggacgcaattgacgcagaattagcctcgctttacaaaagagatgtattctcggctgtaatgcctactcctcgtggtatcttttctgtgggatacaaatgggttttcgtctagaaacagaatgaaaacaatgaggtgatgagatatagagcaaggcttgtagcacaaggttttacgcaaaaacctggcgttgatttcaacgaaacttactctccagttatgagtggtataactttccgatatttaatatcattggcagtacaaaatcgtctatttatgcatttgatggacatagtgacagcatatttttatgggtcacttgattctgatatttacataaaggttcctgacggaatcaacatcccgaatcagaaggtaaatcgtaacatgtattgtgttaagttgcagaagtcactttatggcttaaaacaatcgtgcaggatgtggtacaaccgattaagtgaattcctttcactaaaggaatacactaaaaatgatgattgcccgtgcgtctttatcaaaaagtcccccacaggattttgtattatctcggtatatgtcaatgatctcaacatcattggcaatacacaagatattaatgaagcacgtcattatttaaagacggaatttgagatgaaggatttgggtcaaaccaaattatgcttaggtctacaacttgagcatttaccttctggaatccttgtgcaccaaagtgcatatacccagaaaattttggagaaatttaatatggacaagtcatatccttctaaaacccctatggtggttcgatctctaaacgtggagaaagatccatttagaccaaaggaagatggtgaggatgtgcttggacctgattttccatatcttagtgctattggcgcacttatgtaccttgcaaatagtacgaggccagatattgctttctcagtaaatctattagcaagatacagcgctgctcctaccaaatgccattggaccggagttaagaatgtctttcgatatcttaatggcacaagagatcttggacttttctttagaaagaaccaggattcgactttaattgggtatactgatgctggctatctatttgatccccacaacgccaaatcacaaacaggattcgtatttttacaaggtggaactgctatttcatggaagtcttctaaacatactttggtagccacttccacaaatcattctgaaataattgcattatatgaggcatcacgtgaatgtgtatgccttcgcagaatggttaaccacatattaacatcttgtggtattggttcattggaataacctagcattatctatgaagataatgccgcttgtgttgttcagatggaaactggttatattaagagcaacatcactaagcatatttctcccaaattattttatcctcatgagcttcagcaacatggagagataaacatcttccaaactaagtcatgtgataatcttgctgatttgttcacaaaatatctgccatactccacattctttaaatgtgtcgaaggaattggtatgagacgacttaaaaatttgcaagattcagggggagtactttcctctggaaaataacctattttcgtcatattatactcttttccctttgtatgagttttaccctttaggttttctcatccaaagtttttaacgaggtaatatcaacataagattatatgtcttatcatttggcttttccccactagagtttttactaaatgataaccgtagacattatactattttggatcatactatgagctttactcatagagatctaaaaatagtcaataatatatcacggttctctccttatttttcccactgggttttcgaggagttttacgtgatgtatttaactataattatttctatgattatctttacggggagtgttatgaaacaacagggtgatctcatccatataaaaggatggatcacaaccgaaggcaaccgcgcctcttccctaggcgctccttggcaacggacgcgatggttcccaaccatcgcgtctccggttgccaccccttccccatctataaattgtaccgcattgatcaataaagaaatccgctcattcattccctctacattcttgtgttcaattctctctctcgctaaatcaattctattcacaatagtacgtactcccctctccctcaatcctttcattatctttttctcctattttcaagctattttaagttagaaaatttgtgttacaaaattaaacaactgtaacatctaaaccatacatgtaactttttaaatttagtgttaaatatccatattcacttcgaaaagaaatatgccattttttgttatattttctgacttttgcatagtatttaaactgttataaagattataaacaattaatgatatagatttatcatctttcatataacttcacaataattaaattaaattaactctacaatgataaaagtaaaatggatctattatttacaaccatcagatctgtcttaaaggaaaaaaattaacctcccaaactcaactccacccaggctctatacgtggacgtacacaggtatgttacaaacattattgagaagtttgaaaaagaacagtatataggtatatcactatatatccattattggttcataaatatgcaccattaaattaaatctacaatgtccaaaagtagcaagtcatattggtgctttgcatggcaatcgagaattatgaaaaatcatgaaaaattagtgatatggattatatcatcatatgaacaagctcaaaatgtggggtccattttattcagcagttaggacagtatgggaataacctaaagtattcggagtatagggcttgtaattttttctctttaattcctattaaaaacaaatggtacatgggtgtttcatactcagtttggtaaattagggaacataaatcatacgaagcttatatatcagaatcaatgcaatgaaaatatacgatgtaaaaaaaagaattaaccaaacaaaattatactttagtccgcggtgactgaccaattacaaatgctccacacatacttatttcagataaattgtttttttcaaaaagaagatgggatgtgaaagaaagaagggcgtagaagtaaatgtaagtaaatatatcctaaaatctacaaataatctgtactataaaagaaattttgtaaccgaaagttctataaaataagatatgctaaatattcaaaaaagatacacacatagtacaaatgatagtctaatagtaatcaactctattattgcgacacaatattttctcataaatttaagattgcacggttcaagtaatattagtttagaattcatatgttgcaagggtagttcaaagagtatcataaccaatatactgatgtaatgttcaaagcaaccccaaactaattattgacaaaaacaaatttataagagagtcataaaacataaaagaaaaattaacccacacataaaacatccaaaataaaaattcaagcaacatcaaataagatgcctgcgtatatgcgcgggctacctttctagtttatattacaactagcatggtggcccgcacagattgcgcggcaagcatcattatattttctctcatataatagcatatatgttttctcattatattattcaatttttttagaatgacatcaaatttttaaattttgcaataactttacgaaactacaaatgtgtaatattcatattgtattttatatacgtgttagttattaattatttttaatatcaaattttagttatttgtaaattatatatattcctatatggactctagactcgtcttttcatattttttttaattccgaattttctgtaaattgtatttctatatagactctaggctcttcttccaatattatttatttttatttctgaatttttattatttctaattgtatttctatgtagactctaaattcatctctcaatattctttaatttttaatttcgaatttcagttacttctaaattgtattcctatattgactttaaactcttcttcccatgtttttcttaattttgaattttagttatttgtaaattgtatttttatacggacttaaaactctacttttaattttgttatgtttattctgaattttagttagttttaaattcctatatagactctataatctacttctaatattccttatttttaattccgaatttctattttttttcttaattgtatttctatatggactctatactctacttctaatattccttatttttaattccgaattttagttatttcctaattgtatttctatatggactctagtgtcctcttctaatattccttattttttaattccgaatttcaactatttctaaattgtatttctatacagactctagtctcctcttctaatattcattattttttaattccaaatttcaactatttctaaattgtatttctatatagactctgccttttctttttcttcgattaatatgagaatttatagaccatgagagcgaacgtggaggctccttttttttattcctttaataatataatagatagattgcataaaaacagtgtacactcaatatattccaattgcaatacatataaggcaacaacaccagcgctagtgttggggtctattgcaatgctgcctgcagctgctgctgcaaccgtttggctaggccgatagcgccggcgcacttctgccatgccgcaacaaaggcacaatcatcgagccgcacgcccgcgcctgcacacggtgcaagctcgttccctggaccgcggcaccaacggtgtgtccaggcttagtggaccgagtgagaatacgaacgaatgatgccaaagacgcgacgtgacgagtgtggactgcagaagatgaatcaatcaaaaattttgtcatgcttgaaaggctagaatagctgatcaatggactaagccaatggtgtgtactagataatatgtggcctaagcctagaccagaaagtatgagaggggtccgaggtgtgaggcgacgtgagccgtagctaggcaggttgccccatgccacccaataggtgtgtctacctctaacttgagaagaatttgccagcctgagactagcctggcttattctaagctttgtttggttcctagcctgggactctttcactcccgcctggattgacatatggggagacgtgattagcctgagtccggccatcgattttggtgctcgaggcatgcaaaattttatggcatggtgcactaggcacaaaacaaacaggccctagatccttatattataatcgtattgtgatctatgtatattacattttgtactaaggctgtgtttagatttagaggtgaaaagttttggcatgtcacatcggatatacgggcacacatttaaagtattaatatagactaataacaaaataaattacagattccgtatgtaaaccgcgagacgaatttattaagcctaattaatccgtcattagcaaatttttactgtagcaccacattgtcaaatcatggagcaattaggcttaaaagattcgtctcgcaatttacacacaatctgtgtaattagttattttttttgtttatatttaatactccatgcatgtccgaacattcaatgtgacagggtgaaaaattttgtctggagatctaaataggccaatagcattttcaagcaatgtaaatgcaactatcgcctagcacgggcacattactagttttagtagggtatattagataggaacgagaagtatttatacgtggtaagtcagaataacgcaattttcggaatcgagggagtttgctgatttactaattattaatcgtgctctttcaattaaagctgaaacaaaactagggttgctttaggaatgtggggttaggaacccaccttcaacggaaaacggtgctgctcattagcatgattaattaagtattactctaaagatttaatggattaatataaatttataaagtaacttttgtatagaaacattttaaaaaagatttcttgtttaataatttgaatagtctgtatacagagtaagaaaagtaacgaacaatatatatgaatccaatgaatccaaccaagtctgggtgcatcgcccatgtgagtaaaaaggccatgttcatggtcatgtactcgtgtggtttccgatgtcaatttccatagcgttagcatgtgacgtcaaatcgcaggtcccaccaacggcaccgaaaggccttcttttccctcggttttattcccccggtcggtcctggcgtatccttcctcgatgctccaacaaccaccgcacaatggaaaagctattaatgggctccttcctcactgccggtgtgatggtgagaatcaagtgagttaggctgatctcgccaccgattcccctccgattaacccacctagaagtcgcttagaggcgaggcgaggcgactaggctggctctgcctccttctgctggcggcagctcccagcaggttgccacctccaccgtgcgtcgctcctttcccggcgtctcctcccgtggcgcggagcacgaatcaagcagttggtgggtgcatctacatcatatacacttttggagaattgtcttggctagccgtttgtgttatgtacttcatgcttgttattgtttctggacgttgcatggttggttgatgaaacagcagagagtggaacagagatggcaggagcatttgttagtgcttcagtaggggtgctgaatcctcttctaaccaagctttccgccttggtcgagggagagtacaagctgctcaaaagtgtgaagaaggatatcatctttttgaggaatgagctcagcagcatcagtgtcttgcttgagcatctgtcgaccaaggaggacaagcttgatgggccgaccaaggagtggaggaacaacatgctcgagctagcttatgatattgaggattgcatcgacctcttcatccacaagttgagttgtggcgatgcgaatgccaactttgttcagaagataggaagcaagataaagaagttatggggcaaacaccagatcacagagtgtatccaagaactgaagaatcgggttatggaggaggatcaacgtcgcaagaggaatcagatcgatgatttcatctccgagccaagtgtggtggaaattgatccccgtctaccggcattgtatgaggaggtggagaggctcgtggggattgatggtccaagggagaagatcattaagtggatcatgaccaaaggcaagccattagagcaacgtaaagtggtttctattgttggtttgggtggtcttggaaagacaactctagctaatgaagtgtacaagacaatacaaggggattttaagtgtataacttttgtgtctatttcacgtacccctaatataaggaagatcttggttgatatgcttaaaggactcgggagcaatggagatgtatcggaagatgagcag

SEQ ID NO: 9037 - DNA, 4093 bp, Oryza sativa
accactagcttcggttgatgagtcgagcctcatcccatgcgcggatacattctcttttcctcccccacacgtgaatcgtgaatcttaacgcctatctgacagcacaaattaaatttggaagtttccaacttcaattttctgtcgcaagatatatagcaaatccgaaatgtacagacatatatcgttgtatctagaactagaacaaacccaataaaacactttgcactcttaattgtaatattctagccacaaaaacatctgtacttcgatcaataccagtcttttagctatggctacatgagtggtaactagcttttatgtatgttcattcatccacattggtgcgaaagtatgatgactggatcataaatttaattgtacgcaggtacctcattgtttttgatgacatttgggacataggtgcgtggaaggtggtcaattgtgctttcccagagaataatttgggcagtataatcataacaacaacaagaaacactgccgtagctgaagcatgcagccgtaccacatctgaaggctatcttcacagcatgcagccactagaagagcaagattcacagagattattttaccggagagcttttaattctgagagttgctgcccgcctcacctggaagacatctctcatgccatcatatcgaaatgtcgtagtttaccattagctataatctccatagctagcttgctatcaatcaaacctgatacagaggaccagtggatgcaagtgcacaattctattggtgttacactaaactcagacgtcgaagtgagaaaaattttgatgctcagttattatgatcttccttatcccctgaaaaattgtctgttgtatctcagcatgtatccagaggattatgtaattgatagacaagaacttatatggagatggatagctgaaggattcatcattgaagcgaagggaaaaacacgggagcaagtaggagagaactacttcaatgagcttataaatagaagcttgatccaaccagtttatatccaatatgatggtagggccagttgctgccgagtccacgatattgtgcttgatcttatcattagcctatcaactggacagaatttcgtcacaatagtgcatgaacaacagcattggagttctttcaagaagattcggaggacctggttcccatccaatggcacagataatagaatagtcaaggagattacgaacaactgctcacatgttcgttcgctgttctttgacagtcctaaaccggagcaaataccacaatttaagaaatgccatgctctgcgggtattggttctggatgggtgcatgagcctggagagccagcatattaacagcctaacataccttttccagttgaagtatctgaagctcaatgttgcaaatgttaccgagatgcccaaggatattggacggctgcagcaactagaaacactaattattcgtggaggaggacatgtcaacgaaataaacattccgtcaagtgtttgtagactgcaaaaactagagcgcctaattgttgattacccaatgagattgccagatgaaattggatttttgcaagctttggagatgctatctcttttttacaacatagagtacagcataaaatgtttacaagagctccgtcggctgaccagactaaggtatctgcgcataaggacgccttttggaggtgatgtagcaaggttcgagaggtacaaggacgccttttacatgactctcgatgagttaggtaaaaatagccttcaatcattacatgtacatgttacaaccaagttttcagatacattgatggattcatgttgtagtagtgctcccggtctcagagagctttctacttctggcgttggaatatcaaaactttcggagcagatgatttccctttctaatcttgcctatcttgtgatcttctataatactagaagcaatgatcagaaagatatcaacctccttgggtgtatacccaagcttctctatcttaaagtaatattcgcccaaggctgggaggatggactcactgtaggctgtggtggatttccctgtctaaaggagttgatgttcaggcatagtcgcctgcattggttgttgtttgaacctggcgctatgccaaaactccaaaggctttctattgagttgtttgcacaaaaagcagcatccaaacttgggtttgagcagagctttgtgcacctttccagcctccagcatctaatcgtcgttctcgattgttctgatgcccactacaagggacgtgaaagctttggaagatgccattaggaacgtggccagcatccagactcgctgtcttactctcgaaattctaaggcgctatgaagatgaaatggtaaaggaagatgaagaggagcagctaaaaggcagtacagagggaggtggaactgaagagcatcatattcagcagccactgatcatagtcggaaaccagaagcgctggaagccaggtattgattcatcctctcgtatataggactgtcaatctgcagagctttacttgtatgcttgtttattgcattctgatagtacctgacctatgattgcccttcattttgcagtgctattcgggaattcagacaaagtgcaagctagctaaacatttaatatatggtcctgttgagttagcgccgtacccatttctgctctgcgtttcttcatggtacatgatgtctgtgtctggggatcgtgtgcgtttgtaccatgggctcttacgcatgcttgttcatgtgcgagcgcgtcggagttagtaggcgtcatgtggacatgtgctttctgccttgggattgcgcggctcagtcgggaagcgcatgatggagtcgtagggcgcatggcgaggagagcgctcgatcgtgggatggcacgatcgccgagctatttaagttaataaatgcatcagaaaatgctacaagcttacgcggtgcaaaatgctctcttttgattttgtatttcgtcgaacaccttggggttcaaaggctgatcgccaacaggttcgaacaagatcctactgatcttttcacacaacttttcacttcatgtcgaaacaagattttgacaatactaaaaggagtagcatacaagctcgaaaagtggatgggttaggagaaactgagctaagcacccagctttatcaaagcacataaactgcttaccacctccctaacataggatggtgagtgctgctgataaacgctccagtcagtaaatctttatcacccggagtagatggacgccaagatgatctgcacagagattgtattctgagttccgagaacatgttatagtgatataaaagttagtgcctttgcagtaatgcacaataagtccaagccactaaaggtttattaaggtccctgaaattacaagtagaagttgataaagacagagcagctatccactgctattacagttagtgtcaaatttcaaatgtacaagcaaacccatttcaaaggattgctgtgagagtaattttcccttaagaaatatcactgaagagaatgtgtggagtcaaaattacaacagttctcatagatttatgaaacaattctgacataaaaggattagcagaatgtttaccaaatggtagatagtactcgagtagtatttatttatagtccagataattcagaaatatttgtaacaagttgcactaatgctaaataactagtactagcatgtatgaagttattgggccaacaacaagctgacgctgtttcaagacggtaagcacacactaatggcttatttatgtaaaactgattgaaatatggcactagaccattttactcccagatgactaattacttcataccgagtaaacaaccctacacattcagaacaaaagagtccaaacatctcccacaagttgaactatacatcataagaaaaagaccaaccttatttgcgagctgtatagctttctggaacatagatctcccctccagcttcaccgtgttgctccccactgatcgttttccttgcagccaaaaactcagcactcatagcattcattcctggtattaccgcttcctccactatcctgtaaccatgttcatcagcatattttctaatatcctctg

SEQ ID NO: 9038 - DNA, 3198 bp, Oryza sativa
ggcaccctccgatggtaatgtttcatcatggaaagacatagtggtcacaggatccagatacagagcaaattgatccaaccatctaaactcaaatcttgccttgcttagtgtatcgtcccatgcttgtgcatacggatggcactttgccaaatcagcagcatgagcagcaattttgtaggatatcatgcctgtctaaacatcatcacggttaggcaatccaaggtgctcctttggtgttacataacagagaagtgcagtgccaagagccccaatgttggcagcaccaatggccccaatgttggcagcatcaaacattctcccgtgcataaatcggcttcaatataaacgaaagttgtatctaagggatcattatttacaacaccggttaagcttacacttggttttcaataattcaatgtgttttttcctttagaccatgtaataattaattgtaagattatgtaaaacattccctctgtttcaaacttattgtcattttagatttgttctaagtgagacatgactaactttgaccatcaaagttaacatagatgcagttgcttaaaaaaccaagagcagacctcacctgcgcgtccagcatctttttctccgtccacatcctgtatctcttgccgcgtgtagaagacaaagtctggcaagaaacaaggcccggagctcgtccatcttttttttttgctagtttcacctgcgtcgtggccttccactgttgcaaaagtgacaaatccttgtgaggaagctacatgacatcgctcaatgaaatgtttttgaaaacccaataatttcacacagaaccagatagcccaaactccactgcaaacaaaattatgtgtggaaaatatcatgcaatgattattttacgaccacgttggtactgaccaaaactgccaaatgcatcaatgatcatagcacaaagataaggcaaaaatttgtatttattataatccaggataagtttacttcatcactatagtatcatcattgcaagggattctagattaaaccatataaaggcgcatcttattatgcatcatcaaaatcgacaatgaaatcatcagctattaatggaatggaacagctgaaccatgactgtaacttacaatattaaggaatcgggacaaagaaccaaagacttgaaggaaaacttcgctccgtagatatgaaaaattatgttgtctccctgaaaggaaaaatagcatgctcctatcctgatgtcagtttttcattagtaccataccattaccagctgaatgctagttgtaacctacggcattgtgactatccagttgtgtcctggactcttggtgattataaacctttgtagggttgtgaggtccagtggcagcagaaaccatccggaaacctcaaaccgtgtatactgtatttggtatttcattctcaagatcattctctgtgaaggctaagtggaggattttcaaaccacccacaccctaacttacaagattaatttcaatggggactaaattgaatgtatctgcaacagcaagcctggagccctggattatatctcgaacaaccttttgatgtttgacccattgtgtgaagtgtcagaagtgatatgcatggttcaagaatatgttccagtatccatacaaatcgatatgctggatcagagacatgttatatcatcctttttgacctcatctccacgagctcatgccaaatttatcctttaaatgatccagcatgccactatttaccagtaatccctgcaggaacactgcccatcttcaaatcgatggaatctcgccctgtcccgaatgacaataacacgaccataagctttagagatgagctttgccaccacatgacagtccccacatattcggagatttttgatcacccgaagagtctccccaggtggtgttgcaatcaacccaaatgcaatggccagcttctcactatgataacacaatgcatactgtttttcctcctccccaatgtcatgcagtacattgcttgtctctggctcatatcctagctcactaattcttgatacaatgtcctccagtgctctgtatatctcttgccacctcgggtgctctttgtcaccattaataaacttatgcattactccatctatttctgtgtagctgaagccaggaacttttcgcacatcgttgcttcgcatggtatcacgtactcgaccaacatccatccaccgagccttggatgcataaacattcgataggagcacatagtcaccatcgacattagaaccaagctcagcaagtttattggcagccaactccgcaagctcaacaaccccatgcatcttggctgcacccaacaatgtctgccaaaggacaatatcagctggaaatggcatagaaatgacggtgtcatatgcctcagtgagacggcctgcacggccaagaaggtccacaattgttccatagtgcttcatatttggagcaactcgcatcgagttgaataccctgagcccatcatccacaaggccagaatggttgcacccgcacaacacagcaaggtaagtcactccatctggctcaatgcgtgtgggcatttcatcaaacaatctcagtgcatcacccccatgcccatgcatggaatgtgcctgaattgcagcattgtaggacacaagcgtctggtcttccggcttgatggaatggaacacatccagggcccttgacagcgagccacacttggagtacatgtcaattagtgaattgcagacccgaacattgcgatccagtccaaatcttttagcaaactcgtgcacatacatcccatcttttaacaagccaatctgcgcacacgcggaaagcgccgcaacaatagtcacctcattgggttcctccctcgacggcaactcctggaagctgttagccagcctgtggaacagcgcgagagcaaggttaggctccgtgccttgcgctagccccgccagcagcgagttccatgtggccacgtcccgcacggtcatttcatcaaacaccttccgcgcggacgcgagatctccacacttggcgtacgagtcaagcagcgtggttagcagccggacgtcggcggcgacgccgaggcggaggacgagcgcgtggagctgcaccgtggtgtgcgcgtcggagcagcgggcggacgccttgagcgcgaaggagagcgagagcgcgtcggggcgagggagcagggcggggagga

SEQ ID NO: 9039 - DNA, 9527 bp, Oryza sativa
gggggatacccctaatcggcgcggcgaccagagccactcccacctagtatagtcctagtactactagtactatttgtctagtagtactactgctgctgccctacacagtggcgcgctttagtactacggtactactggtacagtactactttactctactactactaatattatacaaacttgtatacaatatgtacaaactttgtatgtgacatgtacaaactttatattacgatatgtacaaactttgtatacgtacgtattaaaaaatcgaaaaaacaaaaaaaatcacgtatataaagtttgtatacgtatgaatataaaatttgtatacacgtatataaagtttgtatacatgaatacaaagtttgtatacgtacgtatacagagtttatatatatattaaaaacccaaataaccggaagaaccggggaaaaccgaagaaaaaccaaaaactagaggaaaaccgaagaaaaaccaaaaaaaaccggacacgcgtaagttctccgtcgccctcctgccgcccggcccggcccgcccccctctgtgtgcgccatgtggccgtgccgcgcgggggagcgggcgcgcggctagtcgccaattaggcgtttcgcggcgggggtggcattggggaatcaggatcctgactttggtaagtaaaggcagagatgcacagtaacgtgactttgaaagattcgtagccatctagattgcaaaggacagtccagattaaaaccgagaatgctaattgacgcgcgccgctgccaaaagcccaaaaaaaacccatactctatttatttcctgttttttttcttttttttttgagcagccacgttttttttcttttttcatctcaacttttaaaaactttcaactcagatttgaaatctttcaaactcagatttaaaaactttcaactcaaaattttaaaactttcaactcgaaatttgaaatgtttgaagttaaattttgaaaactttcaacttttcatctcaatttttaaaaactttcaattgaaatttgaaactttcaattcagatttgaaaactttcaactcagatttgaaatctttcaacttagatttgaaatctttcaaactcagatttaaaaaatttcaactcaaaacttgaaaactttcaactcgaaatttgaaatttttgaagtcaaattttgaaaacattcaacttttcatctcaatttttaaaaactttcaactgaaatttgaaactttcaattcagatttaaaatctttcaactcagatttaaaaaatttcaactcaaaacttgaaaactatcaactcgaaattataaatttttgaagttaaattttgaaaactttcaacttttcatctcaatttttaaaaactttcaactgaaatttgaaactttcaattcagatttggaaactttcaattcaaattttaaaaacttttaaatcaaaataaaaaaaacttctaactcggatttgaaaactttcagatcgatattttgaaaaactttaaaatcgtattttgaaaattttcaaaatcaattgttttcattttttttattgggaaattactgtagcattttcactaaacaccatgattaacgctaattgtcaggattagtgacgtagtcacgcacgtcgttatctgttgaggaggcggaggcccgcgtgcgcgcgagttagcatcctcgcgcgtgcacgctagccatgcccgattaaaacagcacagtaccaataaacagtaaaccgtacttgtgctacagtattttctcctgttcagtactttgcgggggagagggataagttcttccttaactcgtcgaatccgattttcgctgatacgtaatatgcgactagttggttattaatttttgttgaaagttatatgttttgctaatatgtaatatgcgactagttggttattaatttttgttgaaagttatatgttttgctaatatgtaatatgcgactagttggttattaatttttgttgaaagttatatgttttcaggatggagactcaacgttgtatcttttatttccgagattttgatttaaaaactgactaattatactccctctatcacataatataatataagatacaaccaaactcaacacggtcttcaaaactattatttgatttataatttctcatattgagtatgagtaatagagttcctctactcctacaaacacttgtaagatgccatgtgatgctctaataaataggagaaaatttaagaaaaaatatatgggaaaaacaaaacatctagccatcgatttgcacttaaaccgttgaatccattattttcaatcatcaaactagatttatttaggtaagccctcgctcctaaaaactaggtaatctctccctatgcacgtacatacacaagagatgtaaaaacaaaaaagaagagtgcatatatggtccatcccatcaggtagttttttttttgttttttttctttgtagccctaaggtttctctcaaattatgtatatatgtagcgaccactttttgtgagtttaacgaagaagccacgctgacatggtgctgcttcatgccaccctcaccaattttcttgaatgtactttttgaaatagcaatgtaaaaggtaatcataggcagtcatataaatgtgtgcacaccaccctatgaatgcacatacacacaccctacctcctatgagagaaaaatatttgtccaaaaaattatgaaaagtatgtacatctgagagactaccattcaccaaaaaaaaaacttacatacatacattcagtaaaaaatgtcgtatggaaccatattttatcttttttacttatgtcgttctcatataaattgtgttaattaattgtgttaacaattagtacaaataattttgataatatagagtatttctttgtatattaccatgaacatgttaaggtgaattagatgtataataaaagaaaaataatcaaaacacatattctattttcaaaggatgatgataggtaagtttacatataaccgaaacaaagtgatttttatttgaatatgatagacattatcatttagtgtatcaaaatccatagtctatttcatggtataaatatttccttcttttacggtaaggttatgaggtaatctatggtcctttatgatgatatatgactttttagtagatttttttaaaaaataaattacccgcgcatatgcgcaggttccttcctagtttcctcctaaaagaaacaacggtagtgcaaatgcagcccaccaacccgcgtaaaccaaaacccgatgctcaagtccgtgttcccaatgctgccccaatatggcaaaattctaaaagtagcaatattatgagatggagaaaataataaatatgaatatgatgagtcattttagagttatattgtatcaactaatgttagtgtttacacccaacaccgctggagaaaggcttcgtagtcccggtttgtaactccctatagtcccgggttgcaaactggtattacgaatctgggactaaagatcgctatctttaatcccggttagtaacaccaatcgggactaaaaatggcagtgtcacgtgactggtactgccatctttagtcctggctgggaccaacaaccgggactaaaggtccttttcttcctttttttttaatttgcttgcaagttatcagataatcacaattcattcacagcacaagcaaattatattatcagatcatcgtaaatttattcacagaaacattcacatatcaaaaacatccaaaactctagaacaaatcataaaaaaaaaatcaagaaacattctagaacaaatgaacatcgccgatgtcgcccggccgttggtcgccctcccatctcgccgccggctcatctcccatcccgctgcttcccttctagccggatctagcagaggggagggcgaggccactgtcccgcgcctgtccgccgccagccttccatctcgccgcgtcccttccggttagatttggcggaggggagggccactgccgcagccaccgtcggaccactaccgccgctgcttccaccatcgggccgcgaccaccgccgctttcgccacccagccacggtcgccgccgcttccgtcgagggaactagagagaatgagagagagatagagagagcgagaaagaatgagagaaagatagagagagccagagagatagagagagcagaggccacgtggaagatagacgaggaaatcgagagagaggcgtgggagataaaataaggaggtggaagagagatatttagtcctggttggtgataccaaccaggacaaaaagtcgttgggggcctgacacgacctaacaactattgaacccggagtgaaattatctttagtcccggtaaaattggttgggctttttaaccaggacaaaacaaagatgtttagtcccgattcctatttgaaccgggactaatgtgctttttggccaaccgacgaaagaccatttttccagtagtgcaaattcaacacctagattcgaattaggaaaatatttccaaaatttggagagtaccggtttccttcacgaagccagtctaaccgccatgtgtgggcttgtttgaccggcgatttgtggctggtcagaccgacagagtccaatcccaagtttgtttttatcggatctcgggatttcttatttgggaggatatgtttcgggtttctattagtttctactcgagttggacgtgaaggaggacctggcagcaagacccgttcaattgaaaagaatctacacacaatccaacctagccaattgaattgcttttttaatattgcatctagttttcacctagtcctagcctaattcgtctatctttatcaatttgcgatgtaaatcgtctgctttcgctacgagagtgtgaaatccctttgtaagtttatcccgtaaaccttatgttcgtccacgagacgggtgtttatcgcttgtttcttctaaatcgggcctgctagcccggttaatctaccaaaacccgtcttgatttagtttttgctagattgaggtggttggcgactccataccactgtaagatgtttaggtgtcccaattattgtcttcatgccaaaaaaaatgctaacaattagtattgctcgagttttggcataacctccctatcaaaatatagcagcctaataccgtatggagcacattttataccacgaatatggacattacgttgtatcctgttctaattagttgctatatattgagatagagggagtggttgggatggtgaagttgctatagagatagttttggtttgccaaattacgctaccaagagacgatagtgttcgccttgcgtgagaatttatccggtttcaaaagttaataacaagaaattattcatttaaatttagggcaaaaattagtagtagtagtagtagtctaagtagtagagtgctacaaattccagttccctcccgaaaacaaaagaaggcccaagctgcagcacaggcgcattcccctacagaaacccaataatgctaaggtcaaccttcccgctcgtctcccacctcccatcccgcaaaccacccccaatccgcccacgcccaccacctgttcggccctatgcctcttccgccgcctcgcctcctcctcctcctccgccgccggcgtccgcttacgtccacctccccttctgccgcaagcgctgccactactgcgacttccccatcgtcgccctcggcacctcctcgcccccgacatccccacacggcggggacggcgacgacccgaggatcgccgactacgtccgcctcctcctccgcgaggtcgccgccacgcgccccgtgtccgacgacggggtgcccctcgagaccgtcttcttcggtggcggcacgccgtcgctggtcccgccgaggctcgtcgccgcggtgctcgacgcgctgcggaccaggttcgggctgtcggcgtccccggaggtgtccatcgagatggaccccgggacgttcgacgccgccaagctgagggagctggtggggctgggcgtcaaccgggtgtccctcggcgtgcaggcgttccaggaggacctgctccgtgcgtgcggccgcgcgcacggcctgcgggaggtgcacgacgcggtcggcatcgtgacggcgtgcgaggggctgcagaactggagcatggacctcatctcgtcgctgcccaaccagacagaggagatgtgggaggagagcttgaggtgcacggtggatgcccgtcccacgcatgtgtctgtctatgacttgcagatcgagcagggaactaagtttgggcaactgtaagtgtttattgccaattcatgaatctaatcccatgtttttgagtaaccgattggaaatttcggatatattctggccacatttctgttaatcacttcatgttctgattctgttatggggtttggttggtatggcaatatgggctatgaactaggaatggaaattaaataatttagaatcattataattctattgggaagaagtttgtattactattttgcacttgtttgtgttgtttttaagttcaatgctctgctcagaactcactatgatgataaacaattattgtaactggaatacgctaaaaggtaaaggtttaagcatgaaattgttattgttgtctctggccttgtctcatccaattatgggaaaaatatgtctcattaatttgtgatatgttaatttgcactgacctttttatgggaaggtactgattctcttatgtcagatttgaaacgccagatcagcttttgcctttacatgactacagattgagtcaaaccctcttttatgattttttaaattaaacaaaaactatgatagttaaaatctctgttgttttaagttcggtgctctgctcagaactcactagtatgataaacaattattgtagtcaatacaccaaaaggtaaagagtttaagcatgaaattgttatggtcgtctctggtatgtctcatctgattatgggtaatatcccaatacagattctcttatgttagatttgaaaccccaagtcagccttctcctttacatgaatacagattaaggaaaaccctcatttatgatttttatttaaacaacaactgtgaaagttaaaatccttcacatcactaaaacaatattcctcaagtacattttcaccatgctatagcattggcaggacaattcattgaacttaaataatgcagcatgatattattaaaagactgtaacttattttgaagtttaaagctgtaacttcatcctgtatatgtgcctgacaggtgggtcgaacctatcagacttaccctaaaccctgttcttgacaaagtagcaactgtaagtgtttattgccaaatcatgaatcacatcctatgtttttcagtaaccgattggagatttgggatatattatggccacatgccacatttgtgttaatcacttcattttctgattcagttattatggggtttggttggtatggccatatgggctatgaactagagaatgaagaataaataactagaatcattatcattctattgggcagaagttcgtattactattttgcacttgtttgtgttgtttttaagttcaatgctctgctcagaactcactatgatggtaaacaattattgtagttagatataactgcaatatgctaaaaggtaaaagagttcaagcatgaaattgttatggtcgtctcaggcatgtctcatctaattatgggaaaaaaatgactcactaatttgtgatatgttaatttgcactgatcattttatgggaaggtactgattctcttatgttagatttgaaaccctgggtcagcctttgcctttacatgactacagattgaggcaaaatctcatttatgatttttaagtatacaaaaactaggatatttaaaatcttgcacatcactaaaacaatattcctcaagtaaaagtaaattttcaccttgctacaacattagcaggacaattcattgaacttcaacaatacaacatgattttatataaaaaaaactgtaaacttccttttgacattgaaagttgtaacttgatcccatatgtgtgtgtgacaggtgtgtccaacctatcaaacataccctaaaccctgttcttgacaaagtagcaacttttgataacatcatcaactgtttttgtagttttctgaattgtccagctaatgctataacaagccgataattgacaatatagttgtgttcttttgcgaaattttactcatattcctctaattctagctgtcattccaaccagtaggaattcagctccatgtacatggatgagttgattgaatgatcaatttacagcaatcctttttcataattaatgcttgcagatatacacctggtgtttatccgcttccaaatgagaaagattctgcaaacttctataagatagcttcgaaacgtctttctgaagcaggatataaccattatgaaatcagtagctattgcaagactgggtatgagtgcaagcacaatgtaacatattggcaaaaccggtcattctatgcatttggtcttggatccgctagctacatcaatggtatcaggttctccaggcccagaagaatgaaggaatatgcagagtgggttcagaaattggaaaatggagtgtggagccatgagtctggcaattctgggataaaggacatggcaatggacgtggtgatgctatcactgagaacagcatggggcctagatgtgcaaagtttcagtaaaaccttcggaaggagtctgacagagtcattgtgcaacacatttaggccttttgtggagagtgggcttgtaattgccatggatatggaacggcgagctttgcaaccaagtgaatttgagttggacttgcaacatgatggtgagaatggaagcagagttgccttcatccgtctgagtgacccagatggttttttgttgtccaatgagttgatttcacttgcatttggaattatttcaccataacaaggctacactttctttacatcggtatcgatctttttcattttattactttcatctgaccatactggtaactatctagtctgatcttagttttccaggtagatattagctaatcgctaaaatgcttagcatttctgttcaagtcagtgcaaactgaaactcatattggttgagagagaactgttacaccatttgcataaatgcaaatagatggttatctagtatgttcttattttgtttaactatatccatgactccatatcactcctcccttcgtgtatatatttctctgcattctcttattatcagttcatttcatacatatgagttaaatctagtagattgttgctatttgtttatttatttttgttcatacaagcatacaacaagtttactgtttgctttttgtatggcagttttgggtgcattggataaactattgacgatgaataaattttgtttcttagggatgattgtttcagtacttggttatagtttttaggatttattttcctggtgtagatggaaaaatatttggggcaacaattttttgaactgaactg

SEQ ID NO: 9040 - DNA, 1888 bp, Oryza sativa
  unsure (1)..(1888): unsure at all n locations
tgcctgagctgctggcagcattgctggggcatgagtcatagggcgggttggtgtttgagtgactttaaggttaatcatttgaagaacgtcaaggtggcagtgcaagtgcactattcataaacgctaatatcttgcacggcaaatctgatgttttgcaaagcttgataactgttatgagctataattcaccctgagctttgcatgtcaaatattgataaagctagttaattggattatatccttttttggaactaaatttttaatgttgagtaagttgttgccttcactatgctttggatgcgaagtattgttttgacataagctttctaagttttaacactgaagttgccattcactttacacgtcaatgattgttttggagctcaattattagttgataatcttgtccgagtttctgctgatgggagccggggaggaatagccacattttgggatgatgaagccctccaacaaagcgatcttgatatcagaaccttctccctctcaatctgtctcactcagaagtcctcaaatacgaccttcctcctcaccaatgtttacggcccgatggaagatgcaactctgatgcagacatgctcttctcaaaccacaacctccaagcactctcttcatcatgctccagacatgctcttctcgaaccactgccccctgttgctctcaccaacaaagcagctcctgcgcaagccaactttcaggtttgagaatttctggccaagactattgggcttcctcgaagttgtccaaacggcctggtcccagccggttagcgcttcacacccggtcaagcgcctgagcacaaagctaaaaatgatggccaaggcactaagatcctggagtaaccgcattctaagtgacagtcgtgtccaatttcaccttgtcatcgagcttattctcaaattggacatcgcctaggaaaacataccgctctcacccttggagctctccctcaagaaagatctaaaactgcggatcctcggccttgccgtagttgaaaaggctaggaaaagacaatgttcaaagctaacatggctgaaagagggcaatgcaaataccaagtttttccacctaagagtcaaccaacaacatggaagaatttcaccacnagactncaccggtaatggcccccaattttttcccttggggagcacttcatgaagctaaagagtgagccttgtatgaacatttctccaccatgatggggcattggttacaacgctcttgtaccctgaattggtaagaactccacctcccccaagtgacatcggaagatttagactctcctttctccgaagatgaagtttgggctgctatcaaacaaaagcctattgaaaaagcgcttgggccagatggtttcacaggcacctttttcagaagctactgggagatcatcaatttagacatcatggagctccttgataatttacactcattatcaggggggagttttggaagcataaatagggcaacactgattctcattcccaaaaagaatgacgcatgtacagtgggtgattacagaccaattagcttaattcactcctggcgaagatgctgacaaaaatctggcaatctgcttgtccagacaaatcaacatactgatctcgcaagcctagagtgcattcatcaaaatgagttgcatccaggacaacttcctctacgtctccaacttggcaaagaagatgcacagatccaagaagcccaccctctttttcaagcttgatatcgccaaggccttcaatttggtctcatgggaatacctattaacgctacttgacaagatgaggttcacgccaaatggcacgactgggtggccctgattctgtcaacctcctcctccagtgtctcactaaacggaattgagggagaa

SEQ ID NO: 9041 - DNA, 1143 bp, Oryza sativa
gatgattcacgttttcaatcaactttgtagatgataaaagcatgctttcgagaaaggctgaaatttgaaatgcataccgctggaggggggttgaaggcattgtatggcaccactggagcaagtgtgaatagctaactacgactgcatttgagaagagtttatacattctctccttcataaccttaaattcaagagattcaggatcttcacggttagggtcatgcttgccgtcgaattcaaaggccgtgcgagatctttctttgattggggccagtcagctcttgataaagtgccgggtgatctgttctccttgcagaccttgctcctttagtttcagcatacagtccatcagggcaagcgcctgagcggcttcctttcccattagaagtgagttccaagtgtcctgataaactggaggaagacaggagtactcggggagtgcaggctcggggttttgtacatagaaccaatttgcatgccagcctttgtttgaagttttgaagggcatggacaaatacttttggctcagagttcccctcagttgaaatccagcacccccaactacgcatggcttgctcttgttcggttggggtttgaggaagaagatatagcagaatagggcaaaatgtggcctgacgcccataaaagcttcgcaggcatgtatgaagttggcaatatgaactatggaattcgggtttaggtgatgcaaactaatcccatagaaatccaaaatccaccggaagaatcttgaggttggaagagagaacccaccgtaaaagaaataggagaacaccatgacctcgtgtgtgtccggggtcgggaatgcttcgtcgtacgccgaacgccatccaatgatctccttcgctggaagaacaccatgtgctaccatttccttcaagctttccaccgtgacgtcggagggcgcccattggctctcgaagctttctctctcctctaccatggatgtgaattggatgatgcaatttgctttcgaaatggctggggatggatgggggattgatgcggtggatgcgcggatggtttctgtggagttttggaagggggatttgagcgaatcggagaaccctagttccgccggagtggtttggcactgtagcgaggaatggggaaaatggcgaaagt

SEQ ID NO: 9042 - DNA, 9894 bp, Oryza sativa
attttttactcgggcctctttatatttccatttttggtatattaaagctaaagtagtcggctggatgttttattaaacgtcgcatatgcttagttgtataatattttggatgattcggttgtaaaaccactcggatggatgttatttgcactttgactatgtgtttagcctttagctactcacctagtcgggggctacacctaattaggtttatctattcgatgcacctaattatttatttttagcccttcacagtctttgattttggtactctggagatcaatgcagaagaaagtgaagcacttggattatcattttgcgctccgacagaaggctatttcgtcgactgtaaaggtctcaggggctactgtggagattatggataccccctacctacacggcatgtatagtccgactgggaatggggtgccacgtgtagatagaatatctttagaaggactcgggttaaattctaaacttgtatgtcaaggaaatatcagagatcctagtcggttacgattgtattttatctgtaactacatattccgttagggatatggactgtagtttgtaatacggaccccttcccctatataaggaggggtccgggtgcctctaggggcacgatttttttcccagatcacacgatcaataatatactcggcggatcaatcctcggacaggagtagggtattacttcttgattaagaaggcctgaacctgtataaaattccttgtctttaaacccatccacttttgcagcttgatagccacccccttttagtattaccgaaatcttgtttcgacaagcggttataaatccacttttcaaaatgtaagtatcgattgaaccatttgccatatcaatgttaattcaatcttatcttgtcaccgaaacaagacgctccgcgtaacttgaagttaaaattttcatatttgaaggcctggtcgcggaaatatcaatttataagttaaaaacattaagcattattgcctcaataaaattcatatatgcttaatagtccacgttaattcccatgcatatcagtttcatttgttttaacctaaagtcacaaaatatagctgttgctctatcctgagagtgaataggtaggcattttgttctttactggtatcgttgatgaccgctgtgatacaatcggaccatggtttgatgctagcaaggggctattttcacttatgttctgcctcctaaatgtcctttcgttcttacatctagtaccgtgagaaaaatctagctagttctataggcaaatcgttgccaatacgtgctagccgaactgttgtgagaagcaatgcctcctaagtcacgatttcgttccctttcgtgattttttgtttctaacgtgtttttttaactcctctgcaaaataaacgcaagctaatctttcagatttttcaccaaagtggtcataaaattgatgacgttcttaaaggctatcataagatttttgtcacggaatgtctaaactgttgtagtattagacatattgtcgtaaaggcactttactacatatctcatttgaacgtatgcagttattgataactaatatatttgtcataactcactttacacatacaaatatatgtctagatatatcattaaagttccacgcgcccttgacatgtaaagtgcatttgtaaaacaatagcttacaatacataacaaaattagtttgaaaaggacagcaatccatgtcactgtcacgtcctgataaattcatcccgaaataaaaatcattccctaaaaggaataatagaataaattaaaattcgaaaagaaattggcaaacactaaaatacgtacaagaaaaattcgaatgtggcccggagaatttttgttaaattctccttgctctaaaatgagccctcaaattttacttgaattttcagagcaccggaaatatttattaagcaacaaaaacaattatcaaagtttaataaaaagaaaacctaaaaataatcctccttttcctttgggccaagtctagcccaaagcctccctctctctcccccggcccgcggccgaagtccttccctcctccctttctttttccctccccctcctggcccactccctcctcctccctctccctcccgggctgcctctccctcctctcctcctgggccgcctccgggcccaagccgagaggcgccctcccgcccgtgccgcgcacgtgcgagcgctgaccgcgcgcccgcgtggggcccacgcgccaggtcgttgtcctcctcccgcccagcctcctcctctctcctccgtgaaccctagccatttcctccctcaaatccgcgcgattcaaaccgggaattccaaaattgattagggggaattaatcccctttccctcgtctctctttccccctcaattcccccttgaatggcgcccccaatcgccgggaacggacgcgccaactccggccgctttccatggtcgccggccgccatttccgccgccgttccccgctcctcccgtgctcagctcgcttccctccgctataaaacggaatcccctcgctccgttctatcgttttagccccctcccgcgatctcctgtggtccctagccacctccccgccgtcgtcccctctctcccgtgccaccggccgtcttcagccgcccctgccgccgcgttagcacgccggccggccgtgccgtcgcctcctccagcgtcgcagccgcctcctcttcgccggcctgccctctgtttcccgcgaagacctccggaagtgcatccccgccggcaacagtggcgttgccaccactgttccgcctccagccgcctctgccgcgtcccctgtgcgccggccgacgtcgccaccacctctcccggcaccggaacgccatcctcttccccggccaagccacggcgtcgcccgtatttcgtcggatcgccgtcgcgcgcaccgcctctccctcggtctcgtcggcacccactccggcagcccctttcgccgtgccagtgcaccggccgacgtcgccgtctccacctccggcatcgcagcggcaaggtcgccctcggcctcgcctccccttcgaccgaacccctccgcggtccatcgtcgtcgtctccgttcatcctcgttgacgactcctccggtcggtcgttagtcctcgccggctcgtcgtctcgctgcgccgccaccctcgtcgtcatcgtaccggcgtgttccgcgccgtcctcgtctctgtgcagctgctgccgtctgccctcatcacctcctcgccggttcctgtcgtcgtcctctcgtcattcctggttgtcgtggcgttcgtccctccgtcaagccgttctcgtccgtcgtccgcgtccgtcaagtgtgccgctgcagccccgtcgtcgtcttcgtccttgcctccgcgtcgccaagcgttgcgccggccgcgtctcgccttcgtccaaggatcgccgccgaagtcgtcccctcgcctttcgtctccgtcattcctggccgtctctgccgcgcccgttcgtcgttgtcgttccctcgcctcgtcgcgtggtggtaaggatctctccttcgctgccccgtcttcgtcctttcggtgtcgcccgtgcccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcagttgacacacgggatctgcttctgtcgacccgtggaccgtctctgtgtactcggtctaccgtggtcctttaggttgacatgtggggtccgcatgtcaacggcacagccttcctgtcttttccaggctagcgcttacacatgttttatagttgcaaaacctaattataataatccgcaaatctccatgtaacagcattaaacttcggatgatcatatcttggtcatacgagctccgaatcgatccgttcaagtctcctaatgtttcttataacctaaagaaccctgtgctttctttttattattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgctattgttattattagcttgttcaccctaggataaacaaaaccccaactagtgggtactctattcatggttccactagtatgaatttaggtagatgcttcgctgattaattaggcaactttaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgttcctcgggtactataaggattaagctcaggcctctgttgcaaagcactaccgtacttccacatgtctagcgggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggctggtgtcctgctgctaggggctcaatcctgcctgcctgtcccagaggttccggccgtaggtggggttgggtcggtactcttgtttatggctaggatgggttgggaactatgtcacgtcttccgtccgtataccgtggtggtatgtggcacgtggttacacgtgaggaagatgtatcttgtgggtaaagatgtacacctctgatcagagtataacctattcgaatagccgcgccctcggttatgggcaagcctagcaatgtacccaagttagtgttttaattcttaaaatgtgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtctttataaaatggctttgggtaactaagtgacttttaaatgctgttttctacaaaacttaacccctatattattaccccttgtaccctcttgcattaatcatgcatctgccggtgtggcttgctgagtactgtggttgtactcattcttgctcaatcttcccccccccccttcagtaagagaagctttggagaagaagtcttaggtggagtcctggcttataccccagttgagcgcctgtgaagatgcagccgtaggcccgctagtccgctgctggttatttttttattgtcaggccttaagtgcctttgtaataatgtaaatattatcgatataataaagatgtgtcttttatatcatgtttgtgtggtgtaccccggctttttctgggacggggattaatacactagcgttcgggaaaatgtatttttctcggtcgcgacaagctggtatcagagccatctcgtctgtaggataagccaagtggataatacctaaggacatattttataaatgaaactatttgcgaaagttcctttttcctcctttcccctgtgctatttgcaaaatgtttactctttcttccttcttcaaatttcaactagtactagatggtcagctttgcggagaagaagatatcgtcaattgtctgccgaagctccggaagactgcaggatccgctagcgaagtggaggaagcagtgaagctagctgtgaagaagcagtgaagatcttagagaacccgtcgcagaacccaagccaccctctagggcagactcgtttgtcgtgtgtttccttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcctgtctctagttctggtctattctttcctggcttgtttcctctctcacctcaatccctgtaacagatgtttaacagagaaaaaggaaagaatgtcagcgggtatgcctcaactaactcaagttttcaactcaatccaccactgtcctcaagagagttaacaagggcacacccttggtccattccaagcatgctgctgagttcacagctaccattggttggaagtcaagaccaaaatcagtatgtgtttgatcgagcatttgccacccaggtcaatgagcttccaatgccagaagagcatgtccccttttgtcatgattgtagagaacaaggacactatgccctgaattgtccatgggtatatgccaaacaagcctcttcctttggtttagcagggcagacatcgctaaaccagcctcctcgcaccaagtcaagcttgcagcctagtgtgcaaagtagagagcccaatggagagaatccattgaatcccgggaaatgctttcctcctagcctttcgtaccacgtggggtcacatactaagcaagccaaaggcaagaagagtaagaatcagaagagaaaagcaccgatgcgaactgaagaagaagtacgtaagatgactattaccaacaccgaatggcctccagtagggataactattcctagacgtcaaagaggaaatacctttcgaggtgcacgacagttgacccagcacctcctaagccatggtggcagagtatctgatagtgaagggtcagatcaagtctcctcggatgatgaagatgagtctccccgacatctcggcgaggaagagatggaatcaaaggcatgcacctgttgtggagaaattggacacgttgctagcatgtgtctcacactctgccctcattgtgaagaagaccatccaccaggggagtgtcccacccgcaagatgacatgttttctgtgcgaaggtacaaaccatgtgcccaaggattgccaactcagtgtgttgttgaccaagaccgtagaaatccaacgaacaaccctacgattgtctcatcagctagtcagctccaacagcaacatcgacgatatcatccatagcaccaatgttcctcctgctccacctaactctgcaataaatcatagcaataataccttcagcaccaaccattctctgcaccgacagcctcagcaaagaattgtcgtcgatggaagaagttgtgtctctccccgacctactccaggccgagcaaagggcaatcaacctccggagggcgataccaagcagaagaccgtcatccgcttcaaacagcaatcagaaggaagcttctcctgtgaatgatagcaatatgcagtcctatcacatcatcacagaaccaatcaaggatgcagtcactagaacaatgccagctatatctctccagaatcagaatgagtatccatgtttgtgattttcagttcgctacttatcactgtaatcgggagtttgcagcaatcatgtaataaataaatatattcatgtttataaacagtgagtttgctatgtttatggatgattcatgttgaggatgcaatgtaccgatgttaagcaccttccctttttgtttaaggtagggccttgtattcatgtaataagggagaaatgtgtaacaaaaacaagttctatgaggactctttcggaagatgctgatatgggattatgtgtttactgtcaaaggagacctagggtctcatttcagaggaaccatgttctaacctcgagttaataaccaacctgctgatggaaaagaaaatcaagcgagtaaccagagagacatttgtttggactaagagtttcagatttgtctttttcggatcaaaggcaacgacagtcagtacagcttttgatgaactacttcaaggtttcactgaaaggcagtaggccaaaggacctcattgccaccagaagtgtccgcaacccacattaaagagtaccacctgttagagataggccgaaagatgattgataaaagatattggcaaatatgttctctagcaggaaggaagtaggccgaaagatgattgataaaggataaacagaaacatgctctgcatcactcaaggaagactcctgatagcaatcaccctgcaacagtcaccttgtcattgaggtagaaaaaaaaatcgtgagtaagcaatacgacctaggtaaaagtgtttctttgaaggcaaggaatgaaatctttaactcggtatcagatgctacacggagtgaaaagtgcaagcaccggttaccaggcaatgccatgtcttgggagatgatccaatgggaaggaactcatcaaggtcgaaggtgtaaaggaatacgttgaatgctaaataatgacaacatgaagataatagtgggataagttggttctgttgagaaacataattcaaaggcaaagttattgacccttgcatcaaatagcagaagtagctagcacctggagaccaggaaagctaatatgaggtagttggtggcaagttagaagtaaatgacaagtatgatattcttatgatggcaaacatggtatcctagtaatgacaagctagtgttgacgcatgacatgaagtggtaacttgtatgaggttgactccaaagatatgagttataagaagttctggaactgaagccccatcttccaatgccgcagcccagtcgaagtcagctagaggtgcaaccagggaaaagtcaggtgaagagaagattccatctataacaggagatcgagccaagcagtccagagtggagaagttttgctaggcaagtttgttatagaagacgcgacggaagaagtcagacaagaagagaagaccgcgcaacctatcttcttgctagccacctcgaatctcggggacgagattcttgtaaggggggtggatttgtcatgtcctgataaattcatcccgaaataaaaatcattccctaaaaggaataatagaataaattaaaattcgaaaagaaattggcaaacactaaaatacgtacaagaaaaattcgaatatggcccggagaatttttgttaaattctccttggtctaaaatgagccctcaaattttacttgaattttcagagcaccggaaatatttattaagcaacaaaaaaaattatcaaagtttaataaaaagaaaacctaaaaataatcctcctttcctttgggccaagtctagcccaaagcctccctctctctcccccggcccgcggcggaagtccttccctcctccctttctttttccctccccctcccggcccactccctcctcctccctctccctcccgggctgcctctccctcctctcctcctgggccgcctccgggcccaagccgaggggcgccctcccgcccgtgccgcgcacgtgcgcgcgctgaccgcgcgcccgcgtggggcccacgtgccaggtcgtcttcctcctcccgcccggcctcctcctctctcctccgtgaaccctagccatttcctccctcaaatccgcgcgattcaaaccgggaattccaaaattgattagggggaattaatcccctttccctcctctctctttcccccttaattcccccttgaatggcgtccccaatcgccgggaatggacgcgccaactccggccgctttccatggctgccggccgccatttccgccgccgttccccactcctcctgtgctcggctcgcttccccgggctgcagga

SEQ ID NO: 9043 - DNA, 10448 bp, Oryza sativa
tgattaataacactgtgtaactctaggatcgtctttatataatggctttgggcaactaagtgacttttaaatgctgttttctacaaaacttaacccctatattattaccccttgtaccctcttgcattaatcatgcatctgccggtgtgacttgctgagtactgtggttgtactcattcttgctcaatcttcccccccccttcagtaagagaagctttggagaagaagtcttaggtggagtcctggcttataccccagttgagcgcctgtgaagatggagccgtaggcccactagtccgctgctggttattttttaattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacagtcacactgagatataaagtgagtgacgagtcataacattatctatcttgctaaccatcaagtatctgtgatgggcaataaacttactttgacgatggtatgcagggacatctgtggaggcacatcacgtaacatccaaacgacatgactcactctgatcctaatagaatatccaaccaaaacaaacactctaaagcaaccgataaggaattcaaagaaaacccatccatcgcatctataaatagacaagcacaatgtaaacccccttcatccttctcacaactcaaacattacagcgaaagcataacaactagaatcccaccacaacgaagatcattttcttctttgctctccttgctattgctgcatgcagcgcctctgcgcagtttgatgctgttactcaagtttacaggcaatatcagctgcagccgcgtctcatgtgtcacgaccggaaataacccaacgggcgttccttacgtgagtgcattattccttgtcccaggaggcaaggtacaccaaaagttgatacagttcagagttcaacaagcggaagcgtaaatagttaatttattacatgggcagcgaaggcccagcacacacaaagacaaacgagaaacagcggaagactagggcgacgaccacaggcgcttgacggtaggcacgagctagacaccaaaaccttcatcttccagagactcctcttctgggtttgggaaaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtccaagctcgtcccaagccaacccaggccaaccattccacattttagttgttaagcaggttttaagaattaaaacactaacttgggtacattgctcggcttgcccataaccgagggcgcggctattcgaatagattatactctgatcaaaggtgtacatctttacccacaagacacatcttcctcacgtgcaaccacgtggcacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacgctagtactttgcaacagaggcccgaagaccggtccttatatggccgaggtgctactatcaaaaccatgcaccccgagcccagcctaaaaccattgttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacggtccacggtggaccgggcgcacccgggctcacaccggccggcgccgtgggtcccacgcgtcagccgcacccgaggacgcgggcggctgacagccgggccccacgcggcagccgcacggtgcgcccgaaggcggccacgccggcgcagcggcgggaggcggcgcgccctcacccctatggtcgccggcggcggccataggcacggcggagcggcggccgagagaggggaagggaagggggaaaagaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcgccggggatgcggtggagccgaaggtggcgacgccgaggcgggaggtggtccggggcgacgacggcggcggaccggagctcggcggtgacggcggagagagagaacgacggcgcgagctcgattccgacggggagagagggcggcgagtggcggaaacggtggagggaggcacggggaaggtttatataggattgggagggggagggagctgccggacgagggggaaacgggcgcggaagatccggtcgccattgatggcgccggcgaggttaggggagaggtttccaaacgaatccgagggagagagggagggaaaaatggggggaaagagggagggaatcacggggaatatttccccccactttattgcgcgcgtggatggcgggaggcggcgggattcgcggcggcggcggcgctagggcacgggcgaggcggcgggagcggcgggaggaaggggatgacgggtgggccccacccgtcagcgagggtggcgggcgggcccgcccgtcagcggcacgcgcgcggggaggaggccgaatgggccgcggaggagaggagagagagggagagagatgggccgagccggcccaagagggggaggagggggaaaaggactttttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcggggatgtattttagagtcgttttgggacgcgacatcatgctgcagcaacagatgcttagcccaagcggtgagttcgtaaggcagcagtgcagcacagtggcaacccccttcttccaatcacccgtgtttcaactgagaaactgccaagtcatgcagcagcagtgctgccaacagctcaggatgatcgcgcaacagtctcactgccaggccattagcagtgttcaggcgattgtgcagcagctacagctacaacagtttgctggcgtctacttcgatcagactcaagctcaagcccaagctatgttggccctaaacttgccgtcaatatgcggtatctacccaagctacaacactgctccctatagcattcccaccgtcggtagtatctggtactgaattgtagcagtatagtagtacaggagagaaaaataaagtcatgcatcatcgtgtgtgacaagttgaaacatcggggcgatacaaatcttaataaaaatgtcatgcaaatttaaacataatgcctctgtaaggataaatcctagtacattgttgaaattaattatcatcaccgcctactatggttgcatttacaactttacgatgtgttcctacatttggttctaagctactatggctactcgacgtgaacggagtgtgttaagcaggtcaatcttttcatttcgatcagaacaaagtcaaaacgcatgtggcaaatagtatataccctacaacgtaatcctacaccataggcaaatcattgccaatacgtgctagccgaactgttgtgagaagcaatgcctcctaagtcacgattccgttccctttcgtgattttttctttctaacgtgttttttaactcctcggcaaaataaacgcaagctaatctttcagatttttctccaaagtggtcataaaatcaatgacggcaaaataaacattgttgaaattaattatcatcaccatctactatggttgcatttacaactttacgatgtgtgcctgcattcggttctaagctactatggctacttgtcgcgcccggaaaaataccttttccagaacgctagtgtgttaatccccgtcccaggaaaagccggggtacaccacacaaacatgatataaaagacacatctttatatatcgataatatttacattatcacaaaggcgcttcaggcctgacaatcaaaaataaacagcagcggactagcgggcctacggttccatcttcacaggcgctcaactggggtataagccaggactccaccaaggacatcttctccaaagcttatcttactgaaggagggaaagatagagtaagaatgagtacaaccacagtactcagcaagccacactgggagatgcatgattaatgcaagggggtacaaggggataataataatatggttggattttgcactaaagagcatttaaaagacacttagtcgctcaaagctattttgtaaacacgatcctagagctacacaatattattaatcaagactgtgaaccctcacgaacctgccttaacccaaagcctacgatgattcggaccgaactggcaacccgacctcggtcccagctcgtcccaagccaacccaggccaaccattccatattttagttgttaagaaaattttaagaatgaaaccactaacttgggtacattgccaggcttgcccatatccgagggcacggctgttcgaatagattatactctgatcagaggtgtacatctttacccacaagacacgcctttactctgcattccattgcaattggaacccataaaaaaaacgtgacataaccctttacccatcctagccgtgaacaaaagcaccgacccaaccctgcctacggccgatatcccgggacaggcaggccaggattgagcccctagcaacaggatctagaccgggtgcgccacacgcataggggtgagaccacccgtgtactagtccagtgccatggcatttcgactaacagacaccagcccatgtagccttcatttgcctaaacatctcgattaccgatccgcagctcgcgtagccttcatttgcctcagagatatccatcgtcgcaacgacttcatccatctctatccgtgtccttttgttcaggactagactgagcaccgagttaagccttacccattagacatgtggttagtacagtagtgctttgcaacagaggcccgaccttaatccttatattggccggggtgctacttcccacaactggcatgcacccaaaccccaccggaaaacaggttttaggggttttgaaagaggaagagaggggtatgtcatattccaccataagccaaccgttccatagtatccaagtgatataagaattcccaaagtctaaagttataataccacctattgttgcctaattaatcagcgaagcatctacctaaattcatactagtggaaccataaatatagtacccactagttgaggttttatttgcctagggtaagcaaggtgataataacaattgcaataataaggctataacaaggattaataggtaatgctaaataaaacagtggtaacgcgggaatttaaataaagcagtaatgcaataattcaaatcaaaataattttataaattgggattcaatatgctgaaggatgatgcgacttgccttgctcagagagaacggccttccgaaccttcggcgacgaccgcgaaccacgcttcgggaacctccggaacgacaggagctacgcgaagcacacaagcagagctaaaccctataaagaagcaacaacaatacataaaaagaaagcacagggttctttaggttataacaaacattaggagatttgaatggttccattcaaagttcgtatgaccaagatatgatcatccgaagtttaatgttgttgcatggagatttacggattattgtaattaggttttgcaactaaaatatgtgtaagctctagcctggaaaagacaggaaggctgcgctgttgacatccggaccccacatgtcaacctaagagaccacagtggaccgggtacacaaagacggtccacgggtcgacggaagcggaccccatgtgtcaaccgaggcgagtggccatcaaacggactccaccagacaccacgcgggctgcacacgtggaaaccatgcggctaccgagcgggcacacaaacacggtcaccacacgcaccacgaacgactaccgacactggtacacgggtaccggggttgacaaccgcacaacgggcacggggcgacaccgaaaggacgaggacgaggcagcgagaggaggcacccttaccaccacgcgatgaggcgtgggaacaacgatggcgaatgggcacggcggagacggctcggggacgatggaggcgaaaggggagggaacgacttcagcggcaatccttggacgaaggcgagacgcggccggcgcaacgcttgacgacgcggagccgaggacgaagacgacgacggggctgcagcaaccttgacgaaacgcgggcggtgaacacgatcggctcgacggagggacgaacgccacgacgaccgggaacgacgagaggacgacgatgggaaccggcgaggaggcgacgacgaatgccggcgggttcggccgaaggggaggcgatgccgaggacgacgtggaacacgccactgcgataccggaggaggagacggcgacgtcggccggcgcacgggcgacgaatagcagtcggccagagacggggaggtactggacgccgatgaggaggccactccggcgagcttcgggcgaggaggaggtgatgccggagatgaggacggcgtcgcagaggcgagggaggtggtggcgacgtcggccggtgcaaaggcgaggcggcacaggcggttggaggcggagcagtggcggcaacaccaccgttgccggcggggacgcacctctaggggtttccgcgtgaaacggaggcgacgccggtggaggggaggcagctgcgacgccgagggaggagacggcgcggccgaccagcacgcgggcgaggcggtaggggcggctggagatggccggcggcacgggagagtgaggaggacggcggggagaggtggtgaagccacgggagagcgcgggagggggtaaaaattagagaacggatctagggggttccattttataggataggggagggagccgggcacgagagaggtgggaacggcggcggaatttgtggccggcggccggggaagacgcgtccgttcccgacgattgagggcgccattcaagggggaaaatgggggaaaccaaagaggattgattagggaataaaagcccccaatcaatttggagttaaagcccttgattcgagcggatttggaggaggatgagggatagatttgaacgggagagatgagaggagaccgacggctggaggtgggagacgggtccgacaggtgggacccacctgcaaggcgcggtcaacgcacgtgggcgcgcgcgtgacaggcgcgtgcggcgcggcctggggaggctcggctgggctgggacacggcccaggtaggagggggcagggcggcctgcgccgggcagaccgggaggggagggaggattggaaggagtgggtcgggaggaggaggagaggcccgggagaggagggaaagagagggaggagagggagactttgggctaggctcggcccaaaggaggaaggagggattatttttagtttttctttttagtaaactttgataatggctgttgttgtttaataattatttccagtattctgaaaattcaagtaaaatttgagggctccttttagaccaaggagaatttaacgaaaattcttcgggctacattcgaaattttcttgtacgcattttaatgtttgccaattttttttcaaattttaattaattctattattccttttagagaatgatttttatttcgggatgaatttatcaggacgtgacactactcaacgtgaacggagtgtgttaagaaggtcaatcttttcatttcgattagaacaaagtcaaaacgcatgtggcaaatagtatataccctacaacgtaatcctacaccatataaaacatgcccaacctatagcggttataaatccactattcaaaatgtaagtatcgatgggacaatttgtcatatcattgttaattcaatcttaccttgtcaccgaaacaatacgctctgcgtaacatgaagttaaaattttcatatttgaaggcctggtcacggaaatatcaatttataagttaaaaacattaagcattactgcctcaatgaaattcatatatgcttaatagtccacgttaaatcccatgcatatcggtttcatttgttttcacctaaagtcacaaaatatagttgttgttcttaaaggtcataatatctacccaagctacaacactgctccctatagcattcccaccgtcggtggtatctggtactgaattgtagcagtatagtagtataggagagaaaaataaagtcatgcatcatcgtgtgtgacaagttgaaacatcggggtgatacaaatctgaataaaaatgtcatgcaagtttaaacataatgcctctgtaaggataaatcctagtacattgttgaaattaattatcatcaccgtctactatggttgcatttacaactttacgatgtgtgcctacattcggttctaagctactatggctactcgacgtgaacggagtgtgttaagcaggtcaatcttttcatttcgatcagaacaaagtcaaaacgcatgtggcaaatagtatataccctacaatgtaatcctacaccatataaaacatgcccaacctatagcggttataaatccactattcaaaatgtaagtatcgatgggaccatttgccatatcattgttaattcaatcttaccttgtcaccgaaacaagacgctccgcgtaacatgaagttagaattttcaaatttggaggctgggtcgcggaaatatcaatttataatttaaaaacattaagcattactgcctcaataaaattcatatatgcttaatagtccacgttaaatcccatgcatatcggtttcatttgttttaacctaaagtcagaaaatatagctgctggtctatcctgagagtgaataggtaggcatttcgttctttactggtatcgttgatgaccgccgtgatacaatcggaccatggtttgatgctagcaaggggctattttcatttatgttctgcctcctaaatgtcctttcattcttacatctagtaccatgacaaaaatctagctagttctataggcaaatcgttgccaatacgtgctagccgaactgttgtgagaagcaatgcctcctaagtcacgatttcattcccttcgtgattttttctttctaacgtgtttttttaactcctcgacaaaataaatgcaagctaatctttcagatttttctccaaagtggtcataaaat

SEQ ID NO: 9044 - DNA, 20958 bp, Oryza sativa
ctatgttggccctaaagttgccgtcaatatgcgttatctacccaagctacaacactgctccctgtagcattcccaccatcggtggtatctggtactgaattgtagcagtatagtagtacaggagagaaaaataaagtcatgcatcatcgtgtgtgacaagttgaaacatcagggtgatacaaatcttaataaaaatgtcatgcaagtttaaacataatgcctctgtaaggataaatcctagtacattgttgaaattaattatcatcaccgtctactatggttgcatttacaactttacgatgcatgcctacattcggttctaagctactatggctactcgacgtgaacggagtgtgttaagcaggtcaatcttttcatttcgatgagaacaaagtcaaaacgcatgtggcaaatagtatataccctacaacgtaatcctacaccatataaaacatgcccaacctatagcgattataaatccactattcaaaatataagtatcgatgggaccattttccatatcattgttaattcaatcttaccttgtcaccgaaacaagacgctccgcgtaacatgaagttaaaatttccatatttgaaggcttggtcgcggaaatatcaatttataatttaaaaacattaagctaatcatgtagagagaactcaactagtaatttatatattatttgtgataatcatattctaagcaggggttaagataatccaagggtagagtgacacacaagcattaattactcatcctcataatatatcatctaagctaagtggaaagaaaagagaaagagaatctattcctatacttctaatatacatagtatacatacattctagttaactgatatactagctaataccctctatccgatgccctcctggtacttcgagaagccacccctgactgccgagttccttacgacagcctgtcatgaccaaataatgatatcccataatctagacaccacgtctaaactaccagatactactctaatatcatcgtcacgacatagagtaaatgcataagcaaacattatacccgcaccaaagcatcttctagataagctagccgtatattcagtataacatgaacataatgtaaagtaggtactcatatactcgaaaagtatttcagtaccataaatgtatatagaagagtattctaataaaagtacaaagcttacaaaagaggaaaggaaagctgctagagccatacccgaactcttccaaaggcttccggactcctgattcctattctaattctattccaccaactagatactactaaactaaacttgagaggaatgagagaactattgcttgaggtgtgtgagtgaagtgggaaggtgaggggtttatatagcctcccaatgacggttgtgacggttggaatggtcggaaataccgtccaaccgtaattgggagctaatccacaccgtccagaagaaaccctgcatccagcggcgatgagggaggttcggtcgaaccccctagttcggccgaacctggggccagcccaaccagcccatggctcggctgctggcctcctctattgttcttctccgcagacttgtgaattttggcccaattcatcgtgtcaattctgaattcttggcctattcacacacaagtctggttctcgacatcgtccgattgatttatcgtctgagttaatatcgattctcctccactttagtgtcattccctgcaagaggttagtatacctaatactagtggaagtttattattctagcagatatatgcattgcaagcatcactagttctctcctattttagtaatattgacggtcgaaactgatcgataatgaccgtcaacaaaaccccccaagcttgaacctttgctcgtcccgagtgaaggacgaaaggaaacaaagacttggttattgatcaggaggtgctactatgctgcatatctcaaagatacaggtggaaggtatatgtactctctcttagattaaataatctttggcacggtggcttacccttacccctgattcccacaagacactgtttctccttgccttgggcggttgaaggacagaacattaattagagcaccaatcacccgatctttattcaactcttgttccggaagttttcaaatgattttgaaaaagaaagccaagttcctcaattgattcacatagtctctctaagtgtatcaatttgaattcctcaccaaacattgcattgttgattcctactctaaggtttatatgtggagcttggtagggatcaaacatggcacacttacattcacatttattaccaagtcaaaattttagactagagcagataactaaacatactaaagatcaagatcgtgcataatgtgtgtatggtatatagtcgaaaaataaaggaaaatgcttctcctttggtaggaaaatgcttcttttatttataaggagagggcatggctatattttttttcaacatcatgctcatgcttgatggagcataactttattattattattattattgttattgttattattattattattattattattattattattattattattattttataaccatgcctttacctcctcttttttttcttttttgtcaaaaggatttttttctttttaggacaagaaagtacatgaaaacatggagaatttattttgatggtaatgtgaaaatagaatggaatattgcttaactcccagtgtaggagtttagcatgtgcatatatgtgggtgtatgatcttgatcatagagcatgagaagtatctacacaagtcacaagagtttgacaaagttcaatggaatggtaagcaaccaaaatgtatatggtttaatcatgatagcacatttttggctctggtagaaatttacatcaaatgaggaacttcaatgttatcattttgaaaaacaaaacatccggaattcaagtcaaactagtatcaggatcatagctactcatatttactatctcatatctcacaacaacttagacttagattagcaactgcagcccatttacctcaggttcccggataattgttggctacttatatttaacctttgagagagtatttaccaagaactcatatataagagatataaaacagagcaactattcatcatttcaacaaagagaactagcttgtcttacctaccatgactcaaacctatcctatctttttggtattttctattttgcaattttttatgttgttttcaagttttgtaggatgcaattggaaagcaaacatacaattggaaagggaaatatgcaatgtgatacaagttacctcagtgggtgtcacgtcctgataaattcatcccaaaataaaaatcattctctaaaaggaataatagaattaattaaaattcaaaaagaaattggcaaacactaaaatacatacaagaaaaatttgaatgttgcccggagaatttttgttaaattctccttggtctaaaaggagacctcaaattttacttgaattttcagagcaccagaaatatttattaagcaacaacaacaattaagaaagtttactaaaaagaaaaactaaaaataaatcttccttcctcctttgggccaagtctggcccaaagtcctccctctctctctccctcggcccacggccaaagtcctctcttcctccctctctttctctccctctccttctctccctccttctcttgggcctccccttcccctcccggcccactccctcctcttctcctcctgggccgcctcggcttcgcccggcccaagccgagccgcgcctcccacccgttgccgcgcgttgaccgcgcgcctcccacgtgggtcccgcctgtcaggcgcgtccccgacctccagccgtcggcctcttctctctcccgtgcaaaccctagtgccaatcctccccaaaatccacgcgattcaaaccggggtttccgaaattgattagggggttttaatccccattgattcctctttgatttcccccgttttcccctttgaatggcgcccccaatcgccgggaacggacgcgccaacaccggccgccttccgttgctgccggccgccattcccgcctccgttccgacctctctcgttgccggctccctccccgcgcctataaaatggaaccccctccttgcgttctctcatttttgcctcctcctgagtcttcccgaggtccctagccaccttcccgccgtcctcctctctctcccgtgccgtcggccgcctccagctgcctctccctcctcgccggaacgccgtccagtcgtgccgtcacccccagcggcctcgcagctgcctcctcttccccggcgtcgctccgtttcacgggaaaatcatcggagccgcgtcctggccgacgaccagtggtgtcgccaccactccaccgactccagctgcccctgccgcaccgctcaggtgcgggccggccgcgccatctactccctcggcgtcgccgcgtcgacctccaccccggcctgccctctgattcatctggagaccgccgtcactgccgcgccggcttctccatcctcctcgtcgactcctccgattggccgttcctcctcgccggctcgtcgtctcgctgcgccgccaccgtcgtcgacatcgcagcggcgtgttccacgccgtccttgcctccgtgcagctgctgccggctgccctcgtcgcctcctcgccggttccgggcgtcgtcctttcgtcgctcctggtcgtcatggcgttcgtccctccgtgaagccgatcgcgttcgccgcccgtggttcgtcaagcgagctgctgcagccccgtcatcgtcttcatcctcgcctccgcgtcatcaagcctcgtgccggtcgcgtctcgccttcgtctaaggatcgccgccgaaatcgtcccctcgccgttcgtctccgctgcccattcgtcgtcatcgttcccatgcctcgtcgcgtggtggtaaggatccgtcctctcgctgcccccgtcctcgtcctttcggtgtcacccgtgcccattgtgcggttgtcgaccccggtacccgtgtaccggtgtcggtagtcattcgcttgtgcgtgtggtgaccgtgttagtgtgcccgctcggtagccacgtggtttccacgtgtgcagcccgcgtggtgtctagtggagtccgtttgtcggccactcgcctcggttgacacacggggtccgcttctgtcgacccgtggaccgtctctatgtacccggtctgccgtggtctcttaggttgacatgtggggtccgcatgtcaacagcgcagccttcctgtcttttccaggctagcgcttacacatgttttatagttgcaaaacctaattataataatccgcaaatctccatataacagcatttaacttcggatgaccatgtcttggtcatacgaactccgaatcgatccgttcaagtctcctaatgtttgttataacctaaagaagattgtgctttctttttatgtattgttattgcttctttataggcttgtagttttgcttgtgtgcttcgcgtagcttctgtcgttccggaggttctcgaagcgtgggtcgcggtcatcgccgaaggttcggaaggccgttgtctctgagcaaggcaagtcacatcatcctttagcatattgaatcccagtttataaaattattttgatttaaattaatgcattattgctttatttaaattcccgcgttatcactgttttatttagccagcctatttacctttgttatgaccttattatgattgctattgttattattaccttgttcaccctaggaaaatagaaccccaactagtgggtactctatttatggttccactagtatgaacttaggtagatgcttcgctggttaattatgcagcattaggtggttttataactttagactttaggaattctcatatcacttggacactatggaatggttggattatggtggaattggacatacacctctcttcctctttcaaaacccctaaaacctgttttccggtggggtttgggtgcatgccagttgtgggaagtagcaccccggccaatataaggattaagctcgggcctctgttgtaaagcactaccgtaattccacatgtctagtgggtaaggcttagtttgtggctcagtctggttattgtcgcgtcccaaaacgactctaaaatacatcctctaaattctgcctacaataattaaaatccatgtgaaagcctccaacaattaaaatgtgcaaagttaaaagtcaaataaggcttgcaggatttttgtatatttcctaaaagcctaaaatgcgtaaataaattttagtggaattttcagagcacaaataataattattaagaaataaacaaagttaaaatgactttataaaaagaaaaaccctaaaagtcccctttccctccctccccctcttgggccggctcggcccacttccctccccctctctcctcttcccccgcggcccactcggcccctccccgcgcacgcgccgctgacgggcgggcccgcccgccaccctcgctgacgggtggggcccacccgtcatccccttcctcccgccgctcccgccgcctcgcccgcgccctagcgccgcgaatcccgccgcctcccgccgtccccgcgtgcaataaagagggggaaatcactccccgtgatcccctctccctttccccccatttttccctctctcttccacgttcaaacgggcggatttgcccctgcaaatctcgccggcgccattgatggtggccgacctcccgcgccggtttccttcctttcccggccgccctctctcgtcctggctctatttaaaccctccccgcacctcctccgtccgtttccgcctctcgccgcccttcctcctcgccggaatcgagctcacgccgtcgccctctctctccgctgtcgccgccgagctccagtccgccgccgtcgtcgccccggaccccctcccacctcggcgccgcctcctgcggcttcgccgcatccttgccgacctcgtccacccctccgtttcgctcgccgaccgccggaactccgtcgaccccgtcgacccgagccgcgccgccgccttcctccgctccagccgcctttttcgtcgtcgccgtcgacctagggtgagccgtggaccgccgcctcttttcccccttcccttcccctctctcggccaccactccgacgtgcctatggccgccgccagcgaccataggggccagggcgccgcctcccaccggctgcgcctgcttggccgccctcgggcgcgccgagtggctgccgcgtggggcccggccgtcagccgcccgcgcctttaggtgcagctgacgcgtgggacccacggcgccggccggtgcgagccctggtgcgcccggtccaccgtggaccatgaggcttccacgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatatgaactcggaattggaccgttcaagtctctaatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcctagtttataaaattattttgatttaaattatcgcattatcgctttatttaaattcccgcgttatcactgttttatctagccatgcctatgtacctttgttatgaccttattattgttattgttattatttccttgttcaccctagaataaacaaaaccccaactagtggacactctactcatggtaccactagtatgattttaggtagatttggattcacacctccccctctattcaaaaccctcaaaatggttttaggctgggctcggggtgcatggttttgatagtagcaccttggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccgatgtcctgctgctaggggctcagtcctgcctacctgtcccgggggtcccggccgtaggtggggttgggtcggtactcttgtctatggctaggatgggttggaaactatgtcacgtatttcgtccgtataccgtggtggtatgtggcacgtggctacacgtgaggaagatgtgtcttgtgggtaaagatgtacacctctgatcagagtataatctattcgaatagccgtgccctcggttatgggcaagccgagcaatgtacccaagttagtgttttaaattcttaaaacctgcttaacaactaaaatgtggaatggttggcttgggacgagctgggacccagggtcgggttgccagttcggtctgaatcatcgtaggccttgggttaaggcaggttcgtgtgggttcacggccttgtttaataatattgtatagctctggaatcgtgtttacaaaatagctttgagcaactaagtgtcttttaatgctgtttactgcgaaccctaaccctttatatcttaacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgttgtttctcgtttgtctttgtgtgtgctgggccttcgctgcccatgtaataattaactatttacgcttccgcttgataaactctgaaatgtatcaacttttggtgtatcttgcctcctgggacaaggaataatacacacacgtaaggaacgcccgttgggttaattccggtcgtgacaataatgtaaagtaggtactcatatactcagaaagtatttcaataccataaatgtatatagaagagtattctaataaaagtacaaagcttacaaaagaggaaaggaaagctgctagagccatacccgaactcttccgaaggcttccggactcctgattcctattctaattctattccaccagctagatactactaaactaaacttgagagaaatgagagagctattgcttgaggtgtgtgagtgaagtgagaaggtgagaggtttatatagcatcccaatgacggttgtgatggttggaatggtcggaaataccgtccaaccctcattgggagctaatccacaccgtccagaaaaaccctgcatccagcggcgttgagggaggttcggctgaaccccttggttcggccgaacctggggccggcccaaccagcccatggtttggcttgtggcctcctctgttgttcttcttcgcagacttgtgaattttggcccaatttatcgtgtcaattctgagttcttggcctattcacacacaagtctggttctcgacatcatccgattgatttatcgtctgagttaatatcgattctcctccactttagtgtcattccctgcaagaggttagtatacctaatactagtggaagtttattattctaacagatatatgcattgcaagcatcactagttctctcctagtttagtaatattgacggtcgaaactgatcgataacgaccgtcaacacaggatatcatttgtacaactgccataaactaaccattcccctgcagaccatagaagaatctcgtgcaggtggagcaaacagggagacgcgtaacatggcaaagaatgaacaagaaagttcatcatccttaacacccgtgcagatgtatgagaaaggttgggcaccaactagggatgcacccagagggacccaagctccacgccacagcatcggagtctaaaactgggcgagtgccagtgaggaccgatggcatgcgtctcatgacatacattgggggataaccaacctcccagatcaagtggtgtgcctccatctccttgtgaatggtgctcgagttcctcttgttgggacttaggtgaaatcactaggagaatggatacccttgatgtgcagacgggggagatccagtacaacctcacggaacacatatctcaaacgctagaattgcaacaatctgctaatgctcagttcgccaacttcaacaaaatgatgcagcaacagcacgatgaccttcaagcgtacttcctcttccaggggttcaatcattatcaaggaccctaagcgaaagccaagcttgaggtggggagacatctctccccccactgaggtaacttgtatcacattgcatatttccctttccaattgcatatttgctttacaattgcatcttataaactgaaaacaacataaaaatttgcaaactagaaaatactaaaaagataggataggtttgagtcatgataggtaagataagctagttctctttgttgaaatgatgaatagttgctctgttttatatctcttatatatgggttcgtggtaagtgctctctcaaaggttaaatataagtagccaacaattatctgggagtctgaggtaaatgagctgcacttgctgttcagagtctaagttgttgtaagatatgagatagtaaataagagttgctatgaccctgatactagtttgacttgaattccggatgttttgtttttcaaaatgataaaattgagagttgctcatttaatataaattcctaccaaagccaaaattgtgccatcatgattaaaccatatacattttggtttcttgccattccattgaactttgtcaaactcttgagacttgtgtagatacttctcatgctctatgatcaagatcatacacccacatatatgcacatgctaaactcctacactgggagccaagcaaatattccattccactccatttccatattaccacctaaataaattatccatgctttcatgagctttcttctcctaaaaagaaaagtcctttcgaaaaaaaaaagagaaggagggaaaggcatggttatgaaaagagaaaaaataaagttacgctctcacaagcatgagcatgatgttgaaaaaaaatgtagccgtgccctctcctaatcaataaaagaaggattttttgggagaagaaagtaagcacaaaggagaagcattttctttatttttcctcatgtgccatttccaccatataccacacacactttgcacaatcttgatcttaagtatgtttagttatctgctttagtctaagtttttgatttagtaataaatgagaatgcaagtatgccatgtttgatccctaccgagctccacatatcaaaccttagagtaggaatcaaaaaggcaacatttggtgaggaattcaaagtgatacacttagagagattgagtgaatcatttgaggaacttgagtttcttttgcaaaaatcatttgaaaacttccggaattagagttggataaatatcgggtgattggtgctttatttgttgttctgtctttcaaccgcctaaggcaaggagaagcagtgtctcgtgggaatcaggggtaagggtaagccaccgtgccaaagattatttaatctgagagagagtacatataccttgcacatgtatctttgagatatacagcatagtagcaactcctgatcaacaaccaagtttttgtttcctttcgtccttcactcgagacgagcaaaggttcaagcttggggggttttgttgacggtcgttatttaccaatttcgaccgtcaatattaccaaaataaaggagagctagtgatgcttgaaatgcataaacatgttagaataataatattccactagtattaggtatactaaccttttacagagaataacaataaagtggaggagaatcgacatcaacacatatgataaatcaatcggacgatgtcgagaatcaggccaaaattcacaagtctacgaagtgaagcagcggaggaggccaccagccaaaatgtgggctggttgggccggcccaccctggttcggccgaacctgccgtgaagccgctggatgcagggtttggatggacggtgtggattgcttccctatggcggttgggggtattaccgacctttccaaccgccataaccgtcattacctgcctatttaaggagttcactctcttcacttcaacacacacctcaagcaagagctctctcatttctctcaagtttagtttagtagtatctagctggtggaataggaatatagtagtaatcaggagtccggaagcctttggatagttcgggtatggctctagtagctttcctttcctcttttgtaagctttgtactttatttagaatactcttctttatacatttgtggtattaaaatactttccgagtatatgaatgcctactttacattatgttcttgttatactgaatatacggctagcttatctgggagatgctttggtgcgggtataatatttgcttatgaaattactctatgtcatgatgatgatattacactacaagaaatatgaccttctatgaagaattcctcgtgacatcggagctattcgtcattagcacattccattttatgacgattagtatgagatggggtggcttagtgacgaaaaaaatgtgttcgtcgttaatgccaactagaaatcgtcataaattatttcaatgggacgtcgtgacgaatattaacttgtcataaggggcacaaagcaaacgtcataaatatatataatgcatttctagaaaaatatactccatctatcccataatataaggcgtggttactataagatttgtagcaacaaaattataaccatatgaaagtaaatttaaatgtcaatctaatgatataatttttaacaattaaaattcatttcatattatactaagtgttggtcaaatgtttaaaagttaaatcttaaaatgcgtgcacgtcttatattatgagatggagggagtattaaaagttaaagcaatttaatcaagtgaataaatgaggaaaacaaaattttcctgcaaaaattatggccggaaatattttttttaatattctacgtggtctaaattattctctgaaaatttctgtgaattttcagagctcaataactaattttaatagtgagtgagcaaatttgagttatgctatcagtgctatttcaatagtgagtgagcagcaatacaaggaagatggctaaatgatttgtacctggaggacttcttgattttcgacatgggacaacgggatgttttcttcttcgggttagcttgccttgctggttttccagtcatccccttgctgccagctttttcagagtcatcattttcatcatcgctcagaactaatttcctcttgcggaagtctgattggttggccaattgagtggtgctgggttgagagtcagaccagatttttggtcctctgccagcttgaccagtttgccgacggggtgaccggcgttgagcagttggagggtctgacttcatcaaggcgaattcctaggcatgatgattcaagttttccatcaactttgtagatgataaaagcatgcttttgagaaaggttgaaattttaaatacataccggtggagggtggttgaaggcactgtatggcaccactggcagcaagtgcgaatagcttactacgattgcatttgagaagatcttatacattctctccttcataaccttgaattcaagagattcaggatcttcacggttggggtcatgcttgccgtcgaattcaaaggtcgtgcgagatctttctttgattggggctagctggctcttgataaaatgccgggtgatctgttctccttgcagaccttgctcctttagtttcagcatacggtccatcagggcaagtgcctgagcggcttcctctcccattggaagtgagttccaagtgtcctgataaactggaggaagacaggagtactcggggagtgcaggctcggggttttgtacatagaaccaattttcatgccagcctttgtttgaggttttgaagggcatggagaaatacttttggctcagagttccccttagttgaaatccagccccccctactacgcatggcttgttcttgttcggttggggtttgaggaagaagatgcggcgaaatagtgcaaaatgtggtctgacgcccaaaaaagcatcgcaggcatgtatgaagttggcgatatgaactatggaattcgggtttaggtgatgcaaactaatcccataaaactctaatatcccccggaagaatcttgaggttggaagagaaaatccgccatagaagaaatgagaaaataccatgacttcatttgtgtcaggggtcgggaatgcttcgccgaacgccggacgccatccaatgatctccttcgccggaagaacaccatgtgctaccatttccttcaagctttcctccgtgatgtcggagggcgcccattggctctcgaagctttctctctcctccgccatggatgcgaattgggtgatgcgatttgctttggaaatggctgagaatggatgggggatcgatgcggtggatgcgcggatggtttatgtggaattttggaaggtggatttgagcgaattggagaaccctagttccgccggagtggttttgcactgtagtgggaaatggggaaaatggcgagagtctcggcggggaagacgaaacgacgctctgacttcggcgtttatttctctagggtatcgggagtgctaatgggcctaggcctatacagtacttcagcccaattctgttatcggcgtggctaagttgtgatccgtagggacttaggcatttttgcttcggcaatttttcctcacaacagtatggcctaatgctgttaaaatcctttgtgatgcagttagatgattccttggaattactatgatgcaaataaaaaaaggtacccgacaaaaggtgttatacttcttttgtaagcctttttaggctgcaaaggctgtttgggttttgttgagatgattggtttttgaacagtcattctctcggcatgttatatgcttattttttattatggcgtgagtatagcctaggctattttgactcattaattgtcgtgatatcatatttataccacatttgatggatctttgagagtttttactcagattcttgtcatatgtgctgatttatggacctttggagtattttttactcgggcctctttacgtcttcatttttggtatattaaagctaaagcagtcggctcgatgttttattaagcgctgcatatgcttagctatatgatactctggatgatacggttgtaaaaccactcggatggatgttatttgcactttgactatatgtttagcttttagctactcacatagtcgggggctacacctaattaggtgcatctattcgatgcacctgattatttatttttagcccttcacagtctttgattttggtactcgggagatcaatgcagaagaaattgaagcactcggattatcattttgtgctacaagaaaagactatttcatcgactgtaaaggtctcagaggctactgtggagattatggataccccatacctacacggcatgtatagtccgactgggtatgaggtgccatgtatagatagaatatctttaagaggactcgggttaaattctaaacttgtatgtcaaggaagtacctgagatcctagtcggttacgattgtattttatctgtaattacatattccgttagggatatgaactgtattttataatatggaccccttcccctatatatggaggggtccgggtgtctctaggggcacgatttttcacctagatcatacgatcaataatactctcggcggatcaatccccagacaggagtagggtattacttcttgattaagaaggcctgaacctgtacaaaattccttgtctctaaacccatccacttttccagcttgatagccacccccttttagtattgcggaaatcttgtttcgacactgagccacttcgcccgagcttcatcaacctctgtagatcaagaatcccgaaggaaccgacgcgaggtggaccacggaggaagatcctcttcttcttccccaactccggccgccgacgccattcctttatttctccttctctggtgagcttcggtgcaaatatttttcgcctagagctaccttgtgctgatctaaaccgaagcatgcaccctccctatgcagtagaagcccgggggtacaccgtcgacgacgaccgtagcagccgcgccgtcgccgaaccagtacaccatcgccaagacttcgtcgagccgcgtttgcttcttggtgagcctcctagtagtccctagagtccttaccatacgcatgcacgattagatcgagcctcaaaacccacatgcatatgcaagctgtgctttgccgccgcttctaacactctaatagccgctatagagcacgaaagcttgcactaaagccaccaataggttcgcacggtcgttctctacacttttagttttgggagcttgagctgaatcgccgccgttcgccgccggtgatgctgtgaagctcgcggctgtgctgctgctctgctctgctctgcccagagcaagggcatgtctcgtgaaatttaaagactcccagggatgaaatggcaactcaaccaaaaacttacatgtaggaccagtactaattcgtaaataaattaaaactcgagagtctttttgcataaaatcctaaacaccgtactaggggctgcgggatctatttcccgagaacccaggggcttatgcgcaaaaccgtagtcgctgactggtggacccgagagagtaaatgatttgagaaaattggagaaaatacaaaccttgtttcttatcaactgaaaaatgacagaactttagaaatttgtagaaaattcatcctaactctaaaatttgcaaactaaattttgttggaataatattttcatgctttgcatcaaaaaaatggttagcttaacagaatcataaagatttatgtctcaaaaatccgaaatgcatgtaggtctatatttaacatgtagacactttaaaaatttgtaactttaaacgaaaattattaaaattaaaattctttcactaaaaatcaaattaacacagatcacaccaactccataaaaagcattcattttagagcatgttggatttttatgtatgttttaatttcgattttgcatatgtatgtttagacgattcgcagccgagtcacgaggaaacctacctttaagctgagcaaggagtggaagagcaaggcaagccacctcccctctttgatcacattgaacctatgatttggaggtttttgaaaagattgcaaaatatgcatgtctattgtacactaatctattaaaatcttgtaaaatttgttagatcaactccttaacttgcattatcacctaaactccacaaaagaccttaaccattattccaaatcttaggaaaaattcattgtgtcacattaagaatgatgtttgaggtcacaagtctataaaaatgcttagccatgcttagtgatgagtttacttaccgtttgggctcaattacatatatagaatgatttattttatgatctgaattaaaatgttaaaatgtgttatttgtcaaataaaatgatggaaaatatggatttttaggtttgggcctcatgtggtacacatatggtgtttagttgtgttctgatagggggagagtgtgtccagaccgacctaaggacttcacccagcgtcagttcatttcgtatacagtacaaccacatgtgctagtatgggatagcccaagcttagtaaattatttacggtttagccttacattctggtaggccggtgtgtatgagttagtcaataattctgaggaattagtcgttgattcagaggaacttcctatttaccccgacgtggtagtttaggtgactaagtctgtccaatacaacggtatagtgccacgtggtgggttcccgttgtgtccgccaccacggcgttaagtttaaggcgtgggcctgccacctaacggttctaagtcatatatcgagtatggcttaggatggaataacacatatcatactggtgtaaggctaaatcatgaatcttggaagggctttgttgtgagtaataaatcgggtacttatgtatcgcatgccatgctctttcatgattattatttcgcatcatgtgggtaaagtgtacgtactctgcagagttaaaactaatcaattagctgtgctcatggtcaagagaggcgtatgaatatgtcatgagtatagacctgtattttattcttctaaagctgaatttgaacttcaaaatgtgatctgatttatggatttttgtccttgctgccatggaaggcaataaggagctatgttctatgtggttaacatctattttgatgcccatttgctaagtgtatgcttgctgaaatttaattgaaaataaatctgaatttgaaatgttctttgcaaactaaatttgctttatgctaaaattatcccatgtaagctttactttgaatatgccatgcatgtagagtactaggcttgcttggtgcttgccattacaatttatttgtactgactcttgcttgtattgttgtattgttgcatgtttagatttggttgcagctgagatcactcctgaggaggatgatttcaatggggatgtctctttcttccaggatggttcttactagggtctaccctagtcggttgtatgaaaagtcttttgggtagaaaatgcttccacaaacctaacttttcggccaatcggccatatgtatctaagttataagttgtatgaacctaactaaaacttagaacttagaactctctatgttgagatatcatgtgcttggataaaagtgtttagtgtgttccttttgttagggacatattaaacatgagtatgagttaaagatatttgagatgtcgtagatctttagccatttttgtcaagtctcctgaatgtgtaacacatctggtcgccgtcttcgagtggtttgacaggcacatctcaggctgaagttgactggctggctaaaggcccagcaatgtctcacatatctttctcttggagcgtcgaatgtcttaatatgtttgatggaagaattgtgtttagctattcatccttcaaatatacaaaggggttcggagtgcttccgacagctgagggagaggaagggagggggattgggccgagcccaaaggagggaggacttgggccaaaaatggcccaaggcaaaggagaaggattttaatttgtttttctttttatttaattaattaatttaactttgtgactttaaaattatttcttgagctcctaaaattcacggaaaaatcctgagagtattttagggcacaaagaatattacaaaatattctcggccaatgatttttaaaggaaattttaatttcctctataatttcacttgattaaattgatttattttttatttaatttctagaaaatgcattatttaatggtttttaattccgaacgaaaatcagggcgttacagtttgtagctcagtctgggaatgaacaaaaggacacggatagggatggatgaagtcaggttcgatggatatctctagggcaaatgaaggctacacgggcggttgtctggtagtcgagatgtcatggcataggacaggcattgggaggtcactcccgagggatgttctgatgctaggggctcaaccatagcctacctgtcccgggttttccggccgtaggcgggcgttgggtcagtattcttgttcatggataggatgggttaggaactatgtcacatttttatgatgggttccaaggccatggaatgcggcgcaaagatgtgtcttctgggtaaagatatacacctctgatcaaagtataatccattctaatagccgcgcgctcggttatgggcaaacctagcaatgtacccaagttagtggtttcacacttaaaaattggttaatcaactaaaacctggaatagttggcctgggttcgcttgggacgggctgggacctggtttaggttgccagttcggtcaactcatcgtaaaccttgggttgaggcaggtttatgtgggttcacggccttaattaataatactgtttagctctagaatcgtgtttgcaaaatagctttaggcaactaagtcacttttaaatgctgtttaccgcaaaacctagccctatattattactcctttgtaaccccttgcattaatcatgcatgtcccgatgtgtcttgctgagtagtgtggttgaactcattcttgctcaatctttcctcccttcagtaagagaagctttggagaagtcctaggtggagtcttggcttataccccagttgagcgcctttgaagatggagccgtaggcccgctagtccactgctatttatttttggttgtcaggcctgaagtgcctttgtaataatgtaaatattatcattataataaagatgtgtcttttgtatcatgattgttgaagttaccttggcttttcctgggacagggatcaatgcactagtgttcaggagaggcatatttcccgggagcgacatgaggggataactctcgctttgatcgagtgcgacgtttacgatatggcaaccaaccagaacaagtccaggacgccatgtaatcgctacactataaacgatgtcgtatcaaccgtgacgcgctgttgatgatccctgtaatgcaaatgagagaacactgcaagaacaagataagatgcaatctaaatattatgaataggtgattaagaacaaagaaa

SEQ ID NO: 9045 - DNA, 19786 bp, Oryza sativa
  unsure (1)..(19786): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccgacttcgtcactgagtggactgagtgccaagaagacatgtgtcatgcccagaaattcacgaaccagaatttcgaagctgaatgtgcattaaatccctgtctaggaccagccagggtacacaaacgacaatttttgacatacagatccacgtcttacaaaaatggagatgattacaaatgcagcagaaaagaaaaacgagctagacttggaaacttgacttctgcagcggggtgactccactccacaggtaatccttgacgacagcgacgaaatcaacttcggtaagacacttcccactaggaagatcttcagctctggtgtgggggaaaagagagcaagactgagtactaccaactgtattcagcaagtcataccggaagaggaggtatgatgcaggatataaccgaaggaggctaaaggctctttgcacaaagcaggcatttaaaaacagtagttgaaagcagtaaaacagttgtagtaattaatcaatattaaccaaacattgtccaacgctacaccacattgcaataggcccaaccaaccacctgaactacaccagttcattaagctaaactaggggtgagactaatcacggtaaatctggttgatcgcccataaccgcgggcacggctattcgaatagttttactctggcagaggtgtacaactgtacccacaagacacgattccacacatgtcgccatgccccgaagtatcaccatgacactgcaaagggggaaatcgtgacaagaccctcctcataacccttccctaaccatccacaccatgctaaggtttcacccccacccctcaaaaggtagtgggcggtcccctcttgtgccgcggtgaatccggcagctagacaaccggacaccccggccgacccaactccatcacgcccaccctcgccaccggtgcctaggaaagggttgagctatacctcagatcaagcagttacccactcccgcttgtggtaagcacggtaagtctcccagtgtttcccgtgaaccggtccttaattgccatgggtgcgaccagcaaaaccatgcacgcacaacccaccattcagtgtattttaaataactaacaccattgcggtggcaccaaccagaactatgctcatagtcaaaattgaactatgctcatgtaataatgtgatccccttttgtgtactagttgaactaagcatggctaagcatttcctaaaccaacatctaatcattttgataccccagttatcaatggcatatggtaaacgatatatggctgagtaataggacccatcccacatgacattgtaaaagagtgcaacaattaatagaaatgcaaggtatttgtaaattgggtacaatatgatcaaatgtaaagcatgacttgcctgtctctcgcactgatgagacctcagcaacgtcttcgagaaaccgcggatcgacgaaacggccgaaatctacgcgacaaacaaagcacacaagcaaaacatgctataagactactgaaacaggaaacaaaatcattttaatggattctttgcatttttatgaatttactgagacttgaatggacttaaacgaagctcggatgaattacatatgaattttagaagataaactgtgtttttactaataaagaaaaagtccttaatcaatttattgcgctgtaaatcccagggctgacgtcatccaaggggggaggggcggctgcgccgacaggagggctccgcttgtcagcgcacaagggcagggagagggggctcgggcaagtgggctccactggcagcggcacaaggtggccggtctaccgtggaccgggaccacgcaggtggtccaccgccggtccacgggactgacaccggatcggcccgagaccgatcggacggcgcgggcggcggctaggcacggctcggctcggcacaaagccgaccgaccggccatggcgagcggcggcggcgtgcgcggctgccgacggcgacgaccggcgaagggaggcggcggcggacgacgcgaaaggcggcggcggacggctggagcggcgacacggccaaaggcggcggcacagccaaaggcggcggcgcacgcgggaaggggagaaaagggagggggagggagtcgtcaccggaggggcggcgaccggagtgggaggggatgagcggcggcagcgcttcggaaaacagcggacgggagcagcgcgacctgggaaaaggcggtgaaggggtgagggagaagagaagagccgcggcacggcgagaagaaatggccggagatggaaacaatggcgagctcaccggcggcgcgaaggaatcggagctccggcggtgattcgcggcaacgaagcggcggcagaggtgcgggtgggctcggtgagcgcgacggcggcgactgcacggcgcggcggcggctctagcagcagcggcgcgcggccggagataggcagcggcagcggctaggcgcggcagcgataggggcacgggagagggcggcaaatgggggaaacgatagagggagctcgggggagtgatttaaaggtgcgggagggggcggacggggccgggaaggtggccgatttggccggcgacatgggggagtggggaggaagagagagagggggattcaaattgaaccctgcccactctcgggcgcgcgtgggggcgggagaagcgggggagggccggcgacgtgagcgcgaggtgtgggcgcggagtggaggcgcgacgtggagcggagaaggcgggaaacggcggcggcgtggcggtttcggcggcagcggcggttggagctccggctccaacggccggaggtaggagacgaccgataggtggggcccacctgtcggcgtcccgagagaggagggaggggcggcttgggccggcccacaaggagaaggggctgcgggagagggataggccgacggcccaataaagaaaaaggagggaaaagaaaagaaaaaagagaaaaaggattttcctgggactaaaaatattgcacttgctcaattttaattggttaaaattatttccaaggctctgaaaatttccactaaaaatcatgttaatgtattggagcatggggaactcaagaaaaattccaccacgccgaattcgattattaaatgcatttattaattagggatttagctctaggttaattaagataatttcttcgggcaatttatttaaccaatttttttaaagcaagaaaagggggggaaacttcagggtgtgacaaacctacccccccttaaacggaatctcgaccccgagattcggaagaattggtgaagaggtgcggatgggcggtctttaactcattttctctttcctaggtggcctcttcttctgagtgatgactccactgaaccttgcagaatctgattactttgtttctggtccttctctcgctagtttcgaggatacgagtcggcttctccacatacgtcaagtctttttggatttcgatttgatccggacttgcctgttcctcaggaactctcaaacatttcttcaactgagagacgtggaacacattgtggatgccaagcatgttggagggaagctcaagctggtaagcaacttcacctctacgttccaagatcctgtatggtcccacaaagcgtggtgccaactttcctttggtttggaagtgatgtactcccctgagcggagtgacacggagatacacataatcctctgtttcgaaaatgagctctcttcggcggttgtctacatagcttttttgtcgacattgtgcgattctcaatctttccctgacagctctgactttctcttctgcctcatttaaaacttatgtaccaaacaactggcgttcccctgtctgatcccagaagagcagagtacgacacctccatccatacagtgcttcaaacggtgccatctgcagactagcttggtaactgttattgtaagagaattcagcatacggcaagcttttgtcccatgctccaccaaagtcaagcgtacaggctctcaacatatcctctagtatttgattgtcacaccctaaaaattcaaaatatataaattgttgtttaattagaatttttagaaatgattttaaaaaaagcctagaagagaagatctaattttaattaataaattccaatataaaatggggccagataaaatttcattaaatactttgcttaattctataattcctagatttttctgggatttatttgagctaaggaagtatttttaataaatggaattgtatttcatgaataatttaaattgaaaaaggtttttaaaagtctcttttgtctttgggccgaaagtcagcccaaaaaccctctctctctctccccggcccaagtcggcccagttcgcagccgcagccgcccgcgcgagttcgctgccgctgacaggtggggcccgcctgtcggagtcgtcgtcttcctcgcgtcggccgccgcccgaaaccctagcgccgcgccgccgtcgtctccttccaaattcggtcgcgtctttcccgatccggtgaaatcgatagaagggaaatgatcttcgggatctcctctaccttttctcttttggaatcatcctctaaatcgctttggaaattcgtggattcgaggtcgaatcggatcggtctctttcctccgaaccccgacctttccttctcttcgccggcagccgtgggccttcgccgccgctctccaacccctttaaaaggatccccggtgtcgccgctacccgtcgccaccctcgccttcgtctctcgtcgtccgtagcgccctagcgccgtgtaacctcgagccgccgtcgccgccgtcgcttcagccgtgcgccgccgccgttccggtcgtcgtcgtcgctcgggaagatcgccattgtggtcgccaagtcgccgccgtcctcgtccgccccttcgccgtcgcggtagaccgccggagcatcgccgtcgtcgtcaagccgaaggactccgccgccttttcctcaacgccgccgccgtccgttcatcctccgccgttgctttggtcaccggtgagttcgccgcgatgcccgcatcgtcctggtgccctccgttcgcgtcgtcgtgccgtcgttcgccggcgagcatgcgcgcccgagccgcccgagtcgccgccggtgatgacgtcatcgccgacgtcatcgtggccgtctgccgtgagccgccgtagatccgctcgatctcggccgtccgttttggatggatcaatctcggccgtccgttcccgtgaaccgctgccgtgcgcccggtccaccgcaaaccctagccgctgacgcaataattccctttttccttttcaaaaataattcattattgcgtcataattcaattaaaatctatataagtgttttaatccgattaaatcttcaaaaattcatatgtcgtatactcaccttgcaatcattcatcagaggaagagttctacaatgatgctgatggtgtggaggattaggtgtagccctagtcaagctgcctgtggagtggagtcgtctgcgccgtttatcttattttccgctgcttagatctttattgattgagaggaactatctacctctgtaatgacattttattcgcttattaattagagtaataatggtactctattatcaatttgttattgtgtgcctcggctgattcctggacgagggtttacacacatgtaagcgtttggaattttggatagaaattccgggcgtgacattgattgactcgctcggtctagccatctgtttgtggatggtaagcagtgctgaagttcagaagggttcccaattcctcttgtaatttctgctagaactttgaagtgaattggctccctcgatcagacactatcttcttaggtaccccatgtaaacacatgattcttgtcagataaagttctgctaacctcttccctgagtaggtagtatgcaccggaatgcagtgagccactttagtgagtcgatcaacaactacccaaatagaatcatgccccgatgacgtcctgggcaaacccgtaatgaaatccattccgatttcttcccacttccattctggaatctgaagtggctgtagcaaacctgctggcctttggtgttctgcctttactcgctggcaaacgtcacagagtgcgacgaattcagctatttcccttctcatgttgacccaccagaatttttctttgaggtcttggtacatcttggtactgccaggatgaatggaatactgagtttgatgagcttctgtcattatcaagtcctttaactccttgttttcaggtacacacaatctttcccccatccagattgttccttgttcatcctcaacaaaacctcgggcttttccaactctcatgttctttttgagctctgctattttagggtcacttgcttgagctatgcgaacctgctccaccagtgtgggttgtgcctctagggcagccacgaatccgtgctcaactataccaaggttcagatgttccaaatcacattgaacctcacaacatagttgctctacccatgcaacattgcagtagctcttcctgctcaaggcatctgcaaccacattagccttgccgggatgataatgtattcccatatcataatcgttgattagctctaaccatcttcgctgtctgagattcaaatcaggttgagtgaagatgtactttagacttttgtgatctgtatatacctcacaacggttaccgatgagatagtgccaccaaatctttaaagcatgaacaactgcggccaattccagatcatgcgtcgggtagttgccttcatgaggacgcaactgccatgaagcataagaaaccactttgccatcctgcatcaacacacatcctagcccctgacgagatgcatcacaatagacctgtaaaactttcgtctgatcaggcaggattaagactggtgcagacaccaaccgtcgtttgagttcttcaaaactcctattgcattcagcagaccagataaatttttcttccttcttcaatagctgtgtcattggcttagcaattttagagaagttctcaatgaaacggcggtaatagcccgcaagtcataagaaactctgaacctgagtgactgtccttggtggggtccatttggtaactgactccacatttgctggatccacagctactccttgagcattcacgatgtgaccgagaaactgaacttccttaagccaaaagtcacacttgctgaacttggcatatagctggtgctcttttaacttttcaagtactagtcggagatgctgctcatgctcttcctcggacttggagtagataagtatgtcatcgatgaaaaccacgacaaacttgtctagaaattccataaacaccttgttcatcaaattcatgaagaaagcaggtgcattagtgagtccgaaagacataactgtgcattcgaacaacccttaccgagcgatgaatgctgtctttggaatatcctcttcgcggatcctcaactggtgatagcctgatcgtaggtctatcttagagaacacagtagctcctttcaactgatcaaacagatcatcaattcttggcaacggatacttgttcttaatagtgacctcattgagtgcgcggtagtcgacgcacatccttttggttttatctttcttttccacaaagataactagagcaccccaaggcgacgtgctcgggcgaatgtatcccttctgtaactgttcatcaacttggttcttgacttccgccaactcgttggctctcattctgtaaggcctcttgtggatcggtgcagttctaggtaccaagtcaatccggaactcgatatccctttttggtggcattgttgtcagatcatccggaaaaacctctggatactctctgactataggaatatcctccaacttcttagtggttttctccactgctacctcttgttcttcaccagcagcctggtttaaactgatccctggcttctgcggcactggagactggaaggttaccacttctcctttcgcattggttaacttgatggtgcggctagcacaatcaatcactcctctgtaccggtcaaccaatccattccaagaatgacatcaaggtccttggactcaagaagaatgaggttggctggaaaaatcaacccttgaatttcaactgtcattgatgggcagtagtgagttgtggtcatgccacctccaggagtatgaactcgcattggtatcttaagcttcactaaagataacccatgcgcaccagcaaaacgcttggaaatgaaggaatgagttgcaccagaatcaaacaatattactgccggtgtcgagttgacggggaatgtgcccaatataacctctggtgctgactgcgcctcctctgcagatgcatgattgacacgggcctgaacgaacttgagtctggcacgtcttggcttcgggcacatacgtaccatgtgtctaggctcgttacaattgaagcagagttcgggcttttctccaaactttttgggctgttcttgctgagctgactgaactgactgagctggaatcattagtggacttggagtagggttgaggctgtgctgctcactatttctgtgactgccactgttgttgatgctgttgaaattgtccgggtggtaaggacgatggtgccggataatcatggtggaaggtccaccctgatgtcccatcgtgaagcgaggcttctgactgttcccctgggaagttctgaactaagatgccttcctttttcggttcattttgttaccctgctcctcctgacggatagctttgtctaccaacttctgaaagtcctcataatctcgggagatcaactggttggtcaattcatcatcaagacccgacaaaaacttctcctgcctctcggcatcagtgcgcacgtcctcaggagcgtagcgcgcgaggcgattgaactcatgcaaatactctataactgttctggttccttgttgcaaggaacggaactctctcttctttggtgccacaattccctcgggaacctgtgctttattgaaactctgacaaaactctgcccaggtaacctctgtcctagctggacgggtccccacgtagttgtcccaccaaacagaagcgggaccttgcagctagtgtgtagcaaaagcaaccttctcttggtcgttgcattgcaaaaggttcagcttcttctcaatagcatgaagccagtcgttggtctcgattgggttggtggtacttgagaaagtgggcagtttgacatggagaaattctaacagtttggattgaggaggtggaagaccaaactgcaggttctgctgctgctgttgtgcttgctgctgcacctgctgcaacacctgatggtactgttgttgcatctgttgcatcatcattgacatcatctgagtctgattgtccaacacctgagcgatcgttgggttctcgggcggtggagatggactgttgtcagatgcactgttggcacgtgctccactaatctgctcttcgctgccactgacattgctagagtcacgtgaaccattccttgtcttcaccatctgaagggggataggtagaaatatgagaaaaggaagaaaaacagggggctcagaaactaatatttcttataaatttaggtgcaattatcttaatcttgattaaaacactgaaaaagaggcacgcaactcttaattaagtcagccataccactcacacatgatatcgaccgccaactaacccacaagcaacaaacctaagcacggaaactagcaagcaaacaaaactaagaagacgataaaactaagggcggcgactctgaagctcggagcggcgattgcaatcgagggataggactgacatctaaagtagacaagggataagaaccaattcatgctaaattccaaattaaacaaagcaacaaatgactcaaataaataacctagcatgactgatttttatgcatagaacgtttttcatgaacccagataaagacactaatgcaactgactaaacaataaattaatgcataaattagatgcatagaaaataatgcgcataaaattgccccatcgaacatagacacgacctaatgcatatcacctgatagattcccgactgactgtcaaataaactccaaataaaattttactaaaaccctagactgagctaattttaaagatccgatccgaatgaaggaccaagatttttcccacaaaccaaagaggcaaaacccaaaattttcccgaaacaaatccaagtgaaaaaggcatatgcatatgaaaaggggttcagagggctcttaggtttccagttggcttgtcctacggtcagtctcggctctgataccaacttgtcatgcccagaaattcacgaaccagaatttcgaagctgaatgtgcattaaatccctgtccaggaccagccagggtacacaaacgacaattgttgacatacagatccacgtcttacaaaaatggaaaagattacaaatgcagcgcaaaagaaaaacgagctagacttggaaacttgacttctgcagcggggcgactccactccacaggcaatccttgatgccagcgacgaaaccaacttcggtaagacacctcccactaggaagatcttcagctctggtgtgggggaaaagatagcaagactgagtactacccactgtactcagcaagttataccggaagaggaggtatgatgcaggatataacctaaggaggctaaaggctctttgcacaaagtaggcatttaaaaacagtagttgaaagcagtaaaacagttatagtaattaatcaatattaaccaaacactgtccaacgctacaccacgttgcaacaggcccaaccaaccatctgaactacaccagtttattaagctaaactaggggtgagactaatcacggtgaatctggttgatcgcccataaccgcgggcatggctattcgaatagttttactctggccagaagtgtacaactgtacccacaagacacgattccacacatgtcgccatgccccgaagtatcaccatgatactgcaaagggggaaatcgtgacaagaccctccgcataacccttccctaaccatccacaccacgctaaggttttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattccagaggtagatagttcctctcaatcaataaagatctaagcagcggaaagaagataaacggcgcagacggctccactccacaggcagcttgaccagggctacacctaatcctccacaccatcagcatcattgtagaactcttcctctgatgaatgattgcaaggtgagtatatgacatactcaacaagtcacgcagcaaatatgcaagtgcacaggataccaaaggatggcatagtagggtttcatttgcataaacaacatttaataaacatttcagaatttaataaaacggttaagtaataattaaacactattaatccaacgctatacaacataccctgttgtataggcccaaccattctgaacaaccatacccggctgtacagatctatctccaaaccaggaatataccattccaaaccaggagctaaacaaattattaccatttatagcatctgttatcatgatgagaggtgtgagactaatcacgaaagacattgttagacccgcccataaccgcgggcacggctattcgaatagttttactctggccagaggtgtaccactgtacccacaagacagccccacaacatgtcaccatgtgcctcaataccaccacggtacctcggaaaggagctgtgacaatacccctcgcacaacacaatccaccacagggcacctttcctggatcataatcaccccgttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcatgtctctcaaaaccatgtgctcacaacccaccattatcaagttttagttggcaagtaattaattaaccaatcacgattggccatcgtgagctatcattaagccatcattaaataatagtgaatcataagttatcccaatagtgtgctaatgtttctaagcatggctaagcaatcatatctaatatctagctgaaccaatatatatatagcccaactagtcaagttataaaaacccaaggtatcaaggaataaagtaatcaagaacaaaaggattataacaaacaataggttaattccacccaatgacattcgaaaataaatgcaatagttgaatagaaacaatagctttaaacgggatcaacatgctcaaagggttgtttgggatctgtgtgacttgccttgctggccctggaactcttcaaaatcttcccctgcgaaaacggactctccggaaacgtcggaatctaaacagaaaagagcaaaatcaccaaaacagcatataaacaagcatgaacagtacatgtggatatttttaacatgtagatctcaattttagaaaaatttagagacttgaaccaactaaatccgagctaagatgaattagttatgaattttcaaagattaaatcgatttaaatcacttatatggattttaattgaattatgacgcaataatgaattatttttgaaaaggaaaaagggaattattgcgtcagcggctagggttgcggtggaccgggcgcacggtggcggctcacggaaacgaacggccgagatctttccatccaaaacggacggccgagatcgaccggtccacggccggaccacgagagacgacgatgatgacgtcagcggtgacgtcaccaccgacggcggctcgggcttgcaaactcgccggcgaacgacggcgcgacgacgcgaacggagggcaccagcacgtagagggcgacgcggcgaactcaccggtgaccaaaacggcggcggaagatcaacggacggcgacggcgtcgaggaagaagcggcggcactcttcggcttgacgacggcgacggtgctccggcggtcttcagcgacggcgaaggggtggacgaggacggcgacgcgacggcgaccacgacggcagccttcccgagcgacggcgacgactggagcgacggcgacgcacggctggagcggcggcaacgacggcggcgcgaggtctcacggtgctaggacgctaccgacggcgagaggcgaaagcaagggtggcggcgggtagcgacgggcttggggatccttttataggggttggagggcggcggcgaaggcccacggcgaccggcgacgcgatggaaggttagggttcgaaggagagaggccgatccgaatcgaactcgaatccacgaacttccaaagcgatttaaacgatgattccaaaagagaaaaggtggaggagatcccggagatcatttcccctctattgatttcaccggagaaggaaaggggcggccgaatttggaaggagacgacggcggtgcggcgctagggtttcggccggtggcggctggaggttgacgacgaccccgacaggcgggacccacctgtcagcggcagtgagcgctcgcgcaggcggctcggctacggactgggccgacttgggctggggagagagagagaaggttttgggccgactttcggcccaaagccaaaagagacttttaaaatcctttttcaatttaaattattcatgaaatgcaattccatttattaaaaatacttccttagctcaaataaatcccagaagaatctaggaattatagaattaagcaaagtatttaatgaaattttatctggccccattttatattggaatttattaattaaaattagatcttctcttctaggcttttaaaatcatttctaaaaattccaattaaacaacaatttatacattttggatttttagggtgtgacaggtttcacccccacccctcaaaaggcagctggacaaccggacaccccggccgacccaactccatcacgcccaccctcgccaccggtgcctaggaaagggttgagctatacctcagatcaagcagttacccactcccgcttgtggtaagcacggtaagtctcccagggtttcctatgaaccggtccttaattgccatgggtgcgaccagcaaaaccatgcacccacaacccaccattcggtgtattttaaataactaacaccattgcggtggcaccaatccagaactatgctcatagtcaaagtctatgtaataactaagcatggctgagcatttcctaaaccaacatctaatcattttgataccccagttatcaatggcatatggtaaatgatatatggctgagtaataggacccatcccacatgacattgtaaaagagtgcaacatttaatagaaatgcagggtgtttgtaaattgggtacaatatgatcaaatgtaaaggataacttgccttgctctcgcactgatgagacctcagcaacgtctttgagaaactgcggatcgatgaaatggccgaaatctacgcgacaaacaaagcacacaagcaaaacatgctataagactactgaaacaggaaacaaaaccatttttaatggattctttgcatttttatgaatttactgagacttgaatagacttaaacgaagctcggatgaattacttatgaattttagaagataaactgtgtttttactaataaagaaaatgtccttaatcaatttattgcgcaataaatcccagggctgacgtcatccaagggggggggggcggctgcgccgacaggtgggccccgcttgtcagcgcacaaggggaggaagagggggctcgggcaagtgggccccactggcagcggcacaaggtggctggtctaccgtggaccgggaccacgcaggtggtccaccgccggtccacgggaccgacggtccggatcgacccgaggccgatcggacagcgcgggcggcggctaggcacggcttggctcggcacaaagccgaccgaccggccatggcgagcggcggcggtgcgcgcggctgccgatggcgacgactggcggagggaggcggcggcggacggcgcgaaaggcggcggcggacggcgcgaaaggctgcggcggacggccggagcggcgacacggccaaaggcggtggcacggccaaaggcggcggcgcacgcgggaaggggagaaaagggagggggagggagtcctcaccggagggacggcgaccggagcgggagggaatgagcggtggcagcacttcggaaaacggcggacgggagcggcgcgacctgggaaaaggcagtgaaggggttagggagaagagaggagccgcggcacggcgaggagaaatggctggagatggaaacaatggcaagctcaccggcggcgcgagggaatcggagctccggtggtgattcgcggcaacgaagcggcggcagaggtgcgggcgggctcggtgagcacgacggcggcgactgcgcggcgcggcggcggctctagcggcggcggcgcgcggccggagataggtagcggcagcggctaggtgtggcggcgataggggcacgggagagggtggcaaatgtgggaaacgagagagggagctcgggggagtgatttaaaggtgcgggagggggcggacgtggccgggaaggtggccgatttggccggcgatgtgggggagtggggaggaagagagagagggggattcaaattgaaccccgcccactctcgggcgcacgtgggggcgggaggagcgggggaggggtggcgacgtgggcacgaggtgtgggcgcggagtggaggcgcgacgtggagcggagaaggcgggaaacggcggcggcgtggcggttttggcggcagcggcggttggagctccggctgtaacggccggaggtaggagacgaccgacaggtggggctcacctgtcggcgtcccgagagaggaggggcggcttgggtcggcccacaaggaggagggaccacgggagagggatgggccgacggcccaacaaagaaaaaggagggaaaagaaaagaaaaagagaaaaaggattttcctaggattaaaaatattgcacttgctcaattttaattggttaaaattatttccaattctctgaaaatttccactaaaaatcatgttaatgtattggagcatggggaactcaagaaaaattccaccacgccgaattcgattattaaatgcatttattaattagggatttagctctaggttaattaagataatttcttcgggcaatttatttaaccaatttttttaaggcaagaaaagggggggaaacttcacggtttgacaacatgcccgtggagaagatgaagtattggaccatgcattttgacgggttgaagaggctttcaggcaccggagcgggggttgttctaatttccccgactggagaaagactgagctacgtattgtggatacatttttctgcgtctcacaacatggcagaatgcgaggcgcttcttcacggactaaggatcgcaatctctttgggaattcggcgtttgatagttcgtggagattctcagttggtttttaatcaagttatgaaggagtggtcctgccttgatgataacatgaccgcttactgacaggaggtacgtaagttagaggacaaattcgatggacttgtgctcacccatgttcttcgacacaacaatgaggcagccgacagattggctaattttggttcaaaacgagaagcagctccttccacgtgtttattgaacatctctatgagccaaccgtaccaaggaaagaaacaatcgaggccacggacactcaagacgtaaacatgattgaatccgactggagagagcccctcataatatttttaacaaaacaagaactccctcaagataaagatgaagtcgagcggatctccaggtgcagcagactttatgtcattcatgagactgaactggacaagaagagtccatcgggagtcctgcaacgctgcgtttctttggaggagggaagacaattgctaagagatatacattcaggcatctgtggcaatcacactgccgcacgaaccatccttggttcgtaaggcttaccggcaaggttttttctggcccacagccgtgtccaacactgacaaaattgtgcgaacatgtgagggttgtcaattttttgcccgacaaactcatctaccagctcaggagttgcaaaccatccaattgtcttggccgtttgcggtttgggggctcgacatggtcggcccatttaaaaaggcagtcggtggttatactcacctctttgtggctgttaacaaattttccaagtggattgaagccaaaccggtcatcacaatcacggcagacaaggttagagatttcttcatcaacattatgcaccggtttggggtacccaacaggatcattacggataacggtactcaattcacgggtggggtatttaaagatttctctgaggacttcggcatcaaaatttgttatgcctccgtagcgcatcctatgagcaatggacaagtcaaacgcgccaatggcatggtactccaaggaataaaagcacgagttttcgacagactgcatccctatgccggcaagtgggtaggacagctgccgtctatattttggtccttgcgcaccactcccagttgggctacgggccaatcaccgtttttcctagtatatggagtggaagcaatgttgcccagtgaggtggaatatgaatctctacgttttcgtaacttcagcgaggagcgctacggagaagaccgagtagatgatctcaaccgactggaagaagcccgcgaagcagccttaattcagttggctcggtacttgcaagggatgcgccgttatcataatcgcaatgttcgatcacgagcttttttagtcggcgacctggttttgagaacaattcaaactacatgggatcggcacaagttatctcccttgtgggaaggaccattcataatttctgaagtcactcggccaggttcttaccgacacaagcgtgaagacggtactcctatcgacaactcttggaatatcgaacatcttcgtcatttttatgcttaggcattacttttgtatttccctctttgactactaacatcaagtttttccttgagttatcagtcgggggctactataataataatggagtgtgatttttatcaattcaatttgcttacttgatttatcattgccttgtttggttttttggctcagtcaatgaagactgaaagtttttaagaacttttgcgggttctaggctcaataaggtttgacaaaaacttttaagaaatcaggagctgagtttaaatcatcaagcatagcataaattcatcagtattgtacaaattgtgcctccatcatcattatcatcatcatcatcattgttataatacaacatcaatcagtatcagttttttcatcatcggaattattagatccagtcggccggaggtcgttgtcctggaatctctcaactacatcaacgactatcttatcggcggctttctgcgcatcattgataaggtcaagggcggcttcttcgcttgtcccgtctgcaaagccatcaacggcgtcaatgtcaatcttcgggtacaaagacttggtcattgccaacgctaagctcgctcccatacttccagcttccttgatattcttaaaatatgtatccagagcaattctcagcttgtcgaagatttcggaagcatcgaatgtactcggaccattgttattgaagaacatggcttggacgagtggtgtagcggcgttggcgacttcatctctagctccctcaagcctcttaattttgttgaccaagacatcgaattgagcctgagatttgatcttgcgatctacataaatagatttatatcaacgagtgggcataaagaaaggaatggtttttgaagtattagttaccagtaccttcaacatctttcagagccaagtccctctgtcttgccaattcggcattgtctttctccagagcttggatccgcttttccagctcggatatcttggcagcttgcactgtatttcttcttgttggttgatatcacatggatggtagcataaataagtcagacaaatattgtatttaccttttgacgatccgctcagttcaaagttggagtcttggagctcagcgattcggtctctcaggtcatgctcagtcttcctggcaagctccttatatcaacataaatagatttatatcaacgagtgggcataaagaaaggaatggtttttgaagtattagttaccagtaccttcaacatctttcagagccaagtccctctgtcttgccaactcggccttgtctttctccagagcttggatccgctt

SEQ ID NO: 9046 - DNA, 411 bp, Oryza sativa
cttatgaataccagggccaaaactgttatgggctgggctggggcttgccaaaagtctatgtccgcccctgcataccagtggggtaagaattaggaataagtccactttgactcccttaaaagtgacccgaatctaatctttgaccctcgaccgcaaaaccggatagaacgactccttaaactattgaaaccgatgcaatttgactcccttggcggttttgcagggtggttttgctgatgtggcgctgacgtggcgatgttgacctagttttcgtcccacgtggtgcttacgtggtattagaattaaaaaaaatctataggacccacctgtgattcacacataaaaaatattgtgggtcccactgacatgtggggcctacatgtcattcactctctccttccccctccctct

SEQ ID NO: 9047 - DNA, 2066 bp, Oryza sativa
attcctgcagcccgtgcgtgaaagaagattgtccgtggcgtgttcatgcatataagggtaaattgaaagaatattggaaaagttaacattgtgaccgagcatcagtgccacttacaaggggtcgagaagtatcaccgcaacatcacatcagcttttgttgcaagtgagatgtacaggagtgttgtcggtaactctggctttgaaccaagagcaattattagccgcattgaagacaaattcaagtacaccataacctatgccaaggcttggagagaaaaacataaggttttagagatgcatttttgaagcatcatatgataatttgcagcgtcggttagccaccattgcctagaggaatagcaatacatactatggcgtgcatacatttccatccactgttgatcctaacaagagtgtgttgcaaagagcctttttctcattgggtgcttgcatgaaggcttttgtgcactgccggcctgtgttatgtatagatggaacatttttgatcggtaaatacagaggtcagctattgacagcgattggagttgatgggaacaatcagctgttacctatggcttttgcatttatagagagtgagaacactgaaagctggtactggttcttggacagagtgcagagaaaagtcgtgtgtatgaggcccaatgtttgccttatacttgatcgtcatgcgggcatgttgcgggctattgactacttgcagaacggttgggatgagaagggaattccagctaagtggcccgatgttcagagtcggtgctgcatgcgtcacatgggtgctaatttctacaagcaattcaagaacaagcatcttatggatccttttaagaggctctgtgcacagaatcaagagaagaaatttaatgagttgtggaataagtcggatgagttgacaaccaacaaactgacgagcaatctcgtcgactacaagctgaaggtgacgagcctccagtacctcttggtgcactacatgatgacgcacccacaatgagaaggaggtcgggatcatctatccaaaagttctctcattagattgagaatgaaccaaaggagaagtggtctctattgttcgacaccgatggttctcgatatggcataatgacaactaatctagccgaggtttacaacttggtaatgcgaggagtgcgaggactaccgttggttggtatagtcgaatttatccttcacggcgcgcaggcctacttcagggatcgatacaagaaaattgatccctcaatggtagataacaagataatatttggcagcgtagtgactaagtacatggaagataaaatagcaaaggcacagaggcatagagttgtggctcaaggaacaaaagttcatcggtatgaaataatgtgtgttgataggagcaggcgtggaatcatgcgcaagcatgccgtgcaggaatgtgtactgaagtctgatggaggatgcagttgcacctatatgaagcctaagcttcgacatctgccttgctctcacatacttgccgtggcaggagactgtggtatatgtcccgatgtgtacgtgtcaccttatttcaggaaggaagcaatctttcatacatggagtgaggagatacatgggttcgggatttcaggatcatacataactcagaggtcccaagtttttttcattcccgatccatcgaagttaagggtgaaaaaggggcggcgttagactagacgcatcaaaaatgacatgaacgagtcggaagctggtgggaggactctacgctgcagcaagtgtgaccatcgcggccatacttacaagaaatgctcgaagactgcacagggtccaagcaccgaggatgttggtccatctggagaggcaagtgatggaagaagatcacctggggaaggaacaacaagctaataggaacaacaggcgtcctcatgcggcaggcgatgcgatggtctaatagtgaaattttgctcacgcgtgcgcgtgttgtcacatcaagtgggccagatgaactctcattaagtccatttatagcactagttgcggccctatataatagacaagctgaatacaacagcttc

SEQ ID NO: 9048 - DNA, 1448 bp, Oryza sativa
ggaagctccatttcttgagccaagcctcatggtacaaactcggggcatgagattcttccaatgcgcaaaccttgatcaggtatgatttattcgttacaagttcaattaactgtactgaatacataaaacactaaccgatttctactccatcataacatcttacgtagacataccgtacattgtgcaactacattgaggtgtagatacggaggacccacaaaacgacggaacacgtccatatgcacgtagtgaattaagattggactaccttagatctctctttcatgcactaatcactaatcactactttcatgcacttacatctatttacacaatttttaaaataggaggaagttaggaaatgtcaattcgtacaatggatcgatacggtcagagttacttccattggtcaaacgataacgcaacctgagacgaccacgcaattcattcaggcatggatggagtacgaacatcaggtacaaattgcaagctttagactggaggaataatccattaggtttacctaaatggtcagagcgtccaaagtgtggttgtacagatcactgccaggtggatacctagtttgcagaacaaacaattggtaggagatactttgtctgccccaatgtagacgacgatttcgttgtacgtataacaaattccaaatttaactagcatctgcttattattactatcatatctgactaactatgtttgtttcttagggcaatccaggaaggtgcgcattcactttatggatcgacaatgtcaatcccacatatgatggccaaaagataactgagtctgaaacactggtagagtaccagcgagagaaggagcattaaaatgcaatacatgttgaacagcgcggaaggggtcggtagatacgctcaggctcgatttgtcaggactgacaaatttgtatcttttatccatgctatcttgtcattataatgtttcattattatggtgtgttgttgtatgcctcacgaattacaaataaatgggctctatcgttccgatttccaaagtttcttttacgccacgatacgttgtatccttaaaatttataagtatctgcttatatttttataacttccaccttcaattgtgtacatgattcaacatacgcgagaattatacataacttacaatttataggtaacaaaccccctcatttccccgcaaaaaaaaaaaccctcattaccctccaatctttatgaaaaattaaattattcaaattttataaaaatgtacttactttgttcgtttcaaaatgatattttacctaattttagctgctaaaagattaggtttatgtaaaacacctatttcgaaaaattttaagtgcaaaataattagatttatgtaatgaataatttgaaactattctccttctatttcgaaacgataatttacgtagtttataaagtaaccattaattattt

SEQ ID NO: 9049 - DNA, 11170 bp, Oryza sativa
cctttggaagggcgatttttaaaatcgccctccccaaggggacgcggatcctctgactttacttgctaaagtcacggtgtgactttcgaccaatctccaccgtccgactcatccgatggaggacgtctcctgcgggctgcttttgggccattaaatgccatttgattgatgatcctaaccagcgattagtgaacctaattacctaaccaatataatactacatgagattagtcagataactggaaattacttctaatctgtgtgctaaattgctgattccatgtgaatatattactgtgtaatcagcattattgaaaaatttagtgtaagcagtacatgtgattagttttctcgccagaacgtatcgattgatatattgcacgtacgtaaatgagatccctccaaacattttattacgaagaaattgtaagcgtgttggggattgaacacgggacctcggagtcaaaatcacaaatatcaagtgcgtctctatgttccacgtatatagcaatgtatttttatacatagttatttgcttaaatttctgttgttattaaaaaaatatacgtgcgttacaattttttctcgatctttcaaaattgatcgaggactttcgatccacttgattttcattttttttcatttcccaaaaaaacgcgggaaagcagctttattatttttagtcaccaaaataaaaaataatttcatgcagttgccggcctaatctctcattgagtagtattgtttagatttattacttgttgggtagaatcagtaataaaatgacattcatctgcaacagattagaggtaactagccggtcatcccgtgccttgcacgggttattggtattggtagtataaagatcaaaattttaaccatacgtttactacgttggttatattcgaattctagcatgttagattgaaataatagttaactactccgtttgtctcagaatataagtatttttagaattagacaacggttattaagaaagttggtacaattaaataggggagtgttgtggttgaaggagaagtgaagataggtggaaaaattgaatggtggaggattgtgatttgttgagaagagaatgttggtggtaaagttgttatattttgggacaaattctaaaggctagaagttgttctattttgggacggagtgaatactacttgttaattattaatttcgaattaaacaaatgctaaatttgtgatacatccaacttatttatttgatattgtggaattctggaattaattaagtatttagttgtgtctgtggtcgagtttaaatttaagtgcacccagtaattttataattttcaaattcaaaaaaaaatagttatactcagtatggaccctagaagatataagatatatgcaattagcttttttctctcgtaataataattagtagtgatgtatggtctcttgtctatctgtataaattaaagagtccacgatattgccaattgcatgttttatttttcacaaaccctaaataaactctaatgctatgattttgcgattttgccatgatacatgctttttaacgtgaatttggtcacgtctatcagatcaagcctagattgtttactcttgctgcaagtaattctcatatgaacctacgtacatgataaatatttgtttccgtgcatgattattcgcttaataggtttctagctagttcaaatagataaaccgtgtgtaggattaattctgaatttcgttctctttacgtcgcatgatttactatcgagaagaatatttatgacatcccaaagagtcaggattgctaaaattatgggggtaaaatttttcacttaatttcacgtcatgtatcctatatgatactctagtaagtatgtttctctctctctcatttccttttccaagtagataataattaaattatttttactcctaattcttataaactgtgtactaaaaaacaaaaggtaaatattgaaatttataatgtaattatttatgttatgaaatttagcgtgtaattaactacaatgcaagtgtatgtaatatattgtagttacccttcggttttcctaaaagaaattgtatctcgaaattaggctgctaaaatatacttgtaaatggagctctatatattaactgaaatacttgttaggaaaaattgatataaggactaacccaaacgaatgaacatgaacagtaagctgcaaactacatgtacatatatatgcattgcatacgggatataccgggcatatggaaaattaaatatagttgattgcattcagaaaattataatcaatatatttttatctgcttgtactgtcattaaacaacttatcaaaatcagaattgacaacttagaacttgcaagtttaatggaatagaaacacacattcaatatgcaaaagatgatcagcaaatagttgatcattccaatcaaaaccataaattgagtgcgtcctaattaaatagactgctaaatatatattgcgaattgaacacgcaaaccatgcaaattcaaaggaatacgtatatatgtatattgtagatgcagcaatagatctgtagcagacgcagtgacggatgtgcaagcaatttttttattttgtagcaaacttttttccccagaattcatttggttaaatttcgtttcaggttaaaattaatccaatctttatggagtaaaaatagtacctgctccagacgtcaaaccagagacttaacagggatgaacgatacctctggagcgagagcgatcactgattcactgcaacttttaacttctcctcgtgattgaggcaaattatcgctgatcgggaccacagtctgggatcaaggtcgacgatcgcgttcgccgtttcttctatcgcttctaaatttccaatctgatttctcacgatggaacttggagacaaattagatgggttctgtccttccatcgataactcggtagataggatttgcaagtagcccaccgagtttaagattgattggcccacaacgttaaagtattgcatgatctacggtgtagattaaaggaattatctaattgacgcttagatctttctggttaatatgagagctccaaaaaagtgcccgattagtataggtatagatatagatttttagttatcggactaatctcacgcagtattatattttatagataattaggttcattaatcgctggttaggataagcaatcaaggcatttaatggcccgaaagcagcccacgggagacgtcctccgttggatgagtcggacggtggagatcggccgaaagtcacaccatgactttagcatgtaaagtcagaggatccgcgtcctccccaaggggcggtgggcgactagtttgtaaaattttcaaacacaaaattagttttgtaaatattttaataaaaaaattaaaaataaaaaaaatcttcggaagagctagcttctgcagctacagcgtctaacgcagctaagctagcagcggctgagatatacattcttgattgacagctgaacaactaagttttccagtgccctgcagcccaactgccctaacagtgtagcagctacaaaaacatactaccgaacaggccctgctaaacacgtttgtttgcccatattgaactgactttctactgcacggtcatcgtttcgagaacctgaagtttaactatttgataggaaaagaaacatcaaaagcaatcaagagtagataacgctggtcgaattactagtgagttcccattgtcgataattaaacagagaaaaacacacgaatgcaacgctttggtccaggatggcagcttcaggcagcctcaccatccagtgtccaggataggatttcaaaaccagttctcccttaaggaaatgtgatattcttggcgactgagttcttctctcatgcgactgtgttcttctctcatgctactgactggcttattgcgttcatgtgctttgttcagcttcacatgcatctttggcctcctttaccaagtcctccagttgtttttgtgccataggaataagttgacgggcttcaaccatctcgctgtaggcattcatgaaagatctcttacggatcttcccttcatacttatgtgcatccttcactaacttcgacagctcatcttgtgtaaacatctgaaagaaaataggtatgcttcagcgattcagcccattacaaaaatgccatgatgaaaatgttacagtttaccgcttcctcagctgtagatctttctgtggggtaacatatgatcttaatacccgtagcaagtttcatcaaatcccagtctaaacatttaatgccagaccgtttctcaatgtattcaccagtccagcgcaagtgcttggagtttttcacatcacagtattcgcaatcaagcaagaagcatgccagcttaataatagagtcagtaacctgggtacaaaagagcattctttcatcactaataaaaaaaatgtaagtaaatattgcattctttgggaaaggacagttaaggattccaagtgcacattgaacaaactatcatataaatgtgtgatggggaggcattgacattaaggaagcaacttgtgaactcaccatctctggtttgacatccaaaccatagcggttaaggagcatgtacaatccttggctcattgggaggtagtcgtccttgctcaacttcattttttcttggggtactaaaacatgcatcagattcttcaggccccacatcacttccatcacaatttcatcaaacatgcagggcacactctgaaagaaatgacagcaaaattggtgctcaaggttgtccactaagaaaagcaaacaagggagctgaacactaaccaagcttctttcaatgatttctttatattcgggttttccaacggccattttctgcccagggtgatgccacttcatgatcatctcagcaaggtcgcaactgacaccagtatcatgattaatggcactggacttgtccttgatttctcgaaattccttcagccaaatgaactgatagataaacgaaagagaagaatgttaaggggcaaaaaataaataaatccagtaaataatcatgcaatgtctcccaatcatgacgcatgcaattcagtaggtacaccgcaatcagtggttcaaaaacagtggacgctaagcagctagttccaccaagcaaacctaggcatgattaggcacatgtaaattttactacatagagtatgtactatcatattacatagagcaaacctggcatattaaatcatagaaactggcatatcatacatccatgacatcaatgatgtaaaatcttcatctctaatttgccccacttctctgtgcagacccgaaacaacactaggcaggaaaacaactagatgcaatcctaggtgctatgaaagaggggcagctgggcccagttactagttagcccagttactaattttgaattttgaaaagcggtacttctcaagatgtgctgccaagaacagctggaatatttaatcacaatcgaaagatctagcctttttcaattccttaagttcttgcaatgtgattgagaataagttgttgtgctaaggtaatatacaacgcattttaaaaacaaacaaagtgatgttctttcggttaggctgtggtgttcattatcccggtaaccctggctttcggagcatgttagagctcaatcatccctatcccacagttagaaaataaaattggttgtatagcaaaggttttagcctgcaacaatccattctttaaactataacgaacaactttcaacagagcattatggaaaaaatgcattttcaatcagttgatcagcaaacaaaaaaatgaatactgagcttgtgcttgcatttcttctctcaatgcaaataaaaaggaaaatgtaaagtaaatgtggtggtcaatacccaattcaaactggcaaccaacaacgcaaaaaaaaaaggaataacaataagaagaaatgactaactttggataccctatagtccacgccaaagtttgcccagatttcctgtagttggtagagaaaacagaaaagttaggtcgatgacaaagagagaggcaatcaagcacataagtaaacagggaaggaataaaagcatgcacctgcagggcatttggttgaatgagtctgtccccactcataccgaacattgcgaagccagagggcgtctcaaacagaactaagactattagacaatggtacgtattgtgatctgcgaacacacaagccaagcaaacttaagcaacagcaagcacgaaggactgcaagaggcaacgagaggagatcaatcgcccattcagtcagcacgcgtgaagcaaagatgtggatcttaggctgaaaagccctcatctctgcgaaataaccgctacatctgccacgcggagtcaaactgccatgaacagggtgttcacagtatgcgagatcgacaacaaacgggttccgtgcatacaggaatcgcctccccagatctatctgctcttcccatgcgatgcatgtgctaccataagttaaggatccgctaggggtttgctttctcatcctcacacgccagttttccttccgacgtgggagggatcaagagagggttggtggctcacctacaccggcgattgaccccgccgtcgccgtacgagtagcactgcatcctcgcttactcgaggtcgaggtcgaggtcgaggtcgaggtcgatctctttcctgtcatggtgtgtgagattgggaccgaaggaagacgtctcaacgttggcttcctaataccggcaacagacgccgctgccggacgagaagcacctccgccgcacagattgcgagatgtgggggttggggggagggggggagtattttaccttttaggccttgttcttttaggctgggtttgggggggaatgggccaacatccccgtgtgccatcccggccgggtcgaattttcttccgtggcccatgtatgcgttcgcctgggccggggtgggagtaattctccacccaatccacaccaatcccacggggagagaaaaatcgcctcggagacgatttttttttccaagccagccgcagcgctcggcctcctcgactcctcgttgcgctagggtttggaggcggcgtgaggtccgggaggcggcgcgaggtccgggaggcggctctagggtggagatccaggagcagcatatctccagccgctgccgctctccatcccgccctcggacgccgacgatctccatccagcttcagccgccgccggtctccatcccgtcctcagccgccgccggtctccatcccgcttcagccgccgccggtctccatcccgcttcagccgtcgccgccgctctccttcccgctctccatcccagccagtcgccggcgctcgccatctctccttcctcgcttcggattcaccggttgcgggagagggcaaggtcgagggcaacagccccggacaccaagaagcaggtctgattcttgatctcctcttttcccactcagaaaagattttgtgacttatctagtggatgaatttgttgctagttgatgtattgagtggctgtatggattgaagtatcagtcatgttctgcttagaaggaggggtgatgtggtttgtagtagtagaacctgaaaccacagaaaattccatgcacatctctgtgtgtgtgtgtgcaaatcttgcctatcagttgctctgtaatcaaggaaatatatatttgaattggcagatcctatatttctgaacatgggctctcttctttcttttctttttttttgtgagggagaaacctggtttgttgattctccaggaattattgtagatgcagtgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaaatttgagcaagaagatacaaaaatttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagtttcaggaaactgggtgatcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccctgcatatttactagagtaacagaagtaatttgaagttggagagagagagagattgtaggtacaatgttatgtgatcttgctcaggtggcagatggtctcagttttttttgctagtgaacaggaggttgttattttcaagtaaacatcctaccctagaaggatatcctcactttattaaagttgctatctctgaggtttaaacaaaactaagtacacaaagtattaaaatctgaacacattattgatccccctcctcccattgcagactgtttatttgctgaaagtattaaaagtatttatgcatgtagccaccttgaatgcctctaatttcatgtttaataatcttgtaatacatatgcatattattatgttctcacacatagtttaaagtatagtaattctatatctcttttagtgataaaatcagttcgagaatggcggatgaaattaaaaggaggagagaagaggacgatgatatgatgctttttatttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgctcacaatgcaagctttcaagatctacagtatgaattcaagcatagtgggtctacacttcatcggcatattaagtctattttcaagataatcccagctctcacctatagatttctcaagcttcctcatgccaaccaaacgcattggaagattagaacaaatcctcgcttctttccttacttcaaggtgaatctggcactcaaaatagaaatgaatatctattccttctccaattaaataactcatgcatattctgtccttttcttccctttttgctgcagaattgcataggggctattgatggcactcacattcctataactatagatggagagaaggcagctccttataggaacagaaaagggactttgagccaaaatgtgatggttgcttgtgatttcgacctaaatttcacttttatctcatgtggttgggaggggtctgcaaccgatgctagggtccttagatcagcaatgaatagtggctttcaagtcccaaatggtaaattttttctagtagatggtggttatgccaacacaccacagttcattgctccttatcgtggtgttcggtaccatctaaaggagtttggacgtggtcatcgtcgacctagagactacaaggagttattcaatcatcgccatgccattctgagaaaccatgtagagagagctctaggggttctaaagaagcgatttcccatcctgaaagtaggcactttccatcggataaagaaccaagtgcggattccagcagctgctgcagtgttccacaacatgatccggttgcttaatggtgatgagggctggttggacaaccaacctgataatatagaacctactaattttgtcgatctaccagaaggtgacagtgaataccaaaatgatgtgccatctcttagcaatcaaatgatcagtgggaataatattagagatatgattgctaagaagatgtgggaagattatgttcgtaactagcaagaatagtatagataatattttggttttgcatgatttgtatttatttatgcaatcaacatttatgatatggacaaattaatagtaagcaacgtagtttgtattttctcattcaataaaatattgcaatatagttatgatgtttggaagactatctccgaaagcaagcctattgcagcagcaacaaaggcatccacaaaagaaggcatcaccaaagagctgtagcatacagaagaagaaggcttctccaaaaggtagtatctaacttgtttttttgtgaagtattttcctttcatattaatgattacaaattttacttactataatctaattttgtctaatagctcaacaatcaagagcttcatggaacccgggactagaaaaggctttagttgatttacttcatgagcacaataacccacattaccggtgccaaaacgggtggacaagtgaagcatggaacaaggtcgtcaaagaatttcgtgacagacatccctatgtcgccatgaataagcaacagatccaagataaggagaaggagttaaaacgagattataggttgcttaaggaggcaaggaaacagagtggagcttcttgggataatcaacggtgcatgattgttgccgatgatgctgtttgggcaaacataattacggtatgatattttgagcataattgttttgtcctcattcaaatcactattatttgtattcatgccataattatctgtttttgtatcttgtgcagtcaaatgagaaagtaaggaagttcagcaaaaacaaatcctttcctctctttgaatccttgggtgaactttatgatggtaaatttacttgatgccataattctttgattccttgtgcttacgttcagtgcagccaaccttgttatttgttttcttctctcgttgtttggcactgctaccttctttctttggcttcttcacatatcctgcacctgtactatgttccttttgtatgctgtagtcctcttaggaaacaacaggaacatagctgattagttatgca

SEQ ID NO: 9050 - DNA, 8253 bp, Oryza sativa
tatatactgaaacttttgtatgggtagtgaattgcaacctttttttttaggccaaactgctgagggcaacatgaatttcacttctattgagccattccaacatgctactctcacacaagtgaatgaatatcttgagagaagtgactcttttcctgatgtaaattgggttgctgatgatgatgagaccactgaagttcaagatgaagataatgcagtggagcatgaaaatcagggaagccacattactatcacctcaagagctaatggagaaaagaatgtcaagaagaccaaatctactgagagagagagagtagaaaagacaccgaagaggaataagaggaatgatgttgttgatatgatgggaagttacttggagatgagaaaaagacaatctgaggaggaggaagcaaagaagagggaggaggaagcaaagaagagggaggaggcaagcaaggttgatgattgctcaataaggaactgcatcactgttgtggaatcgatggaggagctctcaaatgaagaaaaggtcaaatcttttggagtattcaaggacgcgcagaatagggagatcttcatgagtgcagggcctatgactcgtcttatatggttaagaacgatgctggtaagtttgaattactattgttactagcataatcttaatttgtgcaattctgaaattcaattcttctacacttaaataggtacatttttttagccacgttgcactttgtttatgatgcgattgtgtaacaatgcagaccatgcaagaatgacctttggaccaaaaggatattgtctttccaggtacccgttcatacttttataattttgacatgattttcatgttatatttatgtcaggtttaggctgaagttagcataattttgacataattcttgttagtatgcctctgaacttttataattttgattcttgtcagcatgccccctctcttctgtcatgcagccatgctagtgtgtgtgcgcgcgcgccactactactagtacatatctacatcgatctacatctacctatatacattcatccacttacattccttgcctaccaccttactacttcctaaaatcaatctatctatctatttatctatcgatctatcatgcgtgcttgctgtaactgattaactggcagtgtgatcatctctctctactgctgctacatatatgcagtgctatgctgcaggtataatgtgctatgtctgcctaccacaaatctaagctaattgtgacatggtaataaagcaggtgctagagtgattctctgtgtgtatgtgtgtgtgtatgtgagtgtgtttgatgtgtaattgtatcattgcttgtgctcaacaaaaacttgagtacaagtaaccatcttctgcatatttatctaatttgattcaagttcattttacctgttgtttagtttacatattagcaatcaccattgtctagtgtctaagacttgtttctttttggttgtgtagtttacagggttccatggcccatttgctagttgtgcccattggaaggaatcttttgcaagatagttcatagagaccacttgaattgtgaaatgcgatggatgaaggacaatttttcctaactgcttcttaattcatgtagctgtgatggttgcaggaaccttttttttctacaggattaacacttgcttgatcagacatagatatattatttagtttgatcggatagagatatattacgttcaaagaacctattttgtagcttgctttgcacaatggcaattggatgtttactgcttgtagaatttaatctatccaaaattataatttttaatattctcgactatttttagaatccatctgtggtaaatccatgattttctatctttacgctttttagaattattttgcacgttgaatttctgttccattttcatgatcgttttttatcttgtcatttctgaattattttgactttcgtgaccttccagctttttaaattttatccgaattttccatgatagtttctcacgctgaatttgaatggtagtaatcccttctaatctcacctgtaatcccaccttctactccaaactgctagccaacagggaaatcccagctagcaaacaggggaatagaggccaggagattgggggaacaaggggattggggggaagggattgagtgtggggagcggggacaacccaaaccccacgtgggttggttttcctttggattatttcccacagctagcgaacaaggccttacgcgtgcggctgttgtgcttctggaaccgcctacaagccaatcgatcccactgtttgggcctgattcgagataaagggccgttttgcattgctacaggaacttattagccgtaccaatattttagtagtttagatagtacatgtgcttgtttggattgtgaccaatctatatctatatctatatctatactaactagcaaaatgctcgtgcttcgctacggttaaaatgaacgtttaaatgttataaatatttcaagaacggatataaaacactgtcgcattttgatatactcatatagtcataacgtgctctctatcaactctcacatggcaagcgcatgatatcatttacaaaattgagatggtgctcggactctaatatgtcatgtcacagaaagaaaataattacttacttaaaattattgatttttgaattatctgttgtttttcgtatattgtccgcattatgcaccacacacaatatacgtggatccacatagttgccgcgtgttgcaataggtaaacactaaattaaattaaagtgttgcaacaggtaaaaattaaattaacaaacacaaacttttctcagcatttttcatgtgatcgaatattatccgtatggttaatataataaagttaatgttaggaagagcagccagccaaccacgacacgccactcctcgcccttgcctcacgtggctcctataggaacgaagctcgggtcacggcggtatcgacgaagaatctcggggcggtggggaggtttgaggttagtcatggactgtgttttgtgggtccaaagctcggggcgatgtgtcaagtcttttggaatttttttacaattattattttttttatctcaaataaatattgaagtagaagtttcgattttttttgatgtgaagaataaaagatcttaataaaataatttattttttagctgaattaaatccatggattagcacaatctagaacacagtggcacctgtccacagctaaggttttgttcagcagcctggttaggaacccatgtctacagcacgggaaaacggaacagtacattagctcgtgattaattaagtataagctattttttttttcataaaatggatcaatataattttttaagcaactttggtatataaactttttataaaaaaaggaccgttcaggagtttgaaaagcgggcgcgcagaaatcaggagcgatgagttgggaaaactggggaagaacacagccaagtgcagccagaagctcctattttttcataaaaaataaaaataaaagaagattatttcttgtacagtactactgactactgagtagataaaattgtgtggtatggtaaattggtaatccttatcctctcactctctcactgtttcgttctctctctcccattctgtctctccctgtccctctctctttactctccaagcgttgctcctcagtgctcaactgctcacgctcttgttcaaccgggagaagatgccgttcaacgcatcggcagcggcgacggctcctccggccaagcacctggtcggcgttcggctcaacgcgatggcgtcaaggttgaggagctgatccgccgtcgacggcgacgggtgctcactctgtcgttctctctctcccatccggcgcgacgccaagggcggctactgggcggcactcaactgggagaagatgcagttcaacgcgccggcggcggcgacggctcctccgaccaagctcctggtcggcgttcggctcaacggcgatggcgtcaaggttgaggagctgatccgccgtcgacagcgacgggagcagtcgatccggcgacctcttcccctccttcacggatcccatggtctctccgctccctcttgcgcggatccgtcgtcggctgcgatgggaggggttagatccggcgacctcttcctctcccgctcggatcccgtcgtctctcagcgccccgctcacgctgatccgtggccggcgacgacgggagggtccagatccggtggtgtccactgtggtcgcggcttccctgccaccgccgcttctgcacgcgcggcccatacaccgcaccctgccgtctccttcttccccgtgttagtatgcctttcatatgtttttaatgtatttgtgctgttcttataatgtagttttgcacttatgatagcatgttacttgtgcttgcaaggttgggtgggttgtcactgtggttggagctggttgttgagctgattggagtcagagatggtggccaagatggagaggagatgtcacccgaagttgtctcggaagccgcaatgaaggttcaaatctaatatgagttttgggctatcttgggttcctttataaaaaagaaaagtgatataaaaaatattgttgagattataaaaaattgaatgattgccattatggttccattttctttttgtcaccctcttttcgatctgttaacataaacttagggtaagaattaactaaatttgttcatttttaggtatcaactgaatatagtctcatttggcagtttgaagaattttgaagcagtttcaatagcaccatccatgactgattgactgatcccatgacttataacctgcaaaatggcaggattagtagagacttgggtgcacaaattagctctttgttcccttactgcctgctagttagtgatgatgtaggaaaagaatactttggtacttgtgttatgaagtagcaacttaatcaggaaaaaataacatttgaatggtcctaatctatatacacaaattgcacttttatatacacggtccgttttgtcattactgaaaggtttataaaacaccccagtgataatgctggcagccttgatatgtcctcatggacggaaaatgaaaaaaattgcagtagtttagaacccaaacctaaaatatcaattaggtgcggtcttgtagcttagccattgccctgtgatatggacatatgttaccatgaaaggaatgaagcagttcttagataaattatattgagtgttagcttcaagcatacatggcagatgcattcctatcttaaatacattagaattggcctagattatttatcttcagaattaatctcatcctatcattatgacgatcttggtcgagtggctgactcattgctggatgatggttttcttgcaggcggagatggaggcggcaaggtggggctgctggcgttggatgttgcactcgcgttcccgcaggccacgacgtcccagttcccgcccgccggtgagacctcctctcttgctttcccggtgttctcaggttctcggtttcccattattttaaataatgagatattatgattgggtgaaactgtcttggccatctaattggagtatttgagagaggtgtgtgcactgtgcagtcggcctttgttgattcgtagttatcttcagtcttgggcagcttaatctggctccaagttggcagcaagcagtccctgttctgaaaactgctctcttacttaagtttgctgaagggatactccttacatcgaagttcattagctacacttctttggttagaaattgctctgttgctgttcaatatgtaccagcaaaataaatatgagaaatcactctagtgcttctaatagggagtcatctttcagcttctattaaacacggaacatttaagaattaccttccatcgtcgtataaatgtagtaaacgcagatgtgtcatgcccaacagggaattgagtagcgtcaagcgggagattgagtatccacaccaattattaggtgtatatatgagtcttgtttgtattttcagtttttttatataggttgagaagatgtttgcatcctacttagccatgtaattcttattcttggattctgtatgtaattcctgggttgtaattattgagccatgtaattgtatatgactctatttgggattcaatcttggtgggaaaaaaccgggcccgcgtaaaaaactaatcgcgacccaccaagaaaaaatcgaacgaaaaaaagggcaaaaaaaaccaatcggacagaaattgggaaaaaaaccgtgtgcggaaaaaaaccgggcaaaagaaaaaaccaatcggacggaaaaaatccgggccaaaaaaaccgcagccttacttattttttaagtaggtatactagcaaaaatgcctgtgcgttgcaacgggtgaaaaatttctaatgataatacacactttccatgtataatgtataatggttgtatctatcgttgttgctaagacatatcataaagaaaacctcgacgtataatgtataatggttgtatctatcgttgttgctaagacatatcataaagaaaacctcgacgatggcaatctcccaatgatctttcaatctcattcttgcaactaataataggatcaatcaaattctacactatctcatgtggtcaagtctagataaaatagagtcatcatgactcttctcttaataataattaaaaatttatttatttttttatatgatacgcaatcaagaatattagctatacttatcaaagtagtctgataattatataaagtagtctgataattatatacagaatcatgcagagtcttcaataaggggcaacataagctatgtaggagatggaaaacattaagtatcctattcgactcaagccttaagaacattcacagaacgctttagaaaaaccaaaccaatgtggtagacgatggatgatacgaacctttctcgtggaatatgaaattttttctaaaattggacaatttttttgcattgcacggtgcgaaccagattttttttataaacgcagatattttctcacgttgggtcggataaacaccggcaattttttataataaacggatgctagctcccggaagcagtatttttttataataaacggagttttttctcgggaagagtcggacaatttttttcggtttgaattttctcgcgtggattcagacagtttgttccgattcgcttttttataaacaacattttttttggacggttttatttcggagtggttttttatttcgcattgagtcgaacgtttttcaaaccgttttttttataaaaagatgttttatgtttttctcggttttttatttttttactggagtcggactttttttttacgtaggtgactttgttttccctttattacgggagtcggtcgtgagaagttttatttctctttctttattaagggagtcagatttctttatttctctttctttattaagggagtcagatttcttttacggacggaatttttttccctttttatcagagtcgggcgtgggaagtttttttttgagtcggacgttttttttttgacggacgagactttttttttttatcgatctagtacgacagtagttgtttttctcgtttttgattttgagtcggacttaaagattctggcatgcgtgcatgcgccgtggaagaaggagcaatgggattaattccgcatgctatttaattaggggtgtattagtagtatctttatggatgacttataagagcagctacaatagcaggctataagtcagctacaaacatattttaaagagataaatcagaagagagaagagcagcgggctacagatttgtagccagctgtagcacggactccaagacgcagtgtgtctatgacaggtgggactagatattaatagtgtagtatgtaactattgtatgaatgagctattagattggctatagatgaattagagctagtagttggctatactattgaacttgctctcaagtacctggtttcttttaaggaaaaaaaaatgatcgcccgtgaaagcgtggactgctgaggcgagagagcggcgcccgtctcgatccttccgcccgcccttatctcttcctttttccaagcgccatttttcctcttcctctctactctcggtcttctctcctcgctcgcttgtatctcctctccaccgctgcgccatctccacagccgacgacgccctccctctccaccgctccccctccccctccccc

SEQ ID NO: 9051 - DNA, 6067 bp, Oryza sativa
ccccctccccctccccctcccccacgggcggcacccctccctttccgcccccttcctcctcaaccacggcccacggcggcgagcagcaccctcgctcggcggcggcgccctccctctgcaggcgacgccctcccctcagccggcggcgccctctcctcggcagcatcattgtcttctccggcacagtggaggcaaccccttcccgttagtgcctcggcgataacatcctccttgcggcgcacggtggggcgctcgccaagccgccacgacctcggggcagcggcgtgcttgcctctgatgtgagcagtggcgccggtttttttgtgattttgtgattctcttgtttctttgcgtaattcttggatcggatcggatttgatctcttgttcaataatctgtattgcccgtacgggacgggtgcgagctggtcggagtgagatgcaatcttgcagactaatacggatgaaaaaattcctaggaaaataaaaaaaatggatggaagcggactttcctccttttgttttaattttttcgtcctttttggttattattacggacgaatttttttggaatccgacagatcttttttttttccacccgattgaatcggatcgatttttttcccttttgttaccgcgtcgactttttttttcgcccccgattttttttcacacggacgacggaaacatctcatactttttaagtagtagtatagtaagtatatatttttaattttcgaattaaaaactaattcattataagataagatttcataataaataaaaatctgttgaaaaaagagaaaaaaaatcgaaggcaaatataatttgacatgagggaagcaaactgtgcaagtaataaaaggtgtacaaatgagagaaaagtgggagtcgaacccgggtggccgaaatgaaaactttcatacctcaccaagtgggaagactactacatgtgggaagtgattacatggaaagtacatataccgtatcaaacgtgattttggagtagataaaaaaatatccgatcgggctgttaaccggattaaatccggatttagcgaagcgcgtggtaatgacggacgaaaaaaacatccggaaaatatatatatatatatatatatatatatatatatatatatatatatagagagagagagagagagttggacccatccaatcctactggtgaaatcaggtcagatgtaatccgaaccgtccacccatctccaccgcacgatttcaccctctccacgcgtgaagaccgagcgaagattacgggtctgtttggttgttgcctaacattgccataactcagtttgccataggtgtggcatggcaaacaaagtgtggccaacaatttgttggccacaagtgtggcaatgtttggctagaaaatgagtatatgacatgtagacccatgaaataagaaagtgtggcttgccacaactgaaacaagcaaccaaacgctaagctaacaatctgtagcatgcctaacatgtggtgtggcaatgtgtggcaccaaaccaaacagcccctacgcctcatcagtcatcaccctctcaacgcgcgactcactcctggcgttgtcgtccccttccgccgccggcgcgcactgaacgagaggcgaggtcttcccaccgctggagcttccccatccaccgcggccggccgcaggtccccatccgtcgcccggagccgacgtcgtccccaaccgccgccgccggagacaaggtcttcccgatgcgccgccgccgccgcagtccaccgctgcccatgaggtcgttcccttccgccgccgctgccgccgtcaccgcgcactgaaccggaggcgaggtcttccccagcccctgtcttcatcgtgcgcatccttgccgtgcgccatgtttagttgtcttcaccctcgacgcctcggagccggacgcccgctgcccaccaccacaccaccggacaacctctatccctgccgccctcctctccatcgtgtgcttgccttctttagcccgaggagagaggattcctaccacgtctttctgttgtgccagtatcctcatcgatgaatgattttaccacagcagcaaagcggttgccatctgctggtattatcccaggtttgcttttccgtctcctctccttctcaattcctttatgtgcccttgttcagattgcatttactttctctttctcctttctgctatcaaataggatcaatgaattgttccgtgaatgctaattatattatgagaatttttccccggcaaaaaaaaaaaacaaatgaaatctgtagcaatatgctatatattaatcttgaatttgtgagaatgtcaacattcaacctttcgactatgaccctatgtcacactgattcattgtcatatctgttgatttccaaatttgcttaatcgatacatgttaaaatgcaattccaatatatatgaaaaataacaaaattgataaaatgtttgattatgctctggaaattatacaaaatgaaaagctcaatctatatgtaaatcattgattctgggtacttattcaactacaaaaggcattgccccagatcccaactttcataactttattagtttgtcatttttgtttttgatccttgcacatgatgacagtacctctgaggtattgtttcactttcaccctaaatttacatgaaaaatcctaaatgcaatttgttttacctatgtaaatgatgcaagatgcaagtgtaggagctgaaaatttctctttcagggaccaagaagaatacaaacttaacagttaggtataatcataagattatatattgtgtttcattttgttatcattaaactgatccacatgatgttcaagtgattacacaagtgcatagattgttttaaaagttgggttcgatagatatgtagaattccatgccgccatcagtgatacctcgcaagcaagccacaatgtctgcacctaggccttcagcggctccagctactgcgtgctgcagatggtacccttccattacggtgagggggtcttctagattagctatcacggttttttttttcatgtttgtgcatgattggagtatctcttttttttcggctgtactgaaatttggtttgtgattaacctgtgaaagtatctgtttgcactgctcgatatcctttattttgaaagcgacatcccgaggaggaaggctcttgtgctaaagaaaatctttagttcctctccttccaattttttcggttcttctttttgttttgattaatgaaaccagaaattcttgaactgaaggaaaaacaggtagctctactgtgtttatggtctttcctgttgaagtaggaattcataggtgtgtggcaatgctcagcgattgcacaaggttgattctccacttctctgcatcagatcggatatatttcaattggttcgattttgatctatactgactcccttttagctaaaaccctgattactgataatatatatgttctactcagtgaaggggatgcaattagacttggaaatggagttagaaggcttaaaggttgctaatgtgatctgcatgatattatctcatgaaaaccaaacattgttttgccccttttatatattttgcccttaggattgaatcaatatttcagaatggacgaaggcatatatcctcttcaaagaatgaggtctcaagggatttggttgtcaatgtaaaatcacagatgaaacaatctttgttggtaagtaaatgcactttttgctgcattgactgggataatctcgatgaacaatgatgttgtttgctactttgattttaatgtagatcactgaattgccattctactatatatgaagcaatatttttaatgtgtaaaataccctaggtcatgtgcatgtttttttcctaagttcatgaataaaatctcacttctatgttagggtggctactagatccaatcctttggttttgtgtttcttatacacccaatgatattttttattttttttaggcttgggtacatgtacatgtttaatttttcttaatgtcaattagatatcatttgccaattaaaattcatgtagaaatacacctacctgaaccaacatattcaatcttccaatgcatgttacttcacaattttcggagctaggaatcttttagagctggacaaatccatttacattgagtgtttattataaaagaaatatattttcaatcactaagataatgataaaattctattatgtgtttgccgataagcccaggtggctgcccggggttgccaagcggtgtctccacctctgactccattcatgtaatcatgttcatggtctgctccattgagtttatttttactggatgcacatccttccattagtagttcttgcaagaaactgaaataagtaacagtcgtatagcattatgctgctagtatcttcagtaaagaatgtattgtcatttgcttacctcttttgtgttttcttcttctgatgcttagagacacaaaaacaagcgtgtacaaacgatggaaagagaataaactgtaattagtgatcaagattgcaccactcatcttttgccacaaacactgcaagagagattgatttacatatagtgaatgaatcaattctacagtcttgaagatttagctctaggttttctttagatggaatgtgcctcagatttagatttatgtacattttaagttgccaaaataaacaactaaatgaatctttacgcaaccacgccaaaggattcacctagatgcttcagtcaacatactatgacaagcagaacaacgtttattcttatcttttttatatagtaatatgcccttgctatataaaaataaaagcagaactacaatgtcttaaaagaaaaaaaaaaccatgttttttagccttggtctattgtcaatcatttgaatatgctttgcttataaatagatgattcatattcatacaatatttgctaatacgtgcattgcacgtgcacgattactagaacttattagccgtaccaatattttggtagtttagatagtacatgtgcttgtttggattgtgaccaatttattggtactgtccatgttagatttagcatcaatctagagcaacttcactataattcatatgttgactttatattggtagcaaaccaaatacaatcttgtcctacaaagaaattggtagtactaaaatttatctaagttttagcactaccaaaaaattggcatgtagcaatccaaataggcccctagttacttaaaaaattcattttagagtaaaatacactagcgttgcttaaacttgtaacgaggtctcacttaggtccacgaacttacaaaacgcgcattgaaatatctaaacttggtttaatatatcatcccagtccaaaaccttgtttgatcgtggtcttgcttacgtggcatgccgcgtggatgatgacatgatttttttttctcccttcttcctttttttttgtgggtagataaggagaacctacaaaacgacggaacacgtccatattcacatagtgaaacacgatcagactatcttaggcggaaggatgagtatgaacgctgaattgatgcagaagctttagaatgcaaggtaaatcctctgggactcgtgtcgtgaacatccagagtgtcattgtggtgaccgttgtcaggtaataaggtatgtaaggcaacgaacttgaggacaaagatgcttcgtgtgtcctaacattgtcgatgatgatttcatcataagtatcaattctttcggtaccactaatcactactatcatgcacttacccgtccctataaaattgtaccaataggaggatgtaaggaattgtcaattcatacaatggatcgatacggtcagagttacttccaatggtcaaaccataacgcaacatgagacgaccactgttggtaattcttacggttacagataaaatccgcaagcgcacggatataccgatgtagcacttcccctacggagtattccaaagggtatcgaatccaagagaacgtgtgtggtcagatcttcctccggttcatccaaggacaccaagctaaagataggccaggatagagaggat

SEQ ID NO: 9052 - DNA, 44307 bp, Oryza sativa
  unsure (1)..(44307): unsure at all n locations
cactaaagcaatcactatattttagttgattataggggaccattaatcccgtatgctatttaggaactaaccaagaaataattctcacaagataaatctaaattactcaggaagaatattatattaaaatcagagtaataaatagaataaaagaaatgagagaagattaccaacaactccggaattcttccgacttcttctactctactctcttcctattctagtatacaatatagtacaatggagcctcttataattcagctcaagcttggaagtgtgtgtgaaagtgaaggagtgaagctccttttatagggcagttatgacggttgtgagaaggggaaatgtccgaactgccccgcaaccgtcatgaggagagcatctggagcgtccacgccaaaccctaggatcaacggtgatcagaggagtttggccgaaccagggagtttagccgaaccagatcaacggtgatcagaggagcgaacctgggctgggccatccggggctggccttcggcttgtggactcccctgactctccatttctcggagttttggggtgagtctttgatattttgatgaagttcacaacccatcctcgtatggatacatgtttcttttcacttctagatttcctcccaacttcggggtttaacacctgcatacaaatatacactaacacttgtgaaatatgtgagattaaacacctatctctatgttggatgttttattatctggtagatgttggtggtatagaatcgacatttaatagccgccaacaaccacacatttcatttaggcttggatagagtacgaacatcgggtacaaattgcaagcttagactgtaggaacaatccattagatttacctaaatggtatgagtatccaaagtgtggttgtagagatcgctgctaggtggctaccgcctttgatattgtggatccacaaagtgaatccgcacctccttgtattgccctgagcaataaatatagttgtcatggcgaaaagataattgattttgaaatagaagtagagtaccaacgattgaaggagaatgaaaatgcaatatggactgacgaacgatggtgaggaccttcttttgcggaggcgattgtgaggcggcctaatggcgatctggcctccatgggggatctctccttcgcggacaagtgggatttctcactgggattggattttgcctcccagatttggtctcgtctccgatcaccggttaatttttcccgctctccctcatccgctttccatttggtggtttgtttttcacatttctccttccggctttctatggattctatggctattgccctcaattgctgtcttcggggaaatccaatgattttcgggttcgacatctccaaaattcctgttatagtttttggtgtcagataggaaggtaggtctctggatgtactccttgaaatctttccaaaataagttcttcaagcttcattttcacttatggaggaatggaggtcctgattggtaccgtgagtacacactatgggttcttgaagaggaaaattcttggactaaagttggtagaaaatcaaaacccatctcaaatggtgtcattcgacctggggtctcgtttgctaatgtgttttcctctgaacctactcggtctagagcagctgtactgattaaaaaagtttttgacaccatcaaggattccattcttgatcctaatcggccttccgttcttcctgtgaggaaattagtttttgactgtctggattttcctagacgaaatgttgttcaagtttctggcagtaatttgcttcacgatggatcttcgtccaaggcgggatctttgggctctttcaaatgttcaaagtgtcttgctaccggtcattctaggtctgattgtcacttccgtgtttgtttcaaagcctgctttgcttatgggcataaggcccgttactgtttggcccagagtaagaagaaggccttgacgaagtgggtagttaaggggagcaccgggaataaaacaagtcacttccgtcgtttcatctcttgctccatctctaccacaagcaaagcgacctctccttatccaatctgcaaaacccacttcgccgaagggccgcattgatcagagttccgctcccatggcagatgtgcagttcaacctggcacgctttactcctctaggtctgcatctccaggaaggtagccctttccgtctgcctagagcggacttgtcggtcaaaccccctactaggcgacatgaatgctataagctagcagaggttgagccagcgattcatgaggatattttcgatgtccataggattcagattagaaatcatctttagaatgagttgggcattgttgttggtcattgttctccccatctgttggcagtgggcttgtttgcagttcgttctcctctggttagggataccttggtcgaggcttttggtttccaatacagtaagttccacactgttcacttccgccatcatggtaggggttctaactggcgggcggctcatacaaaccgaagaggttgggtgatgtttttgggttatccgcttgatttccgtaatcagcattacatcaataaagaggtgagcctttttggtcgattggtggattggcaggagagggatcccattccaggtagtgttatgctcagagctgtgtttgatgacattgacgcagtaccgagagtatttttgctcaaggagttgcccctgagaggtggcctaggacagtcatggacctttggggtctttgttctcaacactgaatttgctgacattcatcttggtgatgaagacctccctcctttgatggttcaccttcaagaacctacgcaacagcataacgatcacatggatatgcagccagatgctccaccacaacatgatcagccctgggggaattgggatcagcaaggggagaataaccctgaaaatactggaaactcaggaataagtgctggccccaaccaaaatttggccatgtctattttggagaatgaagcttcccctgtgttctttgtgctagattctgttcagggcaaaatccaagaagtagtccttaggaatcaggttctaaggcaactgtcaaattgaattcaggggcctccaactgttctgttggttcatgcccctttcattagcttggtgctcccaagaagaaatgttgcttttgattctttgccgctagtttatcactcttcacagttgcccctggtggtcgttcaacctttgggccatgatgaggatatggaccatgacatgggctctcccctgggccatgatgagatctttgatgttcaacccttggcaatttcagagccactagaccaggcccagcccaagagcccaccaagaatcggaccagtgcctctcctgttagaacccccaagagcatcagttaagaagagagatggcaagactgtcatgtttgatcctgacaggaggcagagttctcggttgagatcttcaagtcaagagctcactcaacctgaccctagaatgggcatagggaagccgaggggaaagtctgccaaaaaactgaaagagctggtaggtatctcaaacattttaactggcaatagttctttatcggcttctgattttcattctgatttagatgaagaatgtttctctacatctgattcctctccttctgactgttcaatatctttactcgtgtcattagtaccatttccctggatcaagtagtctggtactcacgattacattgctgaaatatcaagtgcgcatacaaagattgtctagcacgaattattacatcataggcccgcaggcatagtctagaacataggaccgaacggtccggaatacattcaaaagcagaaatagataaggcagcggaatttaggcagcggccacaccattgccacaagcaatgaccgtaactaagacctacggagcgttgtcatcctccgcatcctcctgaagataagcatagggatcctcctcgacttcattgccatccactgattaaattttgtaacagcaagagtgagtaccaaccgtacccagcaagccaccacaacaacaatgcatatgatagaggtattcaaagtatggctattggtttatttgcgtaaagctaatttctcaatccttttcacaagtctaagacctagcattgactagtcaagttttaattccagtatttattacacagcaacggttctgttcaccatccattgtcttccgaaagatggcttcccgctactggccgtcatggttttctgggttttatcccttctcgcctctcgagaagttgctccaccagtataaaatcatcatgcatcatctcacccaatcagtttaagaatttagagtctagccaagtgtagtacatgtcccggtgctcaataaccgcgagcacggctattctaatagatttggtttactcacactaagtggatgtacactttatccatacttcgtgacttgcccaacacatgagccgaagtcccaacgaatgagacgcgtcacggcaaagcatttcaataacctcactttggcagtacccactccatgaactttagtccttattcactctaggcgtccaaagtttcaagcagtgagaggagttctggcgctcccgagggggaaggactcacacattcattaagttatagttaagtttagatttgcacatggcagtcctaccgatggcgacaccactgtaggcccccgcccctcgtggtcctaccaatggctgcctcaccgtaggcccctgcctcctatacacatcaagaactccactacagcttgggtaccgcctccgctcggttatttactccgctaggtctatacccaaacgagaagtacagttgtacttgggtcgtttcatgcttaacttcatggcactagcctttatcggactccacccaagtcatccagccgccctagtcgaaaacatttattcattataatttttctttcacaaatcatttcatccatgtcatggtaatgtggcgcgcatgtctccacataccgaatctcaactaccttccctaaggtagttgcccaagcatataacatttgataaatatgagaatgcatgattctgatttagcatgactaagcatttgtcaaatattgactaaagacacacgatagcatggtttacaatggtcatacaattattcaatatcaaggcatggcatatagcaaataggacattcttattcatacatagcatgcaaattttattatttaaatcaacataattttcgcaataggttcaacatgctcaaagattagtgatgacttgcctggatcacagtcttgttgtccctgctcctcaatcgactcaacacaattccctcggaatctaaatttacgtgcgaaagatcggatttgaattcaattagaattcaaataaaatcaacaaaaattcaaacagtacaaagtaaattgagaaagtggtcccatcagatagatcttgattttagatgaatttaggttcaagtttcattcaaatccgagttaaaatgagtgagttatgagggtttaaagattcaaatttgaattaattcaagaaattatgaaaagttactgttcctaattcatttatttttattctaactcaaatcaataagccacagaggctgacacgtaggccattcaccaatttctttgctcggttttattttcctaaagaaaatgcggtgtcactgataggagggtccgaccccttgtaaacaaaggtgtagccctgccctttaatcaccggtgtgacccgcatgtcattgagacaatcactaaaaactccatttaattagatttctaagcatccgggcccacatgtcattgattcataataataccattagttagggattactgtgcactaatgaagtgggttccacatgtcataatctctctgtctcgttctttctccctcccccatcgtcttcttcctctcgctcgcgacggagcagaggagcggcgcccgtgctgcgcgacggcccgagccgggacgactcggcacgcggtgggcgagcggcgacgcaccaccggatacccgcttgcggcggcgcaccaccggatacccgcttgcggcggcggcgaagcgcggcgatcgcccgacacgcgacacgatggcgcgcggcggcgccaagatcccaaaaatggcggcggcacaatggggaccgattcgagcgctggcgacctcgatttaaccatctaggggtcacatggagtatataaaagcaaaattctagcctatgctacattggaacgaggtccctccatggcgagctcgatcatggcgcgatggcggccggagtcggcacggctatgacggcgagggcttaccacggagtggcgggatggcgaagttcgatggcgcgcggcgcggtgtggccgaaacaggggcagccggcggttggtgactgtcgcaggtgttcaactcccggtcttccttgttcagcggctcccggctcccaccaacagcagcaacggcaatgcgagcacctcctctgcacaccccgccacccacaccggccgagaggccccgcggcggcggcgcagccccgcccaccaggtgtttgacacccggcagcgacgcgatttcgtttctctgagatggagcaagagttttaggggagagggaagcaaatgggagattggttttggatgaggatgagctaggggtgagcttataacagcgggagggagggcgattccttaatggataaggataatcgatcacgtagctttgtttcgatctcttccaggtttcggttcaatgcactggcgcggcctgattacctattcggtagggtcgcaggagaggggggaagctaactgtgggatatggcgccacattacccagtagtctcatccgggggtgacagaatggcaacgcaacagtgatacgatggcgacaagagcgacggcgacggccagtggtaacggccgcggtagggaggcgcagggctacgccttatggtgacgcgggggtgtcgtggcggccgttaaccctcaattcccgatggcgactcgcgaggagacgttatgacgcgggcgttcgtggcggcgcagccttggcgcgagttttcagcggctcggtcggcggcgggcccacgcggcgtggcgcgacgcggtgcggcacacgggcacgaccagtgcagtgcacgagtcggaaaggcaggtgcgcggcatggcagtggttggagagggcgacgtcgggtgttcggtcgggttaggcccagatcgagcacctggcgcgcaatgaacagtgtcgacccaagaaaaatcaaaattagggctttccttagactttttgtgtgattaatttttagatgattcaatctgtatacttcttttgggtatttaccttatttcaacacttccaattttgtgatttattgcatcctatgttaataattaatattctaatttcaacatatgtttcttttgtcccgcattttctaggttttagtatttgtctttccatatcaacatattttttcttctcatattcatcaatggaaacaatatgttttgcaacagagaaacgaataacaccagcatgatgcaaaagttttaaaatgttcgaaattttagtgatttttattatcagagattttcaggatgttacactggtctcttttgttcaatccaggtttaaatggagaatagttatattttatagtaaaaagtacgaattaccccgctgatctattgtgtgagtatgaattacccccctaaacccgaaaaccagttattttgcaccctcaactatcgataccgtatgaaaaaccccccccgaacagctttgcaagcggttttggtgtacgtggcagtccagtcagcaagtttttattaaaaaaatatagggcccacctgtcagatatcgaagtagccgataaatgatatgttcttcaatcttgtggaaagttgaatccttgtatggttgtatgaaatgatcgatttttgatgcccagtgcacaatcaatttgatgtaattattttccgttaaagaaaagttagtagtttgctgtaacagagtgtcaccgtcaccgcctctgccgacttcgccgccgccaccgctaccgccattgccgactttgccgccgctactgccgccatcgccgactccgctagcgccgccactgctgcgaccatagccacacgatataagcaattatgtggacatcgatgtcgaaacaagatttcggcaattctaaaaaggggtggctatcaagctggaaaagtggatgggtttggagacaagaaatttttatacaggttcaggccttcttattcaagaagtaataccctactcctgtccggggatgattccgccgagtgtattattgatcgtatgatctgggagaaaatcgtgtcccaagaaagacccggacccctccttatataggggaaggggtccgtattacaaaatacagtccatatccctaacagaatacgggattacagataaaatacaatcgtaaccgactaagaccccgggtactttcttgacgtacaagttaagaaacaaacccgagttcccataaagatattctatctatattcgataccttgtatcctacctaactataactgtcatgtagatatggggtatccataatctccacagtagcccccgagacctttgcagtcgacgaaattgtcttcttaaagcaaaaaacaataatccgagtgttttaattcttcctgctccagcctgccgagttttaaaatcaaagactgtaaagggcgaaaataaaacatggtgcatcgaatagatgcacctaattaggtgtagcccccgactatgtggttagttaaaaaactaaacatgtagtcaagaaccaagtggtttcacaaccaaacatcatatagcaaagcatacgcggcgttcaataaaatatccagccgactgctttttagctttaatatatcaagaatgataatatgaaaaagcccgagtgataaacactcaaaaggttcatgaataaacatatttgacgagaatccgagtaaaaacgcttaagatcatccatcaaatatgataagaatcatggcagttaacaagtctaatagcctaggctatgaccctcaccataaaaatgagcatataacatgccaagagaatgaccattagaaaactagtcatctcgaatcaacccaaacagcttttgcagcttaaaaaagcttacaaaaatagtataacacttttctgtcgggtgcctttttatttgcatcgtagtaattccaaagaattaaaaggattttaacagcatcgggtcactccattgtgagcacaaattgccaaagcaataatgcccaagtccctagggatcacaacgggccacgctgataataatattgggctgaagtactatgtaggcccaggcccattagcactcccgataccctagcgaaataaacgccgaagtcaaagcgtcgtttcgtcttccccgccgagaccctcgccactttccccatttcttgctacagtgcagaacttcaccggcgaaactagggttcaccaatccgcttcaatccatcctcaaaaactccacgaaatccttctacgcaaccaccacaccgattccccacccccttccagccatatcccgaactaaattaagccatccagttcatatccatggcggaagagagagaaagcttcgagagccaatgggcgccttccgatgtaacggaggaaaatctgatggagatggtggcgcacggcgttcttccagcaaaagagatcattgggtggcgaccggcatttggcgaagcattcccgacccccaacacgcatgaagtcgtggtattttctcatttcttctatggcggattttctcttccaacctcaagattctttcggggaattctgaatttctatgggattagcctgcatcacttgaacccaaactccatagtcgacattgccaactttattcatgcatgtgaagcttttttgggcattagaccacattttgccttgttccgccgcatcttcttactcaagccccaaccgaacaagagtaaaccatgtgttgttgggggcgccggtttccaactcaggggaactttgagccaaaaatacttttccatgcccttcaagacttcaaacaaaggctggcatgcaaattggttctatgttcaaaatcctgagcctgcactccccgagtactcctgtcttccttcggtctaccaggacacatggaattcattgcctatgggagatgaagctgctcaggccgtggaactgatggaacgtatgctgaagctcaaggagcaaggtttgcagggtgaacagatcactcgacacttcatcaaaagtcggttagctccaatcaaagagagatcccgcacggcttatgagtttgatggcaaacatgatccaaatcgcgaagatccggactccctggactttaaggtcatgaaagaaaggatgtacaagatcttctcaaatgccatcgtcgtcagttattcacatctactgccagttgtgccatataatgcattcaaccctcctccaccggtatgtgttaaaattcttcaactttcctcaaaatataattttgtcttcttgttgaatcagttaacagttgaagatattacgtctaggaattcgctttgatgaagtcagacccgccaatcgtccagcgccgatcacctcaccgtcaaactgttcaggggagcgggggaccaaagatctggtccgaatcccagcccaacacttctaatctagctggccagtcagattcccgcaagaggaagctagtgctgagtgacgacgaaggcgacgacggcaaaaaatctggagataaagaaacacccagaaaactgccgaagcaggctattccgaagaagaaaacatccagtcgccctatgccaaagatcagaaaatcttccaggtacaaatcatataacaatctcccctgttttgatgcgctcccagtatggaaataatactgataacaaaaacttgtaggaaaccgtctgatatagatccatctggaaaggactctgatccggctaacatggaaatgagttcttccaaagaaaccgggccgactgccaaaggtcatccgagtgacagccagccggcaaccgacaatgtagactctggtgatcaacctccgactggaaaccagtcagctgaagctgaaaccggagccagtcaggagcccccgactggaaaccagtcggaaacagggccaagccaagagattccagaggttgatgccagccctcgcagacaagatgccagcaatgactcgaagcctggatctccggctaaagcacaaggatcgactcgccctcgcccgggaatcatcacaggtaaacaccttgcctgagatcatgttgatccaaatgtccttaattgattggctgatctttatccatggatgcatcaggaccaatgattggtgacaaagaagaaattctctggatacgagcggctgaaaactcacgccctcccattctggtcaaatggtgggacgatgacttgcaacctcagggcattgtaataaaccgacaaaaggaggacgaagaggtgtgccaactgaaaaaggcactcggtcaagcaactcgtatcgtaaacgtaagttatttgactcaggacctctgctatcttgttcgcttcttagtgtgagcgctaataaagccattatgtagaggatccatcttaggaacgaggcgaagaccgcaaccctggagaagctagttcctcatcttggaacccttgaagctgtcagggatcaactgtacgaggcgaaagaacacgccaagaaaaccgagcacgatctaagagatcggatcgcccagctccaggaatctaacttcgaactgagtggctcgtcaaaaggtaaatacaaagtctgtccaactaactggtgcagtcatctccgtaatcttcaattaaccggagtcaatatagtgcaagccgccaagatgtctcaattggagaaacaaattcaaactctggagagcgataaagcagagctggcaagacagagggactcggccttgaaggacgttgaaggtaccatcaattgactcatttgagctatttaagctatccccttaaatgtttgcgtgttccaatggagaaagcagatcctgaacgtatagagcttcaagaagtttaacctatgtcgagaagccagtcagaatcttggaagtgagcgagaggaatacaggaaatcacgttatacggttctgtaaggttcagtggagcaatcattcagaagaagaagccacttgggagcgagaagatgaattgaagtcagctcatcctcatctcttcgccagttcttctgaatctcgaggacgagattccgtttaaggggggtaggtttgtcacgccctaaaaatcgcctaaattaaaaatgcatattttaaatcatttttagaaattattttaaaagcctacaagttaaactctaataatctaggaaaattttcaacataaaatcgagctagataaaattttattaaatactttgcttgttcctctattttctagatttttctgggaattatttgagcaagggaaatatttttaataaatgaaacaacatttcacaaattattttaattgaaaaagtataaaaaaaccctcccttaggttgttgggccgaattcggcccaacatcttctctctccgcgtgggcgagccggcccaagccggcccagccgacgccgcccgccccgtcctcctccagtcgctgacaggtggggcccacctgtcgggcccttcttcaacctccggccgagccggccgagctcgtccgagccgccgccttcctccaccaattccgccccaattcggtctccccgtgtccgattgattgaggggttttgatcccctcattctcctctatctttacccccaagattcggagcaaatcgttgtgtattttaaccgaatcgaattcgttttcaagtttatccccaaaaccaaccctagtttttcccggctcgattcctcgcggtaggagtccaatctctccaattcaaggctataaatagcatcccctagtcgccctctttcgtttgccccctttcccgagctctctagtgctccatagagtcgccgccgcgccgccctagccgccgccgtcgccggccgaccaccagccgcgccgtgccgtcgccttagccgtcgccgctgcctcctcgcgccgccgtcgggtgcgcgagactgaggggaagcccagccgccccttcgccgtcgtcgccgatcgccgtagcgccatcgccgccgtcaaccgatccaccgccgccgcacaagctcgccgccggctgtcatccgtcgtcgtttgtcgcttcggtgagcaccgttgagatcgcatcgttgccctctacgcgtaggtaccctgcaaaggcctggccgagcctcctagcgccggcgaggtcgtcgcctttgccaaggccggcatagatgacgtcagcatgacgtcataaccttttctttttagttttttttaatagatgaaatagattaaaacttcggaaaatcataactaattcagtagctccgattcgagtggttcaagttgctaaatttttctaaaattgagatctatatgttaaaaatatccacatgtactgtttatgcttgttttttattgttctgttgattttgtctttttgctctagtttccgatgttccggaggagagcgtttccattgaggaaggttcggaagtttttgtggaagctcaaggcaagtcacacaaatcctaaacaaccctgagcatgttgaacctgtttaaagctattgtcttatttcaacttatgcattattttttaatgtcatcgggtggtgaacctttcctagttaattaatggccgaagatgactttataaacctatgggttataatttgattagcttgggccttatatattggattggttcagctaaatgccatatgtatgtttgcttagtcatgcctagaaacattagctaattaatggtgacggagcgtggggctcctcaccgggagaccgcgcaggcccccctttgccggttcggccgggggcgctaagtgaggttcttcaccctcgatctgtgggatgttcgcgagagagcaaatgcacaagacacgggcgatgtagacaggttcgggccgctgagaagcgtaataccctactcctgtgttctggtggatctgtgtatgaagcagttacaaagaaacggagagcaagagagtttaaactctagaacccctctcctctcgttttggatgccctaccagttcaggtatcctctattctctgagttctctcctcatttctttcggtgggcaaggtcctccttttatatctcaaggggatcctacatgcaccacttctacctaatcttcttttgggtggggacccaccctatcttgaccaaaacttggctcgcgccttcgcctggaaactaaatcacagcttgtccttgagtgaggcccagcgccgacactcgcctgacacaggggatcactctgtcattccttcattaatgggcggagatttgcaatggctgctgtccgaatgacccttcgatgggatgggtcatacctacctccactccgccggatgcagacgcaacgtgggagcacagtttgtctgccgatgacgtgaccggcgtcagaccagtcatagaccggtcattcttgtccaccacgtgtcagtttagcatgccgcacgtctgcccttcttcatacagttacttccttgtaatggttgcgatgaagcctagcatgaatctagccgggactgacgtgctaactccaggagttaccacgccggccccggctagggacgagtgccaacaggctctcatcattccgacgggacggggcgaggcgtgcgacaggccgcctgtcgccccctaacccgcgatctgaccggcctgtgaccagtcacacactgcgaccggtcacggaccggataagcctgcgctgcgctgcattaaatgcggcgcggcgcactcctccaacccgcaataaatgcggttaggtgagccccgctgtgctcacctaacccatacaagtggcaccaaatcacaaggggtcagggcaccccagccctcggggccaaaacgggagcggcccgacccctcggggagacagagggaggggtggccacgtcaccctcgggcccgacccccccgagggggtcaggccacgtgggtgaccgcggctgcccaaacctctagtcacgatacccccggtcccatgtcaccgacaaatgggattatacataaaactatattatattattattaattatggttatatttaatggtagctcacgatggttaatcgtgttatgttatgttaattaattaataattaaaacctgcataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgactcattatagtgtgctagactgtgaagcggtgagaagtccattggggtcgctggggagtccattgcctctggttttgagggggagattataatccaggaacggtgcactgtggtgagttgtgttgtgcgaggggtattgtcacagttcctttccaaggtaccgtggtggtactgaggcgcatggtgacatgttgtgggattgtgtcttgtgggtacagtggtacacctctgattagagtaaaactattcgaatagctgtgcccgcggttatgggtgagttgagcaatgttttttgtgattagtcccacattattcattaatggtaattgtgctaatcaatttgactcctggtttggaatggtatattcctggtatggaggttggattagtacaaccggggttggttgttcagatgaggttgggcctatgcaacacgggtgtgttgtatggtgtttatctaatactgattaattattcaactgttgaactattctcttaaatatttattaaatgctgtttacacaaatgagctttattatgccatcctttgttattctgtgcacttgcatatttgctgtgtggcttgttaaatatgtcatatgctcattcttgcaatattcattcatcagaagaggagttcttcagtgaaggtgatgatctggaggactaggcttggtccgggttaagttgcctgtggagtggaatcgccatagctgttccgtagtttgctttagtttatttttccgctgcgtagaatgttattgtttgagaggaactatctacctctgtaatgatttattaattgcgaatattaaatagttgtttatttgtactctattatcaatttgttattgtgtgcctcggctgattcctggacgagggtttaacacacatgtaagcgtttggaattttggatagaaattccgggcgtgacaattctgttgatgtagaccgcaagatcaaatcacaagctctgttcgacgtcctggtcggcaaaatcaaaatgcttgaaggggccagggacgaagttgccaacgccgctactccactcgtccaagcaatgttctttaataacaacggtccgagtagattcgacgcttccgagatcttcgacaagctaagagtcgctccggatacatacttcaagaacatcaaggaagccgggagtatgtgagcaagtctggcgctggcgatgaccaaatccctgtacccaaagatcgatattgacgccattgatggctttgcagacgggacgagcaaagaagccactctcgatctcatcaacgatgcgcagaaagccgctgacaaaatagcagttgatgtagtagagagattccaggacaccgatcttcgaccgactggtcctgacagttctgatgatgaaaagactgacactgattgatgtatcaatgattttgatgatgagtgatggaggcacaatttgtacaatactgataaatttatgccgtgctcagtgtttcatacttagcttctgatttcttaaaagcctttgtcaagccttattgagcctaaaacccacaaaagctattaaaaactttcagtcctcatggactaagtcaaaaaatcaagcaaggcaataataaaccaaataagcaaattgaattgataaaaatcacactccattattattatagtagcccccgactgataacttcaaggggaagcttgatgttgtcagtaaacaaacttaagcataaaaacaacgaagatgttcgatattccaagagttgtcgataggtgtaccgtcttcgcgcttgagccgataggaacctggccgagtgacttcagatattataaatggcccttcccataaaggggataatttgtgccgatcccgtgtagttcgaattttcctcaaaaccaggtcgccgactaagaaagctcgcgatcggacgttacgattatgacaacgacgcaacccttgcaagtatcgggccgactgaattaaggctgcttcgcgggtctcttccagtcggtgtaggtcatccactcggtcttctccgtagcgctcttcacgaaaattgcgaaaacgcaaagattcaaactctacctcactaggcaacattgcttctgctccataaactaggaagaatggcgattggcccgtagcccgactgggggtggtgcgcaaggaccaaagtacggatggaagctgttccacccatttgccggcatagggatttagtcggtcaaaaactcgtgcctttattccttggagtaccatgccgttggcttgttcaacttgcccattgctcgtgggatgcgctacggaggcatagcagattttgataccgaagtcttcacaaaaatctttaaatactccgtcggtgagttgagtgccattatcagtgatgatctgattaggtaccccaaaccgatgcacaatattgatgaaaaagtctctggctttatctgccgtgattgtgatgaccggtttagcttcaatccacttggagaatttgtcgatagccacaaagaggtgtgtgtaaccgccgactgcctttttgaacgggccgaccatgtcaagcccccaaaccgcgaacggccaggacaacgggatggtttgtaactcttgggctggtagatgagtttgtctggcgaaaaattgacaaccttcgcatgtccgcacgatcttgtcggcatcggacacagcagtgggccagaaaaaaccttgccggtaagccttgccaccaatggtgcgtgtggcagcgtggttgccacagataccagaatgtatgtctttcagtaattgtctcccttcctctagggatactgttgacagaaaacacgaggcctgggagatctgcttaactccagtgcaggtccaaaactcaccttcggatgtgtgagcgtgccagttgatttgatcctgtaatcatcaagaaataaagacaaaggaaccgtggttaaatctataaatgatagccgatcggccagatgccgatgacatatcatttatattcgagccgatgtcatctgtgtatcgatcggcaatcgtagataagtaaggaaaaactaaatttacttgatcggctgtaaatattaacggtatataatccttatattgatgtttacttaaatcaagtgattgggatagatcggttatcacaccgagacagtataaatcacttagatcgaaatatacatccataacaggactatatatgtttatagcatagccgatcagatagatctagcatgtatcggctaatactccgatactactttgtattaagacgttgcaacaataatgatatgttgaacaatagtttaacacatttgaatatagcaataaagggcatatttaacatatcagcgaagcaaatagaataagtatggttaaatcagatacgatcggctgaaactccgatgctattctaattgacaactagatggcaggctagagatcaatattctaagcacgacttaatagatcaaactcaattgatgcagcattaagtatgaaaagaagaacaatatctagacaatcaagccgctagaagattcatagaatggtacatatcttatataatctaaatcaacgtcgagatctaacctaatcagctgtcttttgcatacaaatattagccgataatagattagataaagatattgttgaagattatgtaagatatatgataactcagcgaattatataaacgagattagagtgtcatgaagatgtaagcactaatccctaagaacataattcgtcataacgaattttacctcttgttgaagattgaaaccgatgcagctcaacccgaaagcaagaactcgtcgaaataaaacaaaagcaaaaggtggcgatgcgccggaattgtattgaatgtgtgtcttaaaattacatagggctcggggtctatttatactcgaggattacaagatatgcccataccggacataaccattatctctaacaaactctaaaatatcacaagtctctgcggcagacttttgcccatacttatctataaggaatttacataaatcatcctaattaatagatacaattgccttcccaggactctatccatgcgtggcaatcatcttgaagcacatcaacctgagcccgacgtcgcgcacaagttgtattgtcagaatcagctatatcagcttatttagcttaactcaaccttagccgatcctagccgtagccgatcctagccgtagccgatcctaactatagccgatctagactccagccgattcttgctctgttccagaactcgatctccgcctccaactcttctttgaccaaatcccctttcctgatacgaatacttaccaaattcggttgttaacagatacgcagcgttgcagaattcttgatggacttttcttgtacaaattggcctcatgaatgatgtaaagcctgctgcgcctggaaatccgctcagcttcgtctttatcttgagggagttcttgggaggtctgaaaccgtatgaggggctctctccagtcagcttcgaccatagctatgtcttgagtgtccgcggcttcagctgtttctctcttgggtacggttggctcataaagatgttcgacgaatacatcagaaggggccgcttcgtgtttggatccaaaattcgctagtctgtcggttgcttcgttattgtgccgaaaaacatgggtgagttcgagtccatcgaatttgtcctccaatttgcgtacctcttgtcgataagccatcatgttgtcatcgaggcaggaccactctttcataacttggttaacaaactaactgtgaatctccgcgaactatcagacgtctgatgcccaaagagattgcgatccgtagcccgtggaggagcgcctcgtactccgcgacattgtgagatgcagaaaaatgtatccatagcacatagctcaatctttctccagttggggaaattaaaacaactccggccccagtgcccgaaagtctctttgacccgtcaaaatgcatagtccagtactccatcttttcctcgggggtgtcctcttggcactcggtccacttggcaacaaagtcggctaaagcttgggacttcatcgaagttcgtggcttgaacgatatgtccaaggacatcagttctaaggcccattttgcaatccgtccgtttgcttcgcggttgataaaattcttattgattattatatatatattgtacgcactatatttgagataatacatcaatttataatttaacaaattatatttaggacacgagcgaaaatccgtgtaaacaaatgccccttcgagctgcggttgccaaaattttgcttttgcatccggagctcgaagcataattttggatctgcagggacgtggtgtgagctttatgctcacaactatgtgcccgctatttgaaagattgttgagaaaattaaggagcatctccccgattatttggtcacgttccctatcaccaggagcagtgaggcagttcgtttgctcttttaatcactaacccatccactactccagtctccagaggctagactccttcctcttcctcttcttctgtgtgaaggctttgaggaaagacatcaccggtggcagaatcaagggtaagaccctgctttgatcttgtgaactgaactggcgacccctttttcttactattttttttatttttcttattggctttcgtccctctgttctatttaggtttgtgctatgcacacacacctgaagatcctcgagttgatttcattgggtgcttggtgattcaggtgtggcaagtgaaaggtacgcatgaatcttcttaccatccttcaatccattcatttttttaatagatatgtcgatctctctgcacaacgttcatatttgatacgcctctgccaatataacttcctttaaccacattgtattgaattagttgttcgtatgatcggggttcccggacattttgtaatgttacacagccaatccacgttgttagatttgcatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaacccccccaaacttttgggggaacaacaaacaaactcaaactgttacttttattaaggttaaaggctctggaactaagagaagagcttcctccagatctacaagagaagctagggtttaggcaagcaaattccaagacagaagcatccccggtgagagagagagagagagagatgaatcatcagaaagaggatgcggatgctcaccaggatccccttgctcgccggatggagatcggcgaccctccccctcccctcccctgttcagccgcgaatggcgcaagaagcggatgagacgacgagacgggagattttttttctcttttacgcgaagggaagggggaagagatactcgagtactccacctttagctcagatttactatgttacccattatgagtagcaggccaaatgggcggcccggcccagcatagctcggacccgctgatggcacggcaactgtaatgggccgggccgtgccgtgccaggtcttgggcagaacggcccaaggaagtgttgggccgtgtcgggccggcacggctactgttgcatggaccggtggcccacccacctgcaagagaacgttattcgtgtgaaactacagtcgcaagttttctatagtaggtaacacaattaggcaaaattgtgtttatatgggtatttttcattgtcaatattgtgccattatagccgtgttaaaaatttccataatttcctttggcacaactaagagaggtttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaacggcctatcaaagtgctccatccggtcttaaaaacaaaggtcatgtttcctgcacaaaaatgttacaccctatcacatcgaacgtttgaagtattaaatataagctaaaaaaataactaattacacagattgcgactaatttgcgagacgaatcttttaagcctaattgctccatgattttgacaatgtggtgatataataaacatctgttaatgacggattaattaggtttaataaattagtctcgcggtttactgacggatactacaattagtttttttattagtgcccgaacaccccatgcgacaccctatataatacccgatgtgaaacgcaaaaactttacactcctggatctaaacacccccaaagttattttggatactacattccaagttcaaatataaaaatctaatagcatgtacaataatagactataagtcggctacaagcttatgtggtgaacataaagagaggagatagaaaagaagcaggctgcagatttgtagctagctgtagcacggactcctaaatgctacgtgtgtatgacaagtgggagcagtaattaatgatgtagtatatatttgtagttaactattgtataatttggctattagattatctataaataatttggagctagtagttggctatatactattaaaattcctctaagcggcaaaggccgtgttcgattattagtgttagaaactaaccctttgagcacgtaaaacgaaacggttcattaatgcataattaattaagtattagttatttcttaaaaatgagttaacatgattattcaaataactttcatacatacatacgttttaaaaaaaacgcaccgtttaaccgtttgaaaagcacacatgtgaaaaatgagatagataagtaggaaaatacgataaagaatacttcctccatatcaaaatataagccttttttttttgtttttgacttcgacacggttttaaagatgctacattgataaacgatattcataaaagtaaaatattttaaataaaaagagttacatactgtgatagtttgtttaatgctaaatctagtaatatcattttttttagattgatcttttttaatttattttttcttattaataatcaaaggacttgacactatacttaaaaaatacttatattttttatattttagtacggagggaatacaaagttaaaatccgtcatcttctatgacagaagtagtaacacgaaattaatttagctctacatccgttctgtttatgaataacggtcgaaaacgtaataacccaaccacgacgacatgaaaaaaagaaagacagataaaacggtcgaataactaaaacaagttgctactactatttgaaatttgaacaactgtaacggcccaaaaactggggagtggattctaatccctcgagggatatcccctcgtatacctttttcttccaaattcgatacaaatagttatgaaaaattctgaaaaaaattaacaatgtagagtataatgatacctactagtccaccaaaattcatgttcaaattcgatctacacatcgagaaacaaaagaagacaaatttagatataaacagtacgctactattcatacgctgaatttgtctttttatatctcgacgtgtgagttgagtttggaattaagattttgtagagttgtatatatgtgttgtatgaatgttgtcaaattttttcagtatttttcataaccgtttagatggtttttgagcaaacgagggaacatcctcgagggattagaatattttccccaaaaactggaaataatcgaaagagtcgtcgccattttctctcttctcctcctccgctcctctgagtcctctcctctccggctctcccctcctctgtcgggaagggaaggatccaagccctcgccctgctccgcctctgatccccgccggccgccgccgccctcgcaaccctcgcagcagcagcaggaggaggagggttcaggtggtggttgccgtcggccgatgtcgagcagcctagcctcccgccgctcgtcgtcgtcgtcggcggcgaagcggcccgcggcgggggagggaggagggaaggcggccgcgggcgccgcggcggccaagaagcgcgtcgcgctcggtaacatcaccaacgttgccgccgccgccaacaatgcggtacgtgaaggatcgcttgctgctgcttcttcttcttcttttttcctttttttttctctccaagatttgttctttgctttgcgcggtttgggtggagatcttttggtgtgtgaggtggttggaatggtttgggggtggctttttttttttttttttttgcttcttggttcctcttggggcacaagtgagtcgctgttgatgcggaaatggccgaagcgatctgtgtatgatttttttcttttttggtttttttccatcttgtttgtggaggacatacgcctcgatctgttggtttcaagcaaatataaatagtgtttcttgaattcgtcttcttgagttctttctttcagccaacaacaagattttcatttcttcaatttctccttggttagcctacaaacgattctcctcttccaatccccaatatattcttgccttttggtttttcagtgctcttcacattcaaatttggacctctgccacattcttccttgctgattttgaggattctcctattccaatccacaagatttttcttgctgattttctggtttcttttcatggttaattgattgattgatttcttggggagcatccaggtcaacaggctaaattcacttgagggtttattggcaccttcagaagttcaaaataaaagctttcttggtattcgctaagtgttttgtatgtttgcttgctttggaatcttctattggtaatatgatacttgcgtgctgctaatgtttctaataaatatttgttccttttcatgcttgtggtctggaatcccaaatgaacagattgaaatataagttctaaattgatttcttgtcttcaatcctcctgcagaaatttaattcagctacctgggctgcacctgtgaagaagggatctttggccagtggccgcaatgtgggcacgaatcgggtctcggcggtgaaatcagcttccaccaagccagcttcggccatatcccgccatgagagcgccccacagaaggagtcagttcttcctcctaaagtgcttagaattgttccaactgctgcacctgcacctgtcactgtaccctgcagcagcttcgtctcccctatgcattcaggagattcaggtggtgtttacttccagggacttaacttaagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctcagtttcggttgatgagacgatgtcgacgtgcgactcaatgaaaagcccagactttgagtatattgataatggggattcctcctcagttctaggttccttgcagcgaagagcaaacgagaacctgcgtatctcagaggatagagatgttgaaggtgtgttttggttgctgaaatgcacagttatagctagaaaaatttgtgctatatggtgcattctattggaatggttgattgatcttttcccttgtttgtttcgcagaaactaagtggaagaaggatgctccttccccaatggaaatcgaccaaatttgtgatgttgacaataactacgaggatccgcagttgtgtgctactcttgcttctgatatctacatgcacttgcgcgaggccgaggtaatacattcttgactaaaccttatttctctgaaaacatttcccttgagcaccttattgtagtatgttttcataggaaggctttgttttgcttcctcatgatttgagacttgattgcatccatatgaaacacaagtaaaaaaagtttactttgatgagaccataaattaagaagagaataagtgcacatcactgatataaggcattattccaatgtaatttatcaggatatttttcacatttcaccacaatccgttcttttctgcttttcgctttgttggtgcaccttatcatctaccagacatgctttgtgaccatcaattttcagtagttttgttctgcatattatgtaaacaccttacataaaacattcttgaatacttttttttttctgaatagtgggttccatttaatggccatcatattgaaattccctatagaaccagtagaagcacagtataatatggagaaattgtaatggagttatcttcttaaagcattgactgaaccgatgaattgatacatttcaattgttgtaatcaatgctcttgaagtatttttcaattgctcattatttttgctgtgacatggactgcactactgcagtcagtttgatcaaatgacaattaatctgacctgagcacagtggtttcaaatctaggttgaatttcatatttacattgtgattttctatttgacttgaagcagaccaggaaacatccatcaaccgattttatggaaacactccaaaaggatgtaaacccaagcatgagagcgatcctgatagactggcttgtggaagtaagcttttataccgaacaaatttttttagttgattggagcctaaagaccacaatcgttacttaccactctatttgtgcttttcctttgtgcaggtcgctgaagaatatcgtcttgttcctgatacattatacctgacagttaactacattgaccgttatctttctggcaatgagatcaatcgtcaaagactgcaattacttggagttgcttgtatgcttattgctgcgtaagatctgattagcaatttttttaaatgtgtttctcagtttgcatctgagttttgtgtactgattttggcttgttcctatatcagaaaatacaaggagatatgtgcacctcaagtagaagaattctgctatataactgacaacacatacttcagagatgaggtttgttttgcatatctgtgaacatttctatgtttatctccatgactaacacatagattgtcaggttttggaaatggaagcttctgtcctgaattacctgaagtttgaaatgactgcacctacagcaaaatgctttttgaggttctattctctttcatctcatcgatgtctataatgctggaatgaatcgaactctaataactatcttcttgcctacaacaggagatttgtccgtgttgcacaagtatctgatgaggtgctgctctcttaatcatctcctgcttgctgcaatttcatactatttatatgctgcattgcattaacagcttttcatcgtgcaggatccagcattgcatcttgagttcctagccaattatgttgctgagctatcactgctggagtacaatctactttcttaccctccttcactagtagcggcatcagctattttcctggccaaattcatactgcagccagcaaagcacccttgggtacgtggtggcatcatcatattgaactttccatacatcttttatatcaacattcaaataaaaaaattacaagagctaacatatgcttctcattgtaaattggaagcagaattccacccttgctcactacacacaatacaagtcgtcagagttaagcgactgcgttaaggcattgcaccgccttttctgtgttggtcctgggagtaaccttcctgcaatcagggagaagtatacccaacataaggtataaactgcatatcctccccatttcttcagttatctgtactgttcctaatgctgcctcctgtacctttgtttctgcagtacaaatttgtggcgaagaagccctgcccaccctcaataccgaccgaattctttcgcgactcaacatgctgaactagaaaaataaaccaaggattagttacagttgctgactgaattcttcctccagaggcacctatgccaggttgtgccgtagaccgttcagataagcttgatgcaaggcatgctgcttgccccccctgttctttcaggtggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgctcttgtgaaattctcaataagagcaccacattttcaacagtgctcattctgaataagtgctactagtgttcttgatgtttctagtaaaaaatactctctccgattctaaatatttgacgctgttgacttttttaaatatgtttgaccgttcgtcttattcaaaaaatttaagtaattattagtttttttcattcattgttaaatatacttatatgtatatatatagttttaaatatttcataaaagtttttgaataagacgaacggtcaaacatatgctaaaacgttaacggtgtcaaatatttagaaacggaggtagtatcaacttcagctttttttttttcaacctgttctgttcttctgttgacagatatatgcagctgatgtgatcgacttaaacatgatgattcagcgagattcttagataaaagcttctgacatcttttccacgaaagatgttttcatggacaaatgcatttaagattctgaaaatgaaaaatactacgtccatcctaaagtgtccaatgtttgaccgtccgttttatttgaaaaatttatgaattattttttaaaagtagtcacacataaagtactattcatgttttatcatctaataacaataaaaatagtaatcataattttttttaaataagacgaaaaatcaaacataatcaaacattgaagataaatagtgcaaaactgcacttattttgggacggagggagtatttgtcaatgcaacctgttgaagaagtgatgctcaagctatttccatacttgaagctaagcacagctgtttagacatgcatgcctgcgtgttgcatcatcatattgtacttagagctaattaatcacctatactaatataaaaagcattacttgtagtctttgctagctacactaaaaaaaagtgtacacaaattaacctcaggcaccctgcaatctaattgttgagattacaagttccagcttgtcttgcaatgcaacaggtgaactcacagattcaactccaccttggccctggcaaacgcggcggtgtgctagcaactacacgttccaaaatataaaaacctataatcggatgagacatttttttctggtactaagaatcggccaatccagattctcgtctcgctggagtctcatcctcgtctcactggagtctggaatctatagcaacgttgtttacagtagagttaacagaaattatcaccgtctaattaacttgctactgctttacaaaacgggagacaatcagacaacgccggggtgggttgaaaaggaagaaaatgcaagcacaggcaaatgccgacgataagatgactagatgagcaaggctactccctggggaaaaggctttgcttgccatggattgcaacacaagattaaaaaaaaattacaatacagaaagaatgattcgaagcatgagtctagcaaggttaaatcatcactgagctaggcctacaacatgtcgagttagaagtcctcttcgtcgtccagatctggatcatttgatggccgtattctcttgccgtctctccctccagggcgacctcccttctttggttttcctctgtccaaacacacgaggggtcagaactaggcaattctactaagggtgtgtttagttcacgctaaaattggaagtttggttgaaattggaacaatgtgacggaaaagttggaagtttgtgcgtgtaggaaagttttgatgtgatggaaaagttggaagtttgaagaaaaagtttggaactaaacaagggctaaaagggttgttcctagaaacactgttttttttaatataaagaagtgttagacaaacactgccccttgcaaggatgtatgtaaagctgataaggatagcacattttttgccacaaaggtaatctgagcacttactgcccgtttgcaggagtggttgcacctttcgaacgacctgatccatattctcttccatctgccaggatgcagctagtattgagcccagagtctcaattgttcctggtttcagcttaatgaaaacaagaaagagaacttaccatctcgtccagccatatgttcatcgacctggaatgaatagaaaataatggtatgtattagcaaactcacaaatatcagtatagcacagggggaataacaatcatcaatcaaagcaaaccaaaagattaaaaaaggggcacgggcttttcagtgcattaggatttaggatcattagtcataccgctggagatgtaaccgatgacagggagaacagcctctcatcagcctggaacttcctggagcgcttgagactgaaaataataagatagaaactgtcataactaattctgtgtgatctattagcagaacagaaatgataaaacatttgcttgtgcagaataatgaacacgcaacattatgccaatggtaatcataaatccaaccctcccttggtgatgctagatagtgcatatagagcacccctgcaattggccaataaactgacataacactatcatagcatattttgggttatgaatctgttgtataatacctgccactgccactatagtgatcagaggatcttttgttcatctgatcattagtaaattatatgtgatcagaggatcttttgttcaacatcattcatctgatcattagtaaattatatgtgatcagaggatcttttgttcaatatctataactataaattattcatccgaatattagctaaattatatgtgatcagaggctggtagaaagttcaagggaaggacagtaggtcattcaatcaacagttgaaagtaagcaaagaatgtggcatgaattctgaaggtttcgaactggtaagtatacagtgggatgtcaaaagaaaatgaatgaagacctccaaatagtaaagggcgtagcagtctaagaaaataaagatttcttacttggaagtgttctttgacgatgataagaatgattcaaaaccctttagcacacttccgaattgattagactcttgtaggtaggttgtctccatttcataaacctgcaacatatggacataaacatcatttgcaggttgtataagaacaattctgttaaaagcatgaatagatattttgttaaattatgagtgtttaatatcatatacaaaacttccccttaaagtcaagcaaagatggttgacattatagatcatgtgttgttcctggtattaaagagcgactgttttgttctttctaaaaaaaacacacatatcagtgccattaaaatacttgatatgagagcaatagcactttcctccctttttaggattatggtttctactaaaccaaacgctcctcttatttaatgattttggatgacacaccaagattcaccatcacaaacatatattggaatttggaccacatagtgtaactttgaaatactatgaatagaagtagctcatttgatacttgctgcgaataatttctgactaagacacagtagaaactccacattttaactcgaggatagaagaacagatggaattttcaggttgtagctaactgattttcttttttaccttagaataacaaagtgttctcaggcacaaagaacaacatacaagaaatagaatggtcatattcgacaagaatatcaaattgatactttcttcccttcctcctaattctatccaaattgttcgtcacaactgatcctctctgtgaaatgacaatcagtggtcactggtccagcatattggttccaaataggttcatatttctatcattcccaaggcattaagaaagattgaacaataaattcaggctactacaggtatccacaactccaattttacaaccatccgcagcaatgtaaattcgcaccactcattcgcatgttgagcaatggcaagcccttgccatctgaacatatatgcaacaaatccatggtctcctatacaaaaccctaattccaagagagagagagagagaggcgcaaaagagacagggaacagtgtgtaagacctaacctggcgctctatggagcggagctcctcctggagcttggcgcgcttgctcatcagggcggagagcatcgccgtggggttcgcggccgccgcccccgagggtgcagagcccgacgctgccttgtgcgatgcccctcctccgcctcccgagtccatggtcagggtttctagggttcgagttcgtggtttgcctgtttgggcgttcgttctgttttggctcggagacagttcactgttgtggagacgacttagcccctcctctccaatagtacgatcggtcctcttagccaaggtaaccagtatcaagatactatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaatttttttctgttgagggatgaatttcactccaaataacattattggaatacatttctgcctataatctaagatgcacatgttttatgagcgatttgatcatgaccacaaacatgagataatgtccataccctagttagttgcccgtgcattacaatgggaaaagagcatttggctatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaaccccccaaacttttgggggaacaacaaacaaactcaaactgttacttgtattaaggttaaaggctctggaactaagagaagagcttcttccagatctacaagagaagctagggtttaggcaagcaaattccaagacagaagcatccactctagtgttgtagtcattccaatcggcagagtctataggcattttaacacccttcgaagacatattttgagccatgcctgtcatccactcactcacaccaatacttttttcaatgccaacatatatcataggttgaaaatttgagatgcttcattttgactagagtttacaagcttgacatttatatgtacagaaactaactacttccacccagccatagcgaaccatgcttgtgctactagtgatacacagggacttatataataatgactagtttttacaaagcaaatgcgaaacatacagcctgttggaagggaatgtgtcatgagaacatttacatctgcagtaaactatatctaaagaacaataatacagtgagaatatggtttgctcaagtacagagagaacatacaagtagtttgctcaatttcactgaccaattttttctagaaatctaagtacagtgagaatatggttgaaatatatacactaaaaatcaagcaataatagacacacagatcgggagaaattttaaccaacatctaggcaatcaatccccaaaaaatgaaccagatttgagggagaaagtctagggtttgagggagagagtctagggtttagggttaccttcctccttgcaccagatctgctatgccgccgccgttgtctagctcctgccgtgcgcctcctcgccgtggggagccgctcccgccgccaactgccgccgtgagctctcagcggctaagctcaaccaccgtgcgccgcccaaacttctgcccagcgccgcccaaacctcagcccgacgccctagccgcgagagaggaggcagtcgccgccgccgtgcgccgtcaccggcaccgcctcctcctcctcagtcctccctccgaccctccccttctatcttcgccccctctctcttcgcggaggagagcgatgcgagacccgactcggggatgcgcgattcgcctcggtgcggatgggggaacgaaggggtagggcggtggcattctgattgtaatttcttcgaaaagtaatgggtagcgctgtaattaagatgggagtggagctgtggagtggcattttcctcgctccaccgcgctagtacattttcgtggagcgattcaccccgctccgctccaagttttggtgaatctggaccgtttggcacaactctagctctaggtaagttggagttgggagctggagctgtgccaaacgggacctatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaaatttgtgtttcacaatttttttatgttgagggatgaatttcactccaaataacattattggaatacatttctgcctataatctaagatgcacatgttttatgagcgatttgatcatgaccacaaacatgagataatgtccataccctagttaggtgcccgtgcattacaatgggaaaagagcatttggctatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacataatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaaccccccaaacttttgggggaacaacaaacaaactcaaactgttacttgtattaaggttaaaggctctggaactaagagaagagcttcttccagatctacaagagaagctagggtttaggcaagcaaattccaagacagaagcatccccggtgagagagagagatgaatcatcagaaagaggatgcggatgctcaccaggatccccttgctcgccggatggagatcggcgaccctccccctcccctccccagttcagccgcaaatggcgcaagaagcggatgagacgacgagacgggagattttttttttctcttttacgcgaagggaagggggaagagatactcgagtactccacctttagctcagatttactatgttacccattatgtgtagcaggccaaatgggcggcccggcccagcatagctcgggcccgctgatggcacggcaactgtaatgggccgggccgtgccgtgccaggtcttgggcagaacggcccaaggaagtgttgggccgtgtcgggccggcacggctactgttgcatggaccggtggcccacccacctgcacgagaacgttattcgtgtgaaactacagtcgcaagttttctatagtaggtaacacaattaggcaaaattgtgtttatatgggtatttttcattgtcaatattgtgccattatagccgtgttaaaaatttccataatttcctttggcacaactaagagaggtttaggggctgtttggttgatgccctgagaagaacttgcctgagtgaagacaagcctgaggttagtttgaaccttgttttggttgctatcctgagatcaactaccccttgcctggcctgattccttctgacttgcggttagcctgagccaggtgacccattttggtcgccagaactccaggccgcaacagccaccgataattagcgctgctaatccatcctgctggcctgcgcagccgagtagccgacaccccagatgccgcaccaaccccttgcccaatcctccgttcaattgttgctgctcgaagcttcaatgtcaactagatgcaagcgatacttgtgatcatcgtgcaattagatggactgctagtgtatatagatgagagattacttttgtaaaatgaatacgtattatatttttacgctttgttcacataataaacgtcattcaatggttgtgttttcagctcaggcacgcttgacctcagacctgcaaccaaacagagtaatctcaggcttgcctgatcaggccgaacacatcaagatctcagggagatttcaagcagcactttttcttcaggcatgcagctgagggcaccaaccaaacaagcccttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaaccgcctaacaaagtgctccatccggtcttaaaaacaaaggtcatgtttcctgcacaaaaatgttacaccctatcacatctgtcggagatataggcccgggggtatgtggagtaaaggagagctacttccctttccagccacacggctccgcgagctggtcccacccacatacctcgtgagtcactaaggcgaaggggagagcctcgggggtcgacgacatcccctcgggggtgacgtcaccccctcgggctctcccgtcgttttaccccgaggccctctctcggggggaagtgtgagaggggagtccaggctgggcggccataaatgtgcagcgccccaaccgtccctcgctgcattcaatgcggcgggggcagacgtgcggtgcgcccgaccgacccctgtcagtcggatgcgaccggtctgtgaccagtctattgccggtcacggccgattggacgggcggtcgtgcccccacgtcgcctctgtctccgcggagtggcggtaggtacgccccatcacatccggacggcgtttgatgcagggctgccgcaagtcttccctcgtttatgagggaatgacagggctgccccccgtgtcaggcgggagacggcgctgggccccactcaaggaccgaccgatgcttagcttccaacaaaaggcacgggttgaaacccggtcgcagtagggagaagggccccctcccctccctccgatggagggggagggtagagacggcgcatatggtatccccttaagctataaaaggaggaccttgcccaccaaaaagagggggagcgagggaaaccttttaaaattcactgataatcccaaacgtaggagtagggtattacgctccagagcggcctgaacctaggtaatccatttgtgtgctagctaatcggggatcggagggacgaacacgcgacttcggagagacgagtctctgcccccggccgaactcacgaaaggggggtcacgcgactccccgcgatcgggggtcttccctcgacagctggcacgccaagtagggggcagttgcgcgtttgagaagaagtcgcttccttccgtcccaggtcggaccaggccctagaccgccatggtcgaggtcctggaagcagaggaagcggtggcgcctacccccaccccgtctgggagtggggattcgggcgaaaaccgtgaccctcgtcaccatcgccatggctctcaaagtcctccccgccgcgagccttcgcggagggaggatccaacccgttcaagcggtacggccctctccccgcccccaggaggagggaggtcgcgacgcgtcggagcacgtcgccgtctcgactacggagacggtggttcgccccaaggcgcgcttcaggtggtgggcgcccttctgcggcatccccaggtgaacccggagccggagacccccgtgcggcgctggctggacgacgtggccaacttggtcaccgctgcccagcggcagttggccacgggtggccaatccaccgccacaggtacatcgagtaccccggctaccctttcctcgtcggcgaggagaagggcccgtcgatcggccacaaccttgaggcgatccacggctccaacgacatcggaggtctcgggaaggcggaggcgtcatgatgacctctacggggcgcaggatgctcgggtcaacatcgagcgacgcctggacgagcgccgggctacccgcatgggggaaggtgcctcctcatctggagtgccgcgctcttcttcgcgaggcggccctccccccacgctcacccctgggaggggcaggttgtagggctttcgttgcgagtctccagaatgtctggtggcccccgaagtttcgccccaatctcacggagaagtatgatggcagcatcaacccctccgagttcctccaaatctacaccacgatcatcgtggcggcagggggtgacgaccgggttatggcgaactactttcccatggcccttaagggtcaggcgcgtggctggttgatggcccagctccccgactccattcactcctgggaggatctatgccagcagttcgtcacaaacctctaggggacatatccctgcccgggggaagaagcggacctgcatgctgtgcggcggaaggacgacgagtccctccgttcgtatatacagcgcttctgccaggtccgccacaccataccgtgcattccagcccacgcagtagtgtatgcattccggaacggcgtgcggcataaccgcatgctggagaagatcgcctccaaggagcccaagaccaccgccgagctcttcgagctggcggacaaggtggcccggaaggaggaggcgtgggcctggaactctcctggcaccggtgcggcggctgcggctgcccccgagtctgcccctcgctctaagcggcgagataggagaggcaagaggaaaccggcccgttccgatgacgagggccatgtccttgcggcagagggcccacgtgggccccgcgcaaaggaaagattaccggcgataagccgagctccaccaccccctccggcggaggccggtcggcggacaagtggtgttcggggcacaacacttaccgccacagtctcaccgactgccgctcgtcaagaacttggccgagtggttccgaaaggccgatgaggaaaagcggcagggtcgacgggagggcaaggctcccatgacctcaaccagtgaccagcgagaggaggccaagaacaaggcccccgctgacgatggcggaggtggtgaggatctggatttctagataccccaagggaccgtcgccacattcgatgggggggcttgcgctcgcacttctcgtcgagggttcaaggctatgaggcgggaacttctggccgctgttcccacccatgaggcgatccggaaggcgtgctggtcggaggtaaagctcacctttgaccagagcgaccatccgacggtactcgctcggggagggaagttggccctggtggtctccccgactatccacaacgtcaagatgaagcgtgtgctggtggacggcggggccagtctgaacatcatctccccggctgcctttgacgcgctcaaggccccggggatgaagctccaaccgtcgctgccaatcattggcgttactccgggacacacgtggccgcttggtcacgtcgagctcctagtaaccttcggcgactccaccaatttccgcaccgagcggatcgacttcgatgtggcggatctcaatctgccctacaacgcggtcctgggcagacccgcgttggtaaagttcatggccgccacccattacgcctacctccagatgaagatgccgggtcctgccggtcccatcaccatctttagtgatgtcaaagtcgccctcgcctgtgcagaacagcgcgcggacaacctggcggcggccacggggccgcaggccccggaggcccccgcgtcccgcgcccccaagaagcgcctcaccttggccgacgaggtgcccgtcaaggagattccccttggcgacgatccgtccaaaaccgctaagattggcgaaaccttggacgccaaataggaaggcgcgctcatctccttcctgcgggcgaattctgacgttttcgcatggaagccgtcggatatgcccggggtccctagggaggtgattgagcaccgccttgccgtgcgaccggatgcgcgacctgtccggcaaaaagtgcggcgtcaagccccggagcgacaaaccttcatcagggaggaggtggcgcggctcctggaggctgatttcatccgcgaggtgattcatccggagtggctggcgaacccggtggtcgtcccgaaggccaacagcaagctgcggatgtgcatcgactacacagacctcaataaggtatgccctaaagatcccttccctctaccacgtatagatcagatagtcgactccactgcggggtgcgaccttttgtgtttcctagatgcatactctgggtaccatcagattcgcatggctagggaagatgaagaaaaaactgccttcattactcctgtaggcaccttttgttatacaactatgccttttgggttaaaaaatgccggccctacctttcagcgcatgactcgaattactttaagtaatcagatagggcgcaatgtagaggcgtatgtcgatgacctagtggtaaaaacgcgccgccaggacacgttgctgcaacacctggccgagactttcgatagtcttaggtccacacgtgtaaagctgaaccccgataagtgtgtgttcggcgtgccggcgggcaagcttctcggttttctagtctcttcccgaggcatagaagcaaatcccgagaaaatacgcgtgatagagaggatgcgccccccagcaagctcagggatgtgcaatgtgtcgctggatgcatggccgccctgagtcgatttatatcaagattgggcgagagagcgctgcccctattcaagctcctcaagcgccccaggccgtttgtatggacggaggaagctgagcaagccctcaatcagctgaaagcttacctcacttctccccctatcctggtggccccggggccggaggagccattgctactctacttggctgcgaccccccacgtggtgagtgccaccctagtagttgaacgcgaggagaccgagcaggaggtccctccggctcgtgatggcccctcgtcccccaaagcccccagcccccgggaggaccccgaggcccccggaggagaaggcgaggctttggcaggaggccccgagccctgtgatcccaagataatccggaatcccccgggggcccccgagcaggcgcgctccggatcatccgcccctgacaacacgaaccggcccgcccgaacggtgcagcggcccatctactttgtcagcgaggcgcttcgggatgtgaaaacccggtacccgcaggcccagaaaatgctttacgccgtattgatggcctcgaggaagttgcgccattacttccaagcacatcgggtttccgtggtaacatcgtaccctctcggccaaatcttgcacaaccgagagggcaccggacgggtggtaaaatgggccatcgagctggctgagttcgacctgcacttcgaaccgcggcacgcgatcaaaagtcaagtcctggctgacttcatcgcggaatgggccccagtggacgaccctgttccgtccgaaccccctccctcccccgaagagaaagaggacccaaacgccgacattcgtggcggacactggattatgcatctcgacggctccctcacccttcaaggcgcgggtgctggagtcacactaacctcgccaagcggagacgtcctcaaatacgtcgttcggctcgacttccgagccacgaacaacatggcagaatacgaagggctcctcgcaggattgagggcggcagccggaatgggcatccgccgtctcctggtcctaggtgactcccagctggtcgtaaatcaagtatccaaagagtaccaatgcaccgaccctcaaatggatgcatatgtccgcgaagtacggcgcatggaacgccacttcgacggaatcgagctccggcacgtgccccggcgcgacaacacactcgctgatgagctgccgcgtgttgcgtcggcgcgagccccacttcccccggggacctttgaagaaaggcttgtccaaccatcagcacgaccgaacccctcgaggggctccaacgacatgccctccgccccgattccttccaactcgcgccccttggagcccgagggggtcgaccccgacccccctccgcgcccccggggcccgagggggtcgaccccgacccccctcgccaagtcgcatggatgactaatgtccgggcgtatctcgacgacaatactcttcctgaggaccgcgcagaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9053 - DNA, 20708 bp, Oryza sativa
tatatggtaaaaaaactaaaatgcaacaacaaaatggaaacacatttcaaatgaatgtattacatgtgatggagtcagtagaccagcagggcttcgccgctccccttctcctccccctcacccctccctctttctctttttttggattttgagtgaatacattgaaaattctcatagggggaaggggttttatagtggggaggggaaaaatcgccctccctaagggcggcaagggggcctcctacaaaattccaggcagcctcgccgtccttttgtaggcgcccccccacacagtggtaaatcgccctccctaagggcgacaagggggccacctgcaaaaaaaccaggccgccctcgtcgccctgttgcaggcggcccccgaacagagcaaaaccgccctccgtaagggcggcaagggggccgcctgcaaaatggcacgccccccatagccggccgttaggaatgacctaacggccgtgtgccacgtcacaaaaaccaccctttgggagggccccaagggcggcgggcgactagttttgtaaaattttcaaacacaaaattagttttgtaaatattttaataaaaaaattaaaaacaaaaaaaattctcttccggaaaggttttataaatccactagaccattaggcgtgcctttcccgtgccctagccggagtaaagggtgcatcattaagagggcgatatatttttagatttgggaagggaaatttctaaatacttaaaccacataattgtgaatggtaacatgagccttgctagtacagaattggtaggttgtggtgtagagttgcatataatggaacatggtaccgtcattagtaaatagcatagtaagtactggtcgatggtttataaactgatcatagatagtttttacatggtaggccctagagcaaaatcggctacacgtattaggtagcctgattgtgccatatatggtctattgtctctaggcactgttacacaaaagcagtgcatatggagatagcatcagtaggctggtttcatggacaactcaaaaggcattgttcctaaagctggcataggtatattacagctactcttctgagacaatataaaccactgcttctaagcgcttcctaatataaaagtggaatatgcagatagctccaatgcttatgctattctcctccatgaaagatttccatcctgttgttaagttgcagcgtccatctgttttgctatgaactctgtagaaaactgcgttgtgaagtattagaaaaacatattgatgttagttgagtatgtgtaaaatatacttgcattgatgtggattatgaaaaatgtataccactctgccttttaatggctgttgcattgatggacattgttggaggcatgccacgagggccttcaaccagacctgccaaaacagtctaactcgcgaggaattaagccaagtctagaagattcggttgaggcgatgatgtggactagggttcccgatctttcgaaaggttctgataaccaataatttgggcggactcgcgacacaaatcgatccggcatcttgatcgaacacgctcttgagccccgcaatcgcaacaccatgtctcctctggttatcacccgtatcgaaacgcggatgacctcactgagaaggctaatccctgtttgccaatcgaagaacacaaacaagaacaagatagaatacaaccaaaattgcagatgaatgattaagctcactagttggggtcttacaaaccgatttagcggcgaaactgttctcgatagaataatctaagcaaaacccgactctaaatgatgacgactaaagaataaatatgattagagatgtcctagggttggcctagggcgcacacccccttgagctaatgtaacgccccgattttcgttcgggattaaaaatcaattaataatgcatttctagaaattatattaaaagttaaaacaatttattcgagtgaattaatgggagaattaaatttttcccttaaaaatcattggccgggaatattttgcaatattctttgtgccctaaaatattctctgaaattttctcgtgaattttcggagctcaataaataattttaatagcacatagatcatttaatcaattaattaaaaagaaaaacaaataaaattccctcttctccctttgggccgctttcggcccattcccctccttgctcctttcccttccggctgggcgcctccctcccctctcctctttgggctgctcggcccagttcagctcccctccccccccccccaaagtccagaaaacccccacctggcttcccctctctcttccattggctgacaggtgggacccgcagccccacctgtcatccccttcccctacctccagccaccccatcgccagggaccggcaattgccgccccaccctgccgctaaaaccgccgcctcccgcctccctcgcgcacgttcgaccgtgcggatgtggtcgccacccactcctcctcattttcccccacttttccccaaaaatcacgccggtttgacctccctcgagctccatgtcgccaccccacgtcgccggccggttgccgcccgattccgctcctttcggcaacgatttccctctcctgagcctatataaacactgtccatgcgaccctcgtccatttccccaattttcccgtactccccacactctctcccgctctccccacgcgagcccaagcgccgccgctcgccggcgactctccagctggctgctgccgccgctgccgccgtccccgcgccgcgccgtttgcgtcgccggcctcgccgcgcgttgccgaaccccgtccaccgctccgcttctgcaataaaccacccgggcgccggtttcaccgtgcacccgagccacagccgcctctcgtctcctccagtcgctcgccaccgccactcgcgtcgctgccacgctgcgccaccaccgtcgaaagcttcgtcgtgcctcgccgcaccccggcatccgattcgtttccctaaatcgccaccgcaaccacccctccaccgtcgacccgagccaccacctccgtttgtcgactgcagccgcgtcgtcccactgctttggtcgtcgccaacccacgtcgtcgcctccctcggctccgcaaggacgaggaggtcctcggccaccactccccgtcacccgaatcctgccggaactccaccttcatcgcacaccggtgagcacccgctagtcttctttcttccggccggtgattcacgccgccgggtgtctcctcgtgccctcctaatcccgccatccccttccccaggtcctgctggcgctcggtcgtccctccgctttcgccggacgtcgccggagtcccgccgtcgccgtgcctcctcgaggagcttgtcgccgccgcgttcccgtcgtctcctcgccgttgcgcgagctcggtgagcatccctcccttaccctctgtctccccttcaccggccgcctggcgacgcgccaccaccgccggtggccgtctggccggttcatcgccgccgtgctccgcgcccgcacctctgccggctgtgctgggcagccggctgccgcctcccctcgccgcgccgcgccgccactccctagcgtgcgtcgccgctgcccgcgtgcgctgccgctccccgcgccgtcgctagccgtcgccgccggtggtcgtgcgccgccgcgcgtcgtgtctcagctgggccggctctgagccgtgcccgtgctctaggcgccttgccctgtggctgcccgtggaccacccgttgtctcggtccacggtgccgccccggccgcggtggaccgtgtccaccgtgcgtctccccctttgacccgctgacgtgtggggcccgcgtgtcggcaccggccgccccttgctgacgtcagcgatcatcttttcctttgagaaattaaataataattgcgcaataaatcaataataattctagaaattcatttaaatggctcaaaacttctaaaattcatatctaattcatatgaactccgaattgggccattcaacttgcaaaattcatctaaaattgagctctacatgtttgtttactttttatgtactgtttccttggtttttactagggtttttcctcgttttgcgtgcctgcgtgtagttcgcgtcgtttcggaagttcgcggtcgcgaggatcagagttcagaaggttgtagtgaagaagcaaggcaagtcacacattccccttgagcatgttgatcccaatttataaatgttttaccgtttgcaaataaacatgcatgtcttgctaattacatgggatccgagtattacctatctgctcgcttgtgccaatgtttacttgatatctgtcctttgtcaaccttgtgtgataaatcaactagctcatggtacttatgtgacctagctagaactatatgcttagccatgcttaattaccactagctcagttgatgggataattacagtattagacctttttagtatcagaatgagctgcatgctcgagacatctgaccatgcttcgtggtcttaattatccaactaaaatacaactgaatggtgggctgtgggtgcatggttttgctagtcgcatccatggcaattaaggaccggttcgcgggatgccctggaagaacttatcgtacttaccacaagccagcgtgggcaacggctgggcttgtagtgtagctttcgtctagccgacgcatcctggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggagttatgcaaagggtcctgtcatgggctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggttgaccagattcaccgtgattagtcccaccttaataaatcgactcaatgcactgtagatcagtggtgatttaatgttactttaattactcaacagttttactgttttgctaaataaaatgttttacaaccgcctttatgcaaatagccacaaaccgtccctttgttccccttgcacgtctgcatcattggtgtggcttgctgagtacggtggttgtactcagccttgctattattcccccttttcagaagtgtagtgcttctgagctgaagatgaagttagaagaccaaggctcagaccccagttgagttttgcctgtggagtggagctgaagccccgctaggatcgcctttttccgctgctgtcgttctgtttcggtgtgaggactaagtgcctcttctataagtattttacactttatttacgtttggaaccgtatattacttgtcgttttgtgtaccctggctggtcctggacagggatttaatacacaaaatagtctggaaatttgggctaaatttctgggcgtgacagctaagcccacgacacaattacaaggcccaaaacacaaatcagattcggactggattagatatgtggcttgttttgcagattcacggcagctcggtaggaattttgatgtgggaccaaaatcatatgaaagtagactccataagaatcagcggctaggtccgtttgtagttggtgctgtgaggaggcccgaatccgaatccaaaacatgttgaactttatcttttgtcttctatggaccaaaagtgacgtggtgagatgaaagaagacttggagaaggttttggtttggttcccaatcaacttcttcaatcatccatgcattccttatgctcggtctcttttctttcgcccaagcaagtacctctgcaattgaaaacacacaaaactcattgtgtagcaacgtttgttcgaatatataacaagtaaatctaatataaaacatatgcacctttggttgattaatacataaggtagtcatggttatatccgagctagttgtgtcctcatcaggcaaagccacaaggtgaagcatgatggcaaagatcaaaagatcgggtccaagctcgacaattcgggagacatctgccaatgggtgaaagccacatgtcgaaggccatgtggcaaagcatgaaggcttcaccctagataaaacacagtcgggagaaaaggattgaagggccgcacagtccatggaggcctttcgccatagttgggccgacctagctagcccattaagagcccattaatgaaaaggacactgtgtgcctcactaatgtccttataataagggtatccatgtaaatttccctgtacaacctaaaccctagaggatgtaagcctgtactaagactataaatagtcccctggagacatgtaaaggggggatcccaaacaattttactaaataatccaacttgctgttgagtgaaccacgtctttcgacgtgacgtggttgtcaatcgagaatagttggcaccgaccatggggatctcagggcgaaatcactgagaacaagagcgaaaccactaatgccaccaaagaagatcgccaaagagagagttaccaccaagcataagtagagtgatgatgaagtggagatggctggcgaagagggtgtacagcttccagcagccggagttgttgtagcacctcttcaaggggtggcgcctccttgtcacaccttgattttcgtcttaggatttataaattatttaataaattattattagaatttatattaaatgttcattaatttacaagtgaagttaaatgtgggaaataaaatttcctaaatataaagcatggatggatttaatttttattaaattctccattgttaattatactctctggaattttctcggatttttttcggagctcaattcctaattttaatcatacaaagaacatttcagtaaatacccacatattaaattaatcattaaatggtctaattatatttttttaagtactttgagtgtccaagtattttcaggatttttcttgaaattatttgagcattggaagtatttttaacaattcaaagatcatttaagtgattattttaattggaaaagtaataaaaatcctcctcctcagcttgggccctttttggcccatttcttcctcttctctctccctcgcgcgcgtgctgtgcagtccaagccggcccaagtcaagtgctctgttctattctcagccaaccgaaaaagtctaatttgcctccctagacactgttcatcttctacctctagcagccgaactgagaccgagtgggctcggtttttcccctccaaatccgaccttttcccttgtgttttcctaaaattagttgaggggaaatattcctcttatcctcctctatcctttcccccaagaatcagactttatcccgaagaaatcaacgcggaatcgaattcgttttcgagtttatctctccaactaaccctcggtttttccggctcaaatcctctcgtttggagtccgatctctctaatccaagcctataaatagcatcccctagtcgccctctttcgtttgccccatctcccgagccttctcgtgccccgtagcgccgtcgccacgccgtccaagccgccgccgtcgccggccgacgaggagccgcctcgcgccgccgcttgcgtcgtccgccgcctcccgtcgccgccgttaggtgtgcatggcggagtagagtcccggccgccccctccccgctgtcgccggtcgccggagagccgtcgccgccgtcaatcgatccaccgccgccagacaagttcgtcgccggccaccatccgtcgtcgttcttcgttttggtgagcaccgttgagttcgcaatgttgtcctctacgcgtaggtgccctccaatcgcccagccaaggtccgcagcgccggcaaggtcgtcgtccaacccgtggctgccgtcgatgacgtcagcgatgatgtcattaatcccttttctcggttttctttttagatgcaaatcgattaaaacttcggaaattcataactaaatcgccgtagctccgattcgagtggttcaagttgctaaatttttctaaaatcgagatctacatgttaaaaatatccacatgtactgtttatgcttgtttttgtactgttttgttgaattttgttctttcggtttagtttccgacgttccggaggagagcgttttcgttgaggaaggttcggaagtgtttgcggaagctcaaggcaagtcacacagatcccaaacaactctttgagcatgttgaacccgtttaaagctattgttttatttcaacttatacattattttcgaatgtcatcgcgcgggggggggggggggggggttgagcctttcctaattaattaatgggcgaagatgactttattttcctatgggttataatttgattagcatgaaccttatatattggattggttcagctaaatgccatatgtatgtttgcttagtcatgcgtagaaacattagctaattaaaggggattaaatataaattatattattattattaattatggttatatttaatgatagctcacgatggttaatcatgttatgttgattaattgataactaaaatatgataaaggtgggttgtgagcatatggttttgatggttgtgctcatgacaattaaggaccggttcgcgagctactgttgtgagacattaaccgtgccaaccacaagccagcgtgggcaacggctttatcttttgtatagcatgattcattatggtgtgccagactgtgaagcggcgagaagtccgtgggggtcgctggggagtccatgcctctggttttgagggggtgattatgatccaggaatggtgcactgtggtgagttgtgttgtgcgaagggtattgtcacgatttcccccttagcagtgccgtggtggtacttcggggcatggcaacatgtgtggaatcgtgtcttgtgggtatagtggtacacctctggctagagtaaaactatttgaatagccgtgcccgcggttatgggcgagttgagcaatgtttttcgtgattagtcccacactactcattaatggtactaatgtgctaattaatttgactcctggtttggaatggataattccttgtttggaggtttgatctgtacgaccggggttggttgttcaggtttggttgggcctgagcagcatgggtgtgctgttcagtgttgattaaaattgatgattaattactctactgttttacttctcttaaatgtttgttaaatgctgcttttgcaaatgagtctatattatgccatcctttggtatccttgtgcacttgcatatttgctgtgtggcttgttgagtatgtcatatgctcattcttgcaataatcatcaaacctcagttgaagaaaaaggatccagaaggagaagacgtttggcttataccccagttgagctgcctgtgggagtggagctgaagccatcgctagaccgttattccgctgctgttttcttttcttttgtaagtatgtaacgttatcattatgatggatttgtatattaaattgtcagtttgtgtacctcggctgattcctggacgagggttttatgtagaaataagttcggaaattactagtgaatttctgggcgtgtcactcctccacctttggcacaagctacttcggtagtccaagcttcaaccaaggtagcggcttcgacatcttaaacggccacacgggcagtggttgcggtgaaggccccttcgaccgccgccgcctctttgtcccaggcgggaggctcaacccaagccgctgccacgacccaacaagctacggcttccaccatgctcacatccgttcaagcgaacgctgacctcgaggcacaagccgaagccgacatgggtgttgtgcgccagaacatggccaagttgcacgacatgcttcaccaaatgcaagaacaacaacaagcatttgaaacagcaagacaagcgaaggcctcttgggtagccccgcaaccgccttcgtgtcgatgcgaaaaacactcacggcctaggagatctgcgtagatctaatgcaggcccaaggcttgcctcgagtgctaagggtgtgccagctgatttgatcctacaatcaacaaggaaacaaaaaagaggaggtcggtcagccgatagccgatcggccgataggccgatagcgtatcgttggtggtccccagccgattggaccggctatggactgggtatatcaaagaatgtgtatgctgtaagaatgccctatcggctaaaagcactgcctatgaagataaaacatgtgaatcgagacaacactagcaaaagagcagccgatgaagtaaaggaagagcataaaggtaacgtgccagctagtactctggcacgtacctatacagcctggccaaaccataacaaggcgtcaaggctaagccaagagtcagatcgatggcctcagctgatacgacataacctcagtgccaagttatagcagggcctgcttgtataggtggtagatacacgtgcaataatttaagaaacaagcatattaggtaagatcagctgaaaccccgatgctaaccctaggactgaccgaaaacaggctatacctctcggttctaagcacgacttagcagatcaaacctaactgattcagcactgagtatgaaaagaaacacgaggtatagacaatcaagccaccgaccagcagtcaggctggtagataccctggctaatctaatctggtaggatgatatagtcaataccagcatcaaccctaaagcgaatatcagtcgatacaactaaatcgggctaccaagctagattagacatgatatatgataaaaccaagcaaaacgcgtaatccaaaccagtgcgatccaagagatctatcgtttctgatacagccttgaacaacatcgatgtagttgatacgattgcttgggccgacagaacgtaggacttaccccttcaccggatattgaagccgatgcagccctgcgtcaagtgccaagttctgctgaaacgtaaaaacgaaagtgaaaagtaaaagggtggcgatgcgccgaagttgtattggattgtctcccatattacaatgctagggggttaatatttatacctaaggtacaagataagtccattatggacacgactcaaacattctaaaaactctgtcggagagtgatctccactagcgggaggttggaagtcccccctttgtgagttcggccaggggagcaggtgcaatgctgaggagtatcctttctcgcaatcgcgatggatccgtggaaatcgggctcacgcggttgaaggtgacacagagagagagagagagagagagagagagagagagagagagaggttatacaggttcgggccactatcgagcgtaataccctactcttatgtgtgtgatgatcttcctatggttacaagcactccagattctcagtgcacaagctagggcttggccagccttccgcccagattctggttttttcaaagaacctctctctactcgtgggcagtgtcctccttttatagatgaaggggacatcacacgcgccgcccccatcctcaaccatcgggagagggccgacattgccgatattaaaatacatcttatgccttgggccggaagcgatccgcatggctaatctcgggtggcccccactgaatccctccggctgacacgggggacgacccctatcattccttattaaatgtttggcgacttcgtgggcacacgcacattggggggtccgatccggacatgcctcaccggttaaagccactatcaactgggcgagggacgctgggcttcctactgcaaatgatgggacaggacatacctgcccccacgccgcctgacacaagtcagggtgtgggtgcattgccgcctgtcccttctatccatcgccgggtcacagactggccacagggtggtcgcaggcacacgtcggtcagcatgcgccgcacgccgtgccacgtcacattgaatgcgacaggggcggttaccgcgccactcataaatgcgcctggcggacggcactcacgcccgctcaaggctcctgcatggccgccacgtggtggctgagcgaggatgtcacgcccagaaattcccgaatagaattccaagcagaatgtgcattaaaatccccgtccaggaccggccggggaacacaaacgacaatgttgacatacagatccacgtcttacaaacatcataaaagtcttacataaatgcagcggaaaacaaaagataacaggagctaagccttgacttgaactgcagcgggaacaccactccacaggcatcctcgacggcacggacgaagcctactcctcggataacccaccatcggacacatactcatactctggggttggggaaaatagagcaagactgagtactatccactgtactcagcaagtcacaccggaataggggtatgatgcagggatttatcaagggatagctgtacaggttcatttgcataattttggcttttataaagagaagtggaatgcgaaaacagttgtaataattagtcaatattaatcatccactatccaacgctacaccacgttgtaacaggcccaaccatccacctgtactatccaatttcattagactaaactaggatgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataactccctctagccaagcacaccacacctcaggtttcacccccgtccctagcgggcgacgggcagtcccctctcatgcctaggtgaatccggaagccgcataggccgtcgcagggcccatccaaactccatcacgcccacccttgcctggatgcgtcagctagagaaaagctacactacaagcccagccattgcccacgctggcttgtggtaagtacgaggaattcttctagggtttcccgagaaccggtccttatttaccatgggtgcgactagcaaaaccatgcacccacagtccaccatgtgattcattttaattaaccaacaccaaagcggtggtactaatccaacattaccattagaacctgcagtctatatttcaatgggatttttcccccaaagtgtgctagttgaactaagcatggctaagcaattcctagtccaaagtctattcatgttataacccaagctaacaaaggagcatggtaccaaaatagcaaggctgtaacaattggtaaacatcccatattattattgcaaaacatatgcagtatttgaaagaaaacattagaacatttgcaatataggatcaacatgatcaagtgacaggcatgacttgccttgctttgctgctggaggaacctcggcgactatctcgaagtacaccggagcgtcggaagagccggaatctaaacgacatacaaggcaaacaatgcaaacaggctataagattactgaaacagagaacaaaaccatttttaatagattctacacatttttcttgttttactgagacttgaatgggcttaaacggagctcggatgaattagttatgaattttagaagattcactgtgtttattactataacaaaaagtccttaaatcatttattgcgcaataaatcccagggctgacgtcatcaaaggggggaggcggcgccgacagacggggcccgcatgtcagcggcgcacgggtggcctgtctaccgtggaccgggaccacgtgggtggtccaccgccggtccacgggatcgacggcccggatcggcccagggccgatcggacggtgcggcggcggcctggcttggctcggctcggcacaaagccagccggccggccatggcaaaggcggcggcgcgcgcgtgttgccggcgacggcaaccggctgcggaggtggcggcgtaaaggcggcggctcgacccggcgcggctaggaaggagagggaggggaatagaggaggagggggtgcctcaccgaaagtggccggtgcggagggagacgacggcgaacagtgacggcgagccacgggaggacggtggcgatgggcggacgagctccaggatgctctaagagaggaaaagagagagattagagggagggaggtgaaccacggcgatcggaagccatggccgaaggcgatggtagaggtggtgctcaccggagtgcgaggggatgcgggttccggcgacggacctcgacggaggaggggcggacggggtggcccttgaccacgcgaacccgacggcggcgacggcgcggtgcggcggcgagcctagcggcggctagcggcggccggagtagcgggagcggcggcggcgggtggatgcacggcgcgggagcgatggagagctcgggagagttcgacaagatggggaaaaagagagggggtggcggtggagcttaaataggggagggggagctcggacgtggccggtaggggcgggattcgccggccgacgtggggagtgtgggaggagagagaggcgggatttgaaattcgaatcccggccatctcgggcgcgggcacgagcgggagagagggggaaatgggtgcgggagacgcggcgcacgaccggggcggtcgacatggcccggaggaggcgggacgtgggcgcggcggcggtttcggcggtggtggcgacgtggggcgggcggacggaggaaggggacgaccccgacaggtggggcccacctgtcggcgtcccggggagagaggggaggcggccggcctgactgggcctcggcctgcggccggcccagtgggggaagggggagagggagagaatggtccggcggcccattcgaaaaaaaagggaaaaaggaaaaagaaaaaggaagaaaaggatttcctggaattaaatattgcttgtgctatttttaattggttaaaattatttagagggctctgaaaattccactaaaaatcttgttagcgtatttcgacatgtagaacttaagaaaacttccacatgccaaatccgattatgatttgcattaatttattagggttttctcttgctttagcaccaatattttctcgggtggattataaattccattttaggcttaggaaagaacttcagggtgtgacaaacctaccccccccttaaacggaatctcggccccgagattcgaggagctggcgaagaggtgcggatgggcagccttcaactcatcttccctttcccaagttgcttcctcctctgaatggtgactccactgaacccgacaaaacctggtgaccttgtttctagtcctcctttcgctggtctcaaggatatgaactggcttctccacgtaggtcagatcctcctggatatcgatgtgctccgaatcggcctgttcttcgggtacccttaagcacttctttaattgggacatgtggaacacgtcatgaatgccgattatattggatggaagctccagctgataagcaacttctccccttcgttccaagattttgtatggtcccacgaagcgtggtgccaacttgcctttcgtctggaaacggtgtactccccggagcggagtaacacgaagttacacataatctcctgcttcgaaagtgagctcccttcggcggttatccgtgtagctcttctgtcgagactgggcaattctcaacctttccctgatggttctgactttctcttctgcttccgttaacacctctgttccaaacagttgacgctcacctgtctgatcccagaagagaggggtgcgacacttccggccgtataaagcttcaaatggtgccatttggagactaacctggtaactattgttgtacgagaattccgcatatggcaggctcttatcccatgctccaccaaagtcaagtgcacaagctcgcagcatatcctccaaaatctgattgaccctctcagtctggccatctgtccgcagatggtaggctgtactgaaatttaaacgggtccccaattctttttgcaatttctgccagaactttgaagtgaattggctccctcgatcagatattatctttctgggtaccccatgcagacacatgatccttcccaggtacaactctgccaatttctttcccgtataggtggtatgcactggtatgaagtgagctaccttagtgagtcggtccacgactacccagattgaatcgtgacccgatgatgtctgcggcagtccagctataaaatccattccaatttcctcccatttccattccgggatttgaagaggttggagtaaacctgctggcctttggtgctctgccttcactcgttggcaaacgtcgcagagtgcgatgaattcagctatttctcttctcatgctgtcccaccaaaacttttctttgaggtcttggtacattttggtgctgcctgggtgaatggaatactgtgtctgatgagcctcggtgagtatcagatccttcaattccttgtcatcaggtacacacaatctttctcccatccaaattgtgccgtgctcatcctcaaggaagtcccgggcttttccaaccctcatattctttttcaattcagctatttcagggtcatttacttgagcggctctaacctgatccacgagcgtaggccgtgcttccagagcggctacgaacccgtgttcaacaattcccactttgagacgctcaagctcctgctgcaattcttcacacatgccctcgatgcatagggcattgcagtagcttttcctgcttagcgcatctgccaccacattggctttacccgggtggtagtgaatgctcatgtcgtagtctttgattagttccaaccatcttcgttgtcggagatttaggtccggttgggtgaagatgtatttcagactcttgtggtctgtatatacttcgcagcggttgccaatcagataatgcctccagatcttcaaagcatgaaccactgctgccaattccaggtcatgagttggataattcccttcatgtggacgcaactatcgcgaggcatatgcaaccatcctgccttcctgcaatagaacacattcaagcccatggcgagatgcgtcgcaatagacttggaagtctttcatctgattgggcaggaccaaaaccggtgcggacactaatttctttttgagctcctcaaaattcttgtcgcactcggctatccatttaaacttctcatctttcttaagcaactgagtcatgggtcgggcaatcctggagaagttttcgatgaatcggcggtaataaccttgaagtccaagaaaactccgaatttgcgacacggtcttaggtggggtccatttggtaactgactccacatttgctggatcaactgccacgccttgagctgtaatcacgtgacccagaaacttgacttccgacaaccagaagtcacacttgctgaatttggcatataactggtgctcctttaacttctcgagtaccagacggagatgttgctcatgttcttcttcggactttgaatagataagtatgtcgtcgatgaataccgcaacaaacttgtcaagaaattccatgaacactttgttcatcagattcatgaagaatacgggtgcgttggtaagtccgaaagacataaccgtgcactcatacagcccgtaccgagtggtgaaggccgtctttggaatatcctcttcccgaattcttagctggtggtagcctgatcacaggtctatcttagaaaacaccttagctcccttcagttgatcaaacaaatcatcgatccgtggtaaaggatatttgttcttgattgtgacctcgttgagtgcgcgataatcgacgcacatcctcttcgtcttatcctttttctccacaaaaatgaccggagcaccccaaggtgaagtacttggtcgaatgtaccttttctgcagttgctcatcaacctgcttcttgacctctgctagttcattggctgccatcctgtatggtctcttgtagattggagcggttcccggtgccaaatcaatccggaactcaatctccctcttgggtggcttggtagtgaggtcttcaggaaacacttctgggtactcgcagactatgggaatctcttccaacttcctcgaattcctctcctcggtgaccactgggatttccacctcaatctgattcaaggagaccccttgttttggtgagactagtgatttgtacactactgtttctcccttctcgttggtcaaggtgactgtgcgattcgcacaatcaatgactcccttgaacttggtcagccaatccatccccagaatgacatctaggtctttggattcaagaagaatgaggttggctagaaatggtgatctttgaatttctattagcactgaagggctaaaactgaccgaggttgaactatttcccggggtatgaaccctcattggtgtactaagctcttctttccttaacccatgcttccccacaaatttctttgaaatgaaagaacgcgttgcaccagaatcaaaaagtacggtagcagggactgagttgacagaaaacgtacccagtacgacctctggtgctgcttgtgcctcctctacagacgcgtggttgacatgagcctagacgaaccttggcccggcacgcttaggcttcgggcatttgtcagcgaagtggccaagctcaccacagttgaagcaggaccctggctttgctccagtctccttcttggcttgcgcggatggagctgactgtgctggttgcattggtgggcgtggagctgcaccgcggttgggctgacctccatggtggttctggctgctactggcaccctgatggaagttgctggcattgaaagggcggtgctggcggacgatcatggtggtaggtccaccctgttgtccgggagtgaagcgcggtcgctggtggctcccttggttggaccagaactgcgccaccttcctcttcctgtccattttattgcgctgatcctcctgacggattgccttgtcaaccagcctctcaaagtcggtgtagcctcccgatatcagctggttggttagctcgtcatccagacctgccaggaacttttcctgcttctctgcgtcagttcggacatcctccggtgcatatcgcgcgaggcgattgaactcatggagatactccgtcactgtcctgttgccctggtggagtgcccggaattccctcttcttttgtgccacgaccccatctggcacctgcgccttcctgaagctgcgacagaactccgcccaagtgacttccatgcctggcggacgtatggccatgtgattgtcccaccaagctgacacgggaccttggagctggcgaaagcgaccttctcctgatcattacactgcaggagattcagcttcttttctatagcatggagccagtcattcgcctccatggggttggtggtgctggagaaagtgggtggcctgacgcgtagaaactccggcagtttggactgagggggagggggaccaaactgctgctgatgctgttcggcgtgctactgcatcctctggtgcatctgctggtgctggtgctgcatctgctgcatcatggctgccatcatctgagtctgatgtgccattacttgggctagcgtcggattctcggggagtagtgggggaccattgccggaatcactgttgggatgcacaccatcagtgcgctcttcgccgttgctgccctcgcctgttgtgcgggtgccattccaggtgtagaccatctggaggaagagcagacggggaaacggagaaaaacagatactcaggaactaagctttattatatagaaatttaaactgcaattgttctgatctgatttaaaacacttaaacagcaagcaacaatccttattaagacagccatatcataggaacatgatatcgaccgtcgactgacccacaagcgagcaacctaaacacgcaaactaacaagcaaaagctaaacagtcgataaactaatggaaagcgagcctaatgctcggaacggctcctgcggtcggtggagtcgaaggcgtcgtcctgctcgtcaccaggtccctctgagcgactcctggagcctggcagatatgtctcgccgctgcccggctctgagccactggagctactgctgccgcggtcgtggctgccattgggagtagcaggcaaccaacccccattgccactggcggggcccctgacggctgatgctggcgtgaaggagagagcggatgcaggagctgacacgggaacaggagctggaactggcgctggagctgcaggagctgcgggaactactggcggaggtgggttcctgggcgcaagctggatgcgcacgggtgccgttgtcgacttgcggggcgtagtgcggatccggactcctcctggcgcgggtagaccctttaattgagcattctcctccagccggggaacacaaacgacaatgttgacatacagatccacgtcttacaaacatcataaaagtcttacataaatgcagcggaaaacgaaagataacaggagctaagccttgacttgaactgcagcgggaacaccactccacaggcatcctcgacggcacagacgaagcctactcctcggagaacccaccatcggacacatactcatactctggggttggggaaaatagagcaagactgagtactatccattgtactcagcaagtca

SEQ ID NO: 9054 - DNA, 2500 bp, Oryza sativa
  unsure (1)..(2500): unsure at all n locations
tgaatgcgaaaacagttgtaataattagtcaatattaatcatccactgtccaacgctacaccacgttgtaacaggcccaaccatccacctgtactatccaatttcaatagactaaactaggatgagacaaatcacggtgaatctggttgaccgcccataaccgcgggcacggctattcgaatagttttactctgatcagaggtgtacaactgtacccacaagacacagccctacgacacgtttccatgcgccgacatgccaccacgacataccggaaagaggccgtgacaggaccattcgcataaccccctctagccaagcacaccacacctcaggtttcacccccgtccccagcgggcgacgggcagtccctgctcgtgcctaggtgaatccggaagccgcataggccgtcgcagggcccatccaaactccatcacgcccacccttgcctggatgcgtcagctagagaaaagctacactacaagcctagccgttgcccacgctggcttgtggtaagtacgaggaattcttctagggtttcccgagaaccggtccttaattaccatgggtgcgactagcaaaaccatgcacccacagtccaccatgtgattcattttaattaaccaacaccaaagcggtggtactaatccaacattaccattagaacctgcagtctatatttcaataggatttttccccaaaagtgtgctagttgaactaagcatggctaagcaattcctagtccaaagtctattcatgttataacccaagcctgcaacccatatccctagttagaacctaatccatacctcccattaaattccaactgactgtcaaataaatccaaaataagttttactaaaaccctaaccgatcttatttgaacaaatttcaattgaatgagcgatcaagatttttcccatgaactgaggaacaaatcccaattttcccaaaacaaatccaattgcaaagaacatatgcaaatgaaaagattcggaggtctcttagggtttccatttggcttgtcctacggtcacggtcggcttcaataccaacttgtcacacccagaaattcccaaatagaattccaagcagaatgtgcattaaaactcttgtccaggaccggccagggtacacaaacgacaatgttgacatacagatccatgtcttacaaacattataaaagtcttacataaatgcagcggaaattaaaaggataactggagctaagccttgacttggatagcagtggggaacaccattcgacaggcatcctcgatggcatggatgaaggctagtcctcagaaaagccaccatcggaagcatactagaagtctggggggagggggggagggaagatagagcaagactgagtactacccactgtactcaggaagtcataccggaacggagcgtatgatgcaaggaatataaccaaagaggactaaaggagttcatttgcataaagccaacatttgtaaatagtagttgaaagcggtaaaacagttgtagtaattaaccattatttaacccattcactgctcaacgctacaccacgttgagacatgcccaaaccacaacctgaactaatatgatccattaagctaagttaggatgagactaatcacggtgaatctggttgatcacccataaccgcgggcacgactattcgaatagttttactctgatcaaaggtgtacaactgtacccacaagacacagccccacgacacatgccagtaccacataccggaaagaggccgacatacctgtgtgccgacatgccagtacgacataccggaaagaggccgtgacaggacccttagcataactctctctaaccaagcacaccacacctcaggtttcacccccacttctcaaaaggcggcgggcagtcccctctcatgcctaggtgaatccggaagcgacaaaggccgtcgcagggcctatccgctccatcacgcccacccttgcttggatgtatcggctagaggaaagctacactacaagcccagccattgcccacgctggcttttggtaagtacgataagttcttccagggcatcccacgaaccagtccttaattgccatgggcgtgaccaccaaaaccatgcacccacaggccaccatttaacgtattttaattaaccaacaccaaagcggttgcactaatccaaaatcatgcattaatgtaattcccccattgtgtactagttgaactaagcatggctaagcaattcctaatccaacatctagtcatgttacaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9055 - DNA, 264 bp, Oryza sativa
agtttgatcagatgttttatttattaactttgtgtttgatttttgaaatgttaactgaactgcagctgtaatctcaatactgaatgtgatttgttgaataagtaatctggactctctgactcaacatatctaattttgtagtgactacatggatctaaattgcaagattcagaagaagaaaacgatgaagaagaagaatcagaagatcaaatcagaagaaaacgattactacatggatctgagtttgcttgtgtgactttgctg

SEQ ID NO: 9056 - DNA, 564 bp, Oryza sativa
cactataaagtattataataacctatggtctggtttcaaagttcaagttgtaaaatggacaattgtgccattattttgtcacctgctgctattttttaagggaattgaaacagcaaatgacaattatgagagtttcagcagtatcgcaaatacaaagctgagatcagtccatctaattcctaatcttgtgtaccaatctgaattgccttttcaggccacccttgtgaaaatggtcaatgaagccactgcaaacattccagggtgggacgaagaaaggtgattaaatggttttgcctcgctgatactcaattcagctgatagtgtttacattagaagccatcgaaggatctccgtggtcaataaaacaagtgaatcaacgcatgttcttcttaggcggcagacacgattggctaattcctacaaattaacctagaattagtttttggcaagtaaaacacggtagttatttggtcaagtgaggtggtccatttttggtgttgtaaagctgaaacgtgagcttttggtaatactcctagatcatcgattgtattgtaaagcagaaat

SEQ ID NO: 9057 - DNA, 734 bp, Oryza sativa
cccacattgccacagatgctaaacattctaaagagcaggaaccctgggacctatgttgctgtgccagaatgggaatcaattcctccttcaaaatatcttgggatgcaccggcatttttttgcattcggagcatgcattcatgtgttcaagtgctcgaggccggtgctgtgtgtcgacgtatctttcctatctgggaagtaccgaggccagatattaacagccattggtgcggatgcgaacatccagataattccggtagcttttgcttttgttgaaagcgagaactacgaaagctggttgtggttcttgcaacatcttaagtggggagtggtgcaaaaacacacatcgatatgtatcatccatgactggaatgccggtctgttgaaggcaatcaaagagctccaggaggatggtgatggtgcatactactggcctgacatgcatagccgttggtgcatgcggcacatgggggccaattttttcaaacaattcaacagccggcggctgatgaacatgttcaagcggttgtgcaaggaaaatcagtctacaaagttcgatgagctttgaaaacaacttgacgaggggacaaggacacatatccggtcaaagcagaccaacaacaacccgcaggatgtacatgtcccccaggccctggaaccaatggatgatcttattccatcaaatggaaagaagcgtgcgtcatcaaaaaatatcaaatgctttacccattggat

SEQ ID NO: 9058 - DNA, 9940 bp, Oryza sativa
cccggcgatgcggaggcgtggacgtgcggcggcggcaccctaggagagagcagagatgggttaggggtggggtaagtgaccacggcggccaccattgttgaccggagacggagggggatggatatctcactggctcgcgagggagatagggttccggtgaggttacggcgacgcgaggcggtggccgagatgacccacgcgacgacgaagcaagcggcggcggcgcgtggctggatgcggcagctctagcggcggcggcgcatggctggatgtggcggcaagcggcggcgctagcggcaagcggcgcgggcgcggtagagaacacgggagggcgcggcgagagcggaaagagggagaggaggctcggaggagtgatttatagggcacgggaggggcggacgtggctgggaaagcccccgatttcgccggtgacgtgggggtggagagagagagagactggggttcaaatttgaatcccggtcggtgcggggcgcgcgcgcgtgcgggagaggtggaggagtgggcggcgaagtgggcacgagcgcgggagaggcgcgggatgggcgcggaggagccgcgtgggcgaggcggcgtgggcggctgcggcggttgctgccgaggcgcgggcggcgggaggttagggacaaccgacaggtgggccccacttgtcggtgaccctagggagaaagggaggggcgtgggccagcccaaaagaaggaggtcgagcgcggttgggcgagctggaccgggccgacggcccaagaaagtaaaaagaaggaaaaagaaaaagaggaaaaagggaaaatgaattcctgggatttaaaattgcactttgatgattttaattggtcaaaattacttataaggctctgaaaatttcactaaaaatcctgttaatgcattaagacatggggaactcaagaaaaattccaccacgccatttccaattattgattgcatttattaattagggaattagctctaggttaaattaaaccatttctttggacgatttattttatgaatttaaagcaaaggaggggaacttcagggcgtgacaacaccctcgtctccctaaccgttgagacagagggattgcgtcgaggacctatttataaaacattttttataaaataattaaaatgcaattatcttttcttaaaaatagggatgctagagagacaggtactaaggatctatttgtaaaaaatatttatatttaattcttttttaaaaaatattttataaataggttctcagcgtaagtgtttttggtgctgacccattcatatcaatgagttcactattataaggggtgaaagcgtcagcaccaataccactgtcgttgagacattgaacctcatggtctcaaactcattgccccagcaccaagaaaaagggttctatttgtaaactaggtttttaggtagggttaatgtaagatcaaagtgtgttttgatgcttatttagtgatgaacaattggcatctgtgattattggttttgatatttggtgattactgtcgaagtggttttggatgattggactcacaggtgctgttattttatgtggtccggtccgaccgggcggaggttgccggtcagaccggattgtgttgagcggtcagaccggctagccgcggtctgaccggccgacgctgtgtcggtttcggtttcgggttgtttgtttggatatcagtgattgtttcatggttatggcttctagatgaatactatacgtatgtaatactgtggtttgctaacaatgagtcaagttggtggtagcttggtctcggaatatggtttctttgtttgtctcatgtgtaggtgactcgatgcctcgggagaatatttgcggtgatggaccgggagtcggcttgttggtaagacgatgtccgtggtggtcagatatcatgcgggatactaaggctagagttgatgcacatggttgatggagattccatatggcatacgatggaggtattgtgtgcgtatgggatgcggagtcgaatttggaaggagtccaaatttggtacgattggttatgtaaagtttctttcttgtactagaaggtttcctaagctgtttagcactcttaatatgagtttggttcgtggctttaggctacctacctcatgtataaatagagagggagcatgaggctttccggtatcgcttttgtatagcttttgagagctagtttagttagggtttcgagtttagtcgagatttttgtaaggagtgctgttgttgcactttgtaaacacagagagaagcaataaagttgtcatctactttgagagttcttctatttgtgtttcaccgggtttcggcggtctaaccggcatctcaccggcggtcagactggcgacctactggcggtcaaaccgactaaggcgaggcggtcagaccggtggcggcgacagcgacttcagacgcggcagacgatcttcaggcggttgaaccgagtgatcaacaccggtcagaccggcggcacgagcgcggtcagaccgacggatcaacttcggtcagaccgctatccatcgaattcgagggtaacttttatttccgctaaaagtttttggtttttgggtataccaaccattcacccccccctctggttggcttagttcttgtgattcgatcctacagttaaaatgtacaaattgcaggtcatgcgcgttagcgtgtatatttatttgcccaagcaatggggatcgatcagttgaccaagctaggtctttatgtacttaagctgcgtagtcgagcataatatacgtgtattatagtactagttcccaagattacagcgcaaacatttccagtttctttctatattgacgatcatcctttttttttctcccatctcttgcaatcgattatccttccgccatcacctctctctttttttttggcgtttgcctgttcggcaagagatattagtaatacacacttagagcctatttgattcccctatcaaaattttacaccgtcacatcaaacgtttgaacacatacataaagtattaaatataaacgaaaaaatatctagttatatagattatgtgtaaattgcaagatgaatcttttaagcctaattgcaccatgatttatcaacgtggtactacattaaacatttgctgatgacgaattaacacggtttacaggcggattttataatttgttttgttattagactacgtttaatactttaaatgtgtctatatatccgatttgacacgccaaaactttacacccctcatctaaacacagccttatttaacgaagctcatgtggtctgtgtccaaaccgctgaccagtaaatagtatatggacaagaggattgaacgcccgatctgatctaaaaatgggcagttaaaatattttagtttgccgtatgcgaaatgttaaattatatgtcgtaaataaagagctcagttatttgaacatttgaaaggatgaaaatgtagtgcacaacaaataaaacaacattaaacatcttgagaaccggaaaaatgtgagtgtgaaacagtgttaaattcaaattgaaacattttactctcatatataaaacattaagttcctacttaaaaaaacattgacaaattaatgagatgaaaaagtagaaaaatgaaacatagtaaatccaaattgaacagtaaaataaaattatctaagattatgtttaggccccgtttaattaaaaaaaatttcccaaaaacatcacatcgaatctttagaaacatgcatgaaacattaaatatagataaataaaaaaactaatggtacagttaggaggaaaattgcaagacgaatcttttgagcctaattagtccatgattagccataagtgctatagtaacccacatgtactaatgacggattaattaggctcaaaagattcgtctcgcggtttccaggcgaattataaaattattttttcattcgtgtccgaaaaaaccttccgatatccggtcaaacatccgatgtgacacccaaaaattttcttttggcgaactaaacaggcccttagttgtgtccgatgatgcagatgggcagaggtggagctcgccacctccgagccatcggtgccgctcctagatgccaccgctcaaaccatcatctgcatttgggttaacgtataaactaaaaatacatttatagtcaaatttatcttttctgcgatatgtataagttgaattttaaattgcatgtctgtggagtgatatatcatatgttaataaatcttcttaatttttctttaaaaaaattcataactatttaaatgacatacatatcagtgcctgagcggagcctttggatcagcaatgccgagtcttcacaattgtcttatcagtacctatcggaagatcgggaccctagtcctcatcagtaatggaatgcccccgaaaagacttggatgggggactaggacaccatgcgactacacgaacatactcctatttgtggcgacaaccataatatccctagggaacgaatccatagctcgtttctgggactccgcatggctaccaagaagaaggccgaaagacttggcaccacaggtatacacaacatccacaaggaaaaaagaacgcttaagaaagcattcgaaggtgagacatgcatacaaaaccttgacctctcagtcaatggtgacatgctagttgagctcctagaccaactagtctccctatagaacatagtccaagatgtgcaactcgttgacgccgaactagatcaaatcacacggaaactcacaacccatggagagtacataacgatgtctgcatacaaagtgtggttccttagatccaaagcagaaactacacaacaatcatatggaagtcctgggcaccgagaaaatgcaagttctttgtatagcttatcatctaaaacagagtatggacgtcagatcgcctcgagacccgctgatggcagaacaacatccactctgctagcataccctagagatggctatgcacctcacggcggaatgtaggtacacgaagagaatttggggattgatatcaacttgaatctcccacgagtaaattaagccagcaaattggaacaaccatgcgacaggccatgagtggtggatgggtctagcctccaatcctggggtgccaaagaaaggcttgcgtagccttatccttctagtatcatgggagatttggaaggagcaaaattagcaatttttagacgcaaagaaccgtcagcaacatgtctggtcgcaaagaacaaataggagccaaagactcgggccatgacaggagcgaaagaattgtgtaacatagtgccttagagccccctccttttcttttaaaggatagcaaactcaggggggcgttagaagagcgaaaaatgaaaagcaaacgggacagcaaactcagggggcctacttatttcgcgaaaacaaaattttttggtgtcatataagatgtttgaccggatatcggaaggggttttgacactaatgaaaaaactaattttataactcgtctggaaaccgcgtgacgatcttttgagcctaattaatccctcattagtacatgtaggttaatgtaacacttatggcaaatcatgaactaattagactcaaaagatttgtctcgcgattttccccctaactatgtaatttgttttttaatctatatttaatactctatgcatgtgtcaaagattcgatgtgatgtttttgaaaaaaaaaattgggggaaataaaccaggccaaagttgaaggaccaaccaaacacaaacaagctgaacgttatgtgtgaattattttctttcaaaaaacacctgtaggacgtgtgcatgttcaatttctacgatagcacataccagtgaaactatatgtattatcagaattttttaatataacatatatatatatatatatatatatatatatatatatattcggtgaccctgtatgtaaacaaaatatagtagtattaccgatagaaacctcatatgtcagtgacggagtgacacgtctaactatctaagagactgagcactgggttcaggtgatcgagctagaacattatattggctgcccacacaaccacaagtgtatggccaaattaaaaggtaaaaaaaatacaatgggggtgttgcgagaatcgaactcgcgacttctcgcacccgaagcgagaatcataccactagaccaaacacccggcaacaatcgattagtggaaccaagatatatatatgcattctcctggacagattcgctaaggcggtaaccaagaacgttacgtgtgtacacaggaacagcctgaacagctcgcacgcatgcaagcgcccacgtctcgacccgtccagcccaccgccttctttaaccacttcaccgagcgatgaatcctcccaagctcgctcgctcgctcgatcgtttactaactatacttgcgggagatgtcgtcgcttctgctggtgggtccaaggatgagcgcccggttcctcgccgcggtggcgccggccagcagcgcgcggcccaggggcggagctaaagaaaagatgaggggcttcctgactttctctttataatataataccggtatgtataattctgaagtgatattgtactaaagtgatattgtactaaatagttgtgtacccaatacatataagaaacatatctctaattgatgtcaatatacaacaagaaaatgcatagaaaaatgaaaaatatacgtaccataatgaagaaaccatcttataactagccacttgctgtcatcctactcccctccgttcaatgcaagcaacaaacactaacttaatcaataatcatgggttatggatagtctagcaaaattaaaagaggggaccaacgggacttgacttatcgattggattttgatgctgcggcctgcagtggtggagttggtggcgaacagtgaactgctggccgatgttgggcatggtaggagtaggcgataccggcggccagcggcaggcacggcaagggcactagggcaggccgcactgccgcacgtgtccagggctgatccaggcgataggggcagccgatgtcgccacgtcgggcataatcagggatagatctagacggcgagagactgaaaggtgagggacgagtcgcgcgttttgtggaagacggaacaatgccgctctgatttctggtcgccgattcgctaccctggctccctgattcgtcgtcacgcgcgcatgaatcgatcaaaacacgtgcgatgcgactcctcatctcctctcagctgggccttctccaccaataaagaaatctatgggctggccgaccgggccttgtcgagtggaagttttaggctagacaatggagaaaggttccttggtttgggctagaggggtgcccatgtggtagagatataggggttacaagatatttcgaattttgggccgggttcctgggcacccccctgggcctattgggctctgcccctggcgcggccgatggggacggtggcgaagggcaccacccgcgccgccgtgcacggctcgcgctcgccggccacgaccaccctccatgtaagtactccctccgtactcgtaaaggaagtcgtttaggacagccacggtctccaaagcacaactttgacttcttttttctataaaaatatttattgaaaagtgatatatgtaacttttatgaaagtatttttcaagacaaatctattcatataatttttaaatttttaaacttaataacttgagagttattcatgatttatattctcaagatttaacttaaacattgtcttaaacgacttactttatgatgagtatggatggagtatacgtagacgtagtcgcgcgcgcgtctcagctacttaattttagctgtcgcttcagttcgtttgctgctgaggcatatatatgcagaacaaggaggaggtggaaacggcggtggagagaggtcgggagcagaagcacaaggcgagggaggaagtggaggacaaggtggacgccagcatcgccgaccaccgccagccaacgaccaaataaaatgatcatccgagacttgatctgtgttctttgtactattattagtagcttgtaaatacacggacccaggaataagtaatcttatggatttatagcttgtaaatacacggacccaggaataagtagtcgtatggatttacgaacccaggaataagtaaatcttatggatttgttacatacacaaaatacacgatgacaacaatatttgtttcaagttaccgacgtttcgacattaatctgagccgtggggagaaatctggacgagcacgccaagagcggcatctgatggtgcagtatttcagtctccagcatacgtcgccgcaggtcgccagactctatgtctatcattcatggacatgatcgtgcagatgcatatctcaattgctccatgatttatttcaagtatcgagagaaatcaagtgttattttttcctctttaaacatacaattattctcgttcctcgttcaacagatccattctatgatttcaagtctcaatagaaattaagtgttcctttctcctcataccatacaattatcctcattcctaattctacagatgcacaggtcattgttctatgatttcaagtctcaacagaaactaattgttcctttgttctcttaacataacagttattatgagaggaaggcagaggttaccgttcaagaacaacgattttttttgggtgtatcctgcaaagcatgtttcggaaatgctttcttgaagaaatcatcatttgctatgagatccccaccctcgcaccagatgacatacatgcaagctacgcaaaacagatcaagcagtacatgattgaattgtaatgtgaaacgatcataataacatcagttgaccttatgttgacatgatgaaaccaagcaaggcaactgaagccaaacattcggcagatctatcatcagtcataacgaaagcactgtgattcgagagagaataaactgtccatgagcactgaatctttaggaaagaagacgctggttcttaagtcctgcagtttttaactcaaaatgttgcataaatgtcgcaagaaattgaatgaaacctagcgaatgacttggaaattagggcaaaaatcgaacctagcatgaaggcaactaaacataaccatatccaaaatgttcgtgtaattttcataaaggggaatatggcaagataggtaacatgcaacacatgacatagcacactaatgatcagttacctttaatagggctgaacctgaacgtgtctgcatatccagatttgcagtccaatactagcgttgttgtacgctttcagctttattagactaattttcagtttcaaatgttgaaacaaaacctcactgtatgttaatataggtaactcaaaatactaggaaaggtaaacaatacctacctgatattttttcccctctaaaaggaagactgtagggtcccaacagagctgttacagcagaacagagattcaacaagcgcaacacatcgcaaaactcatttgtacaacaggttaaatggcgaaagggacataatggtctacctcatgagttttaactcggaataaaactatctatatgttcactgatctgggccatgcctgcttggagaacgagacctgctcctcactctactcctgtcctttctcatgtcatcactcctatatcggtgtctgtctctttcagaatccctaccatttctgtaggaactgcttctatattctgatcctctatctctgtgatcatgagacctttctcttccacgattgcggtcatagtaacgatcacggtcatagtcacgatccccagacttctctcttctagaaccaccgtccctgcctccaacatcatactctttttccctctgtttcctacgttcttctgctttcttctcccttgcaatcctctcttcgtctcttgccttctcttttgcagcctgaac

SEQ ID NO: 9059 - DNA, 769 bp, Oryza sativa
ttctattaaatgttgcattcttttacaatgtcatgtgggatgggtcctattactcagccatttattgtttaccttatgccattgataacttgggtatcaaaatgattagatgttggtttaaggaatgcttagccatgcttaattcaactagtagacaaatgtggatcacactattacatggactttgactattagcatagctttggattggtgccaccgcaatggtgtcagttaattaaaatacactgaatggtgggctgtgggtgcatggttttgctggtcgcacccatggcaattaaggactggttcacgggaaaccctgggagacttaccatgcttaccacaagcgggggtgggtaactgcttgatctgatgtatagctcgaccctttcctaggcaccggcggcgagggtgggcgtgatggaattgggtcggccggggtgtccggttgtccagctgccggattcaccacggcgtacgaggggactgcccactgccttttgaggggtgggggtgaaaccttagcgtggtgtggatggttaggggcgggttatgcgaagggtcttgtcacgattttccccatttgtagtatcatggtgatacttcggggcatggcgatatgtatggaatcgtgtcttgtgggtacaattgtacacctctggccagagtaaaactattcgaatagccatgcccacggttatgggtgatcaaccagattcaccgtaattagtctcacctctagtttagcttaatgaactggtctagttca

SEQ ID NO: 9060 - DNA, 20878 bp, Oryza sativa
atgtcaaaaattatcgtttgtgtaccctggctggtcctggacagtggtttaatgcacattcagcttagaaattctggttcatgaatttctgggcgtgacagtgttgacaccaaaatcactggcgtcaagatgttggacctcagccagggtcacttgcattgagaaaatgatataaccctgactaagtttatctagtggtttatttgtaaaatatgtttcaagaagggccaaatgtaaaaagtgcagcacacatgaaacatgacacgcacattttagtatagttagcagctatagcgtccacatgctcgccatcagtccgccattttgactttcaccaggcttgtaagtacaacaaacgccgtcgttgtccttaggagcaaatatacggccatagcgatgtaaacaatgaaaaccaccgtatataaaaaaactgacaaacagcggagagaaaaattaaaaacaggaataatgctttatatttataatttattaattttataactcgcaaacgaagttgactttgttataattgtctttttttttggggaacttttttttatgactttgttatatttatctttcccgcatatgcgattttctttagaatgtttttgagaacttctaaaaaaaactttcataatatgtttttcttgggatcggccactacaggatgccacctagatatggatatcgagttagctcggctcgattcggcttatgtcaactcgtgaagatacatacaaagctggtttggctggtgcatgattcgggctttgtttcatagcaattgtggttcgcaatcgtatgggttatcacttttttgtcggtccaatgctattgaatctcagacttcatgccgaaacccgaaagagagagttggaaaggtggagtcatggtgaaagagtgtcaaagttgtactctcatcgactcaaccacaccgatttcaagagggttctcaggacctccccgctccgtgagggttcaccggcatcttaccttccattggcattggttgtctagctgtccggcgcctagaggtgcgttatcatctagtctcaagaaaaaaaaaatctcgcatatagcaaaggtgatattatacatgtaaatttagaagaataaactcaactacatttgttaaatacaaatttgacaaacaatggagaaaataataaaaaagggaataattctttatattttcaatttgttaattttacaaacgaagttatatatgtttgttcttacaacttttgttgcctatttacatcttccttgcatacgcgattttctttagattgttttttaaatttcttaaaaaaagttcgtatcatatatatttcccatgggatcggccactacaagatggtacctactaagggatagatatcgagcattcgagccagctagcttgactcaatgaacaaacaagctaaacagctagtagctcatctcggctcttcaatagctccagtagagtgagtaggtaagaatagaatcaacagcttacttttttaaaaaaaaagctttgtctcgtccagcaaatgttatctcatacagagtagtactaccaccaggtacaaaatcaaatcgagccgttgattgtggagggagcggggtacattggcatcgttcgtcagcacgaaatcaagtttagcgagacctttgtgggagtgcctgactgagcccactccaccacatgtccacattcgatttttttttattttttgaactttttcaatttttaatttttttgggaaacttttaatttaaaaataagcactttcaaaacttattttcaaaatttgaatcttttggcgtggctggtgcaataaaataacgctgtaacgtgtagtctggctagattgacaaacgttatatatttagtcacgtcgatctggctggcgtgatggtgttatttagcccgttatatgtgatgtgtcaatattgttttgctagccagacgagctgatgtggtcaaaatgtttagattctaaaaataagttttagaaatatttatttttaaaatctctactattataaaaattaaagatgtttttgctggtactttggtatgtcatccgtgtatgagtcgaattttaagtttgttcgtttttggaaatacatatccgtatttgagtcgggttttatatttgttcgcttttgaaaatacaggagtaatcatatatataagaaatctctttaaaaaaacttatatgctaacttgagatgatcggactcctaattgcaactcatgattttctagaaaaaatatatatccaagcgaatctcacaatgaattgtagaaaaaaaaacaataacagaattaaaatagccttcaccgtagcaacacataggtattttttctagtaaataaaagttcaaaaaaaaaaaaattccaccacatcctcacctcccagcgcagattatactgaatccgcagttctctctccccacggcgatgggggagggggcggaggcggatgcatggtacgcaacggcggcggctgcatagatgcacggccatggcgacacacactcgcgcggcgcggcggcggtggagggggagactgcgtcactcgtcgaaatcggtggcgtcagcggagctaggatgcacagatacggtgcgcatgcaggtcacgtatcccgtatcggatacgtgtaggatacggatacgtatccgatacgcacggatacgtatcccgtacgtatcgccgattaacaagattttcaaataaaaaaaataattccggatacttcccgatacgtccaagccctagcatcgatcttctccagacaacctcgtgcgccgccgtcgttcaccctcacgaagtgcagcgaggcccagcagcagctagccccattcccagctccaggatacgtgagggagcgtgtatgccgagcgaacgacggagctgctgtctgacgcgatgcctccgccgtccacctgctggtgccgcagcttcgctctccggcgcgcagcgcctccgcgggccgctgggtgccgtagcccgcagccagcagcttcgctgccgggcacgccgccatggccgccagtaaccctctcaccaccctgtcacttgttcgtccactccagttcaagcctcttcaaatcttcaatgatcttttatgtgcccccattctgctagtatgactgctaacgcaactgcaacttcatagcgttggtggagatagctgtgagaattattgagatgtttcattttcctgttgattttctctggctttgcgaactccaactctcaatcacagtaagtgtgtataaccttaagacagtcctagaagatcttgcagcgtttgatctatctgatgatgcaagcaacaattaaattgatctagctctctagatattgagttgaacatgaagttctgaacaagtctattctaatttgtcattgattttttttctgcactatacgtagtcttgcacttatatgattttctgtatgtgttatatatatatatacatatatatatatatatatgtatatatatgtatatatatatatgtatgtatatatatatacacacacacatatccctgtatcaaggtaacgtagcatcggagtgctcgcgtcgcggcgttggccaagcgtgaaaagacacctcttcccatcccatccaatgtgaaaatacaatatgaggtgttcaattatatggcaccacctcaatgacacaaatggtactcactgtactaacctccaaccgttggatccgattgtaccaccggttgagatttggtaccaccctactgtgttgggcgataaaaaatctaaaaagaaaaaactaaatcaacagcatgcaaattaaggtttagttatgaaaaataaaacaaagaaaatactctcatattgaaaaacacataacttcttttagaactgatttattgaagggcgtacatatataaaactgatacaaaacagacgaaaactgaagtcgcagtaataatatcaacgcaacatttactggtactatattacaaacactataatcgtggcaaggctcgatccgtcggcttgccgttgccggccgcgccgcgccgtcgagcaagctagtcttcaaacagcagtggcaccggccggcggcgcagcagcttcagggtcacggtcgaggatgccggcgtgcgtgagcagcgcccagatgtgcgtcatgaactcgccgccgcgggcgaggctctcggcgtgggcgtcggcgttctccgacggcgccaggaagagcaccagctcggcccagacctccgcgagcagcttccaccgccggcgggtgtcgtagctggcggccatcagctggctccccagcctcgctccgtccatcagtatcccgtcgcggcctccgccgctgctctcgccgaggacacgcagcttcttgcacttgttcgccatggccgtggcgtcgacgaggtgtttccgggcctcctgcacggcggcgtccaggaccagcgtggccatgtagctgtggtccggcagcatctccgggacgaaagccagcaggtaggcgcagtaccctgacaggcgggtcgcgacgaggcggtcggcgccgttctcgtcgtcgtctgcggcggcggcggcgtccaggtggtcgcacatcgtggtggcgatgtgccacacgaggacggtgtgcgtgtgagctcgcgtcttccagtgcgtgtcgctctgcagctgcgtcgacggcggcaggaagcggtcgcacgcccaccgcaaccggctgtccagcgaccggccgacggcgagacggccgccgctctccttgaacgaacggaggactgccaccttcacctcgcgcggaagcctgacgaccttcggctccagcaggcgcccggtcagccatgacaggcagttgccagctgacgaatggtagaggagagagtactggccgagcttgttctgccagtgcctcgacgtcctcgcccggcgagtcgccaaccgcttgatcaccgcttgccggaagccgaagccgccgccgtgccgcttcttgttgttcttgtcgacgcgcctgacgtagtcgcagacgaagtggacgaccgcccagtcggagtatccggtggacagctgctgcatgacctcgacgccgaggatcatggagatgaagaggaagtcgttgaaggaggagaagatgccgacggcgcttatgtctttgaaaatcttagctgtgtagctggccgtgtaggtgaagtcgtagaagagcttgaggaaggcgaggagggagacgaagcgggcgacgtggagcacggcgctggtggggaacagcgccgggtacttggtgtagaagaagtcgtgggcgaacgacagctcgagctccacgacgcggaacgcgcgctcttagtcgtcgccggcgaggaggccggcgacgacgaagtccctcgccttctggtgccccgtctccgcgacctcgagcccgcagaaccgccgcttcagcagcttgaacagcgcgaaggagaggcacgtgtccttgagcgcccgcgcacgcgcccgccgcttgtcgccgacgacgccgtcgccggagctcaccagcagctcgccgtcgcagcgccagatcttgtcaatggtgacgacagtgccgtcttctggaacacgtgtccggtagtccgtctgctccgacggcggcgtggagcgcccttcctcgccgtggaccagatacttgtacgggcccatgtccacggagtcgaggtcacgagcggcggtcccgccgtcgccgccatggccgcagtcgcggtcccacgcgtcgacggtgtcgtgcatgtagtcggcgaccaccttggcggcgcgcacgaggccgtgcgaggagctcgccatgcgcatcgccttgatccgctgccccatcttgacgatgctgtagagccagcagacggagagcgtgatggtccactcccagttgacgccgcggggaggaggattcgagcaggatggcgttgttggcccgggtgacgagcacccagagcacgagcacggtctgcacggcgtgctgggccatcatccccttgctctgctcggcgtcgccgcgggtgaaggcggacatggtgtcggcgctgccgaggaggaggagcagcccgacggcccaccactgctgcacgctgtagcggtcgggctcggcgacggactggacgaggccgacggtgtaggagacgacgttggaggagacggtgtaggcggcccagagcaggacgaggaagagcttgttgctgctgcgccggcgccggtagcccagcagcgcctggaagccgagcagcgcgccgcccaccgtggcgaggatctggatgtgcgtcgtgcggtcgctgccgatctggttgagaaggtaccggacgctcatggagtccatggtcgtgttgggaggagggcctagctccagctcgaacgccatggttcacactagctagttgaggcctcggaggctagcagcaggttgtgtactgcgctgcgcagtttccacgggggcttttaacaggcccgcccggaacctacatggcttgactcagctcaggcggtcaatattaacaatagtttctgcatagtgctaaggcatactccctctccctgtgtcaaaaaaaaaaatcaaattatagtggtaaatctcaatgcagaagaataagactgtaggaatgagtctggaactgttgcactactggagaatgcatcttctatcccggctcataacccatgtagtctcggttgcagaccgagagaagaaattcaagactaaagatgacgatctttagttccaatttaaatacccgagagtaaagatgcttgtggatcattgtttttatctatttgcacttttttcagttgaactcatccacggttcatctcccaacatcccaagtcatccacaatcccaaattattcataacaacaaaatcatcatccataatcccaaatcattcacaacaacaaaatcatcatccacaaaacatatatagtcaaaaaaaatcatccacaaattaagagggaaaaaaggggggaaaaaaaagaaaaacattggccggccgaccctccgcgtgcgcccggccgcctgccgccacgcccctccgcgccgcccgccaccgagcgccgctgcccgccgcgcctccccgcgtccactgcacgctcacccactgccgcaatcgtgcgtgagaggataggatagagagagagacagagagaggaaagggataggataagggaagatatggttgctagaggataagtgcgagggattatatatactatgcatcgatttttagtcccggttggtgttttcaaccgggaataaaaagagtagggggcggacactttttcaaccgggttggtgttaccaaccaggactaaagatcatagaatggctgtgtggtttttaaccggggctaaagatgatttttagtcccggttctttttggaaccgggactattgtggttttcggccaacctagcaaagatcagttctccagtagtgttggtttttcttaacgacgatactagaaatataattcccagcaatagcgtcgagataatctcggaatattttactattacaaatataatccaaaagcacacagatataccgatgtagcatttcacctagaagtattccaacggtatcgtatttatttaatcccaatggaacatatgataagagagtactttgctaataatttatatcacttatatagatcgaagtctatgcagaggttaggcaatatttatgggtagagatatgtgacacaaagaagtaaccttattactctcattaaaataaagtctaagctaagtggagaaagaaaaagaaaagaatcatttttgtacttttagtatatagccattttaatatacacttgctagtatataataatgcaaccaaatttccctaactatgccttcctggtgtttcgagagactacccctgattgccgagtttcttacggcaacccatcatggccattcatcggtaatgaatacggaggagtacccataccagaaaattgtcttaatactatatacccacgtagaggaatacccgtaacgagctgtcaccatcagcagctcacctctaccaaggttgtcaggatcgggatactacatagtatcattttgtttaaagtaatatcgtatcgtagtatcaggatactatgatattttcttttttaagtttaattaatatttatattaattatatatagccattctatataaaaaagtagtaattatatatgtcatgcaaatagagacatttatcaagagaaaccacgttggttttgatatatttaactgatttttatataaatttgagcattttatttacattattttcaaaccatgttattttaaataatattttgtagtatcgtagaatcgggataccacctaaaatttcataggatcgtgtagtaatgaatattaggatcgagatactataaaaaataggatactaggtgggatcggtatcatttcggcttggtaggatcgtagtatcgtaagatactaggatacgaatcaggatactgacaaccttgacctctactgcctcgtggcatataataccaattaatgatatgtaataatttaagcaccacactgacattactaaatagtactccatatcgctgcagcagacgtagagcaatcatcgaaatgaatattaaaccacaccattgcatatctctggtaagttagccacatcattatatcgagacaagtataatataaagttggtacttagataatataaatgaagtaaaggatcgaagctatataaagaagaatatttcactaataatagtataagtcttacaaaagaaggaagagctactagagccatacctgaaatctcctgaagattcaaggaaaatattctattcctactccactagcaatagaacagataactaaacttgagagagctcttgattcttcttcttgagtgtgtgttggagtggagtgaggcctactccttaaataggttgccaatgacagttgtggcggttgaaattgtcggaaatggcccgcaaccgtcattggggagcaatcctggacatccacgtggaaggccgggatgagaggcctcggctaaggttcgaccaaacctggtccagcccctctggcctccaattttggccgaggacttccttgttaggacttattcttcgtgacatggcagttgggcttatttgcagatgttaaataagttttgtaagcccaagcatcataagtctaccagtcggcggtcattgattatttcctgctgattttcctccgtttatgtagaggtcgttgtgttcaaataaaatttcaagcacaagtggaaatagattatttctaacaaattatgcattgcaagcatagctagttctcctttattccggttatattgacagtcaaaattggtctataacgaccgtcaacaggcataggacaagtttgattctttctgggcagaaagattagttttttattcaactcaaaccttaacttactccttaattttctgttagtatgttttttaaactgttaaatgatgttaaatgatgtgtttgttgcaaaaagtttatgtatagaagttatttttaaaaataaaataatttcattttttaagtttgtaataattaatacttaattaatcatgtgctaatcatctttctcgtttcatgtttttcctccaaaatcactatgtttttcctccaaatcaaaggggcctaagtgtgtaaataaaattcgagcttgcctcgtttgagctcgttatcttaacgagccagttcggctcagattgttaacctccataggagtaaaaacttagagcgtgttctaggggatgaaaaaggagaatattaagaagaaacttaaaacgatgtgagccattaatacaagattaaataagtaccacctttgtttgttataacctccttatcttttcgtatgacgtttgaccatttgttttattaaaaattattataaatatgtaaaattatgagttaagattatagtttccgtgatggtaaacaattcacaacaaaataaatgatatttatataattttttgaaataaaatctagggtcaaacgtcacatcaaaagtcaacggcatcatacattgaaaatgagggagtattaattacttcaaacttaaaaatagattatatgacttttttaaagcaaattttctataaatatatattttttaaaaaaccatttaatagttcgggaatcgtgccagtagaaaacaagcaagttttttcactctttgtgctgcttccgaacgcagcctttgatttatgagtataatcttgggctcttgggctggttctttaagctctaatttatttatataatcttaacaatttaataatttatcaatttattatatactaacataatatttcctttgttttacactatgagacattttgagttttaaatagattcatagagggatctatgtatgtacttcatatatgtcaaaattcatatagatattagtaaatctaagacgagagatgaagaggctaaaagaagtcaccaaatataaataatcaccaaatgtgaaatagatcgagggagtaataaacataaccaaatataagtagtttggatgctactaaaagattaagcattagtgaagaagcaataagaatatgaagatatagcgatcttttgtattagcaagctagagtcgttcgtgagttaaaaggtcaacttggctcggctcattgagattactagttcgagtagatccaagtcatgagcttcaatgtcgctaattaatcgtactgctggatgttctctggttacctaaaatttaagaagttaccgagtttatctcaatagtttattggaaatagccttgccttctaatttgatgtcaggcacaaaattacctatgtaatcatccacctaatggcccacatttttgctacatttccatagctacctcttgttatatatcgtcagattacaagcgatcaatggatataatgcctctcaagcaccttagaaaatctcaatattataatttctggaccgttcaatcactttaaaattcattatcttcttattgtccctctcctcattgtccgatacccctccccccctccccctccttttccccgtcgtcatatccctcaccaccagttgtcgccttctaacctctcgctccactttgccgccattgccaacacccgtttcattgctgaccaacgatccaccacctcccacggccatcctctaccctttttttctttccttcgcccccctcccccagaccgtaaccctgatttcaaaaccttaactcgtcatgctattgttagtcgctggagctagaggagttttgagcatgatatcttcaaacaaatcaagtgattctaatctataaaaaatctccctgattttaattgaatgccatttagacctagcaggtcgtttggaaagacggagggagggagaataaggttattgttcacatacaaatctccataacaacgctagttgtcaaaaggtgaccggatatgagggttctgtcaaacatgttatgagcagtaaaaaagctgatatgctcaccctccctgatatatatcctcacccaacgatatctcagtaatcatatggaaataaaacttttcgtccttatttttgttcttaagaaacacagtacaaataaagaagcttacaacaccctatgaacacacgcgcacacctacccctatgagtatctctgaaaaactagatggatatatctttagatttaatgaagtcatcacgaatacctcgctgctaacggatactccctccgtcccataaaaaactaacatactaccggatgtgacacatcctagtctatgtccagattcatagtactagaatataccatatccggtcatagattcgttttttatgggacgaagggagtacgttgcctaccattgaaaaaataattagctataaatacgaaccacatatcaagtctagaatttaaaccggataggctgcttccattacaaagaatctaactaattgtgctatgcttacttcgtatcatccctttctatacacacatcgtccgatacatcgctcaacacactgttggtcgggtgagtaaacaaattaacgacagctaggaagatgctgaggcttgcttccttctcatgttgtatggtaaaaataaggacttggcatgtcagactcacgtcaagtgatcacagagtgtgcacacaacaagcatatcattaattctgtcactctacatacaatatatcacgttgagtggttgaggtacgactacacaccttgtctgagtactggcgtggtagtgatcccaccacctctacgagtgatcgaggtatgacaacacaactggtccgagtaccagcgtgtgttgacgagaaacacagcggcataggagatttgctttactccagtgtaggtccaaggcttgcctcgagtgtcaagagcgtgccagatggtttgatcttgcaacaacaagaaagacaaaaaaatcgtaattagatgaacgatagccgattggctgacagagccgatgacgtatcgtcagaatcccgccgatacggttaaaccaaatcggttgcggctttgagatggataaataaaacagaaccctaaatatgtcttatcgtctgtaacgctatctcttttatttttgtcaatcacttttagaaatattatagaaataaccgataatctaatatttagagccagaatagataatgtattggctattactccaatagagacttacataaacagattaatctagataaatataccaaataatgatcaatctcagatacaatgatttgatccagattgattaagacttgatatatatagagtgatctatctgtataagtggcaaatatacataaaaatagattatgagacgtgcactattatgtatattaggtaagatcgactgaaactctgatactatcattaattataattaattccaggttagtatctaagattctaaacaagactagggttgatgcaactcaaagtatgtaaagaaatctaaagtctaaacaatcaagttattaactacttttcaagatggtaaatacctaactaatctaatcttgtaaagcgattgagccgataccggcataaaccctaaagcaagaatcagccgatataactaaatcaaaatactaactagattaactaagatatatgatagtgatgaccacaataaaaagactaatacatctaaaatgacgtaatagccccgatagtgcaaactattgagacaaggtacctcttgtcgagagatcgcaaccgatacccgactcaaagcaagaactcgtcgaaaaaaataaaagaaaagggtagcgatacgccaaaagttgtattgattggattgtcgttccttattacaatgatctggggtttatatttatacccggagtacaaaattcttccattatggacacgactcaaaccttcctaaagataaaaacaaacaagtctacatgacagactcttaccatatctctaattcaaaacgacattaaaatcctaattaatagatacagttgccttaaataagctctatctctatacaacaatgatggttatctcaatcgaggcccaaaccgagcccaagttgagctatatcggctgctttccatatcggctcaatcaaactccgaatatgtttctagccgatgcacaatctgttttggcaagattcaatctccttcaaatccgcttcggtatccaactccaaatcctagtctatcttgccaaatttcactgttaacagcgtggtagcgatcccaccgctctacgagtcctctacgagtggtagaggtacgactacacacctggtccgagtaccagcgtgatagcgatctcacctcctctatgagttctttacgagtggtcaaggtacaactacacacctggattgagtactggtgtggtatcgaccccaccacctctatgagtcctctataagtggacaaggtaccactacacacctggtctgagtaccagtgtagtagcgatcccgtcgcctctattagtggtcgaggtacaactacacgtctggttcgagtaccagcgttgtagtgatcttcgagccgcctctatgagtggtcgggttgtagagggtacgactacaacctggtcctcgactagcgttgtagcgatcctcgagccgccttcacgagcggtcgagtatgactacaacctgatcctcgactagcattgtagcaatcctcgagtcgcctccatgagtggttgggtacgactacaactttgtcctcgacagcgttgtaatgattctcgacccgcctctatgagtggtcgggtacaactacgtacaccttgtccttggccagtggttgtagtgattctcccaccacatctacaagtggtcgggtatgactacactagttctcggctagtggttatagcgatcagcccaccacttctacgagtggccgagtacaactacacatatggtcctcgctcgaccagtatgtgtagcgatcctactacccccatgaattaatccatgtaagtttttatacatatcaaatgtgcaatatttgtcagagtatcatgttttctcatatcgctactggttggattcaattcttatactcgtattatgttaagtccgacaagtcatcgggttccctaaaccttggccgaggatgctcggtgctattggactagtcgggttgctaagggtcagacaaccagtgaaatgtgtagtggcttgattttttgttgtaagatagccaatgatgagtaatgttgctgattatttgtgatgcttatgaacatatttttcctgctgatttgtgttatgccattgtatctatggctacaaatagaagttattgataaggccagatacaatagtgcgttcttttaaattgatactgacagatacacacttgattaatagtgcttatttgtgatgcataagaacagatatgcctgcacttgacccttattcgatatggtcaggcaaccaaacatgtttctgtctttctgtgatttttctcagtattttatagttcaaatgatctcagcggaactgaggccacctctacacttgaactgagcagaatttatgtgagtacatgaacatatttttctacacttgtttttttgcttgctgttaggctgggtaagacagcaaatgatgatatatgctgctgtttgtgatgcatgtgaatagattttgttctacacttgttctctttttcttgctgtttcttttttcctgcgcttggtcttattttccttttcctagcttgtaccttttcttttgctacatttgatagatactggtaagaacagatacaaatgatagtagctacttcctccgtttcacagtgtaagtcattctagcatttcccacattcatattaatgttgataaatctagacatatatatctatctagattcattaacatcaatatgaatgtgggaaatgctagaatgacttatattgtgaaacggaggaagtaattcacattcttcatatatctgaggccattgttctgcatttatttacttgttggaaatgaggctcaatgatgtcaaatttctgcgcatatttgctacattttcgagttattgatgttaggaaaatactatcaagttccttgttcatcttttcatatcaacatatgtactcatttcttttagtaaccacacttgattttgacatgatcaagtttttgataagaaaccgatatactctgcacttgctctttttggtaaagatcatactactattaagtgttgatgctcttgcaccctgatctctgcaactcagatcctgtattatttcaaaggtacaggttatcctgtttacttttactatgtttcaggaaaatgtgataatggaaaaacttgtgagaccaagtgtagatatactaaggttgatgtgtttgaagcaatctgtacaaaagcttgcaagcagaacatagctgaaacagatggttttagttttgtatgcggttactaatttgcttatcaaattggttccttgttttaaaaaacttgccatgggcacgtatatttgtatgtttgttttgaattgtcaaatgtaccagtgttgtcaatgaaattatgtacatgatttttgctataataatcactctcttgcgtgttcatctagtaagccaggccattccgtaacatttgttaaaaaaaaatgatcatcagtgctgctcattggttttaaaaaatgacaatatcattaaaacgtacatacacattacatcgattctccatgagaaaaatgagctccgaagtattagtaggtgggcatacccacagagtgacacaatttaatctataacctctactacagattaactttaccacacataaatagatttagggacttagaaaaaacctcgcatcacaaactttatggggtaacctcaccacccacaagaataggtattgtcataataccacatacctaatagtagttaactaagctcggcagggcccaccatgtaacaagtcttatacgaaatcatacctcgtatatagaaggagttccggataaggaaggacaaatagagttctatattaaaactataaggactactcggattatatccatattggtctctctagttctacttgtataaggggacacctatgggtataaatagaccccctaggaggagggggaggaaacaacaacaacaacagatcgacacacaatacacacgccaagacaagccgccggttatcgacatcagagataagcctagacaaacccaatatggtgtctgtggaggccaacaagagggatctagcgctatatctgatcttgctgagtttggattcaaggaagactaccccattgtcgactacgtgatagtatttcaggcagtcaagtcgacaacggttagataggttatcccaaatattatactagtgtgattatgatgaataagagcaacaccggctttggccaataggagtattactgtcagataagggacccgaacatgtataaaaatccttgtctccatctcttttacttcaatctcgtatataccctggtaccaacgatccccatactatgcaaaataccatagttgcgatctcaaacgtcgacaggtatttgcacacaagatgtatccatccaaccaaacaacatctcctgcatgctaccgtttcatccgccccttgctgcaaccaaccaaacaacatctcatcatatccaggtttatctcatgcaagcaaccaaacacatgcatgtgtatcccctaaaccaggctaaacttagcctggatgagagagatgagccagactagagggataagagcaaccaaacacacccgtaatattgtacgtgagatagagaaagaaaagtctattgtgcgaatatgagcatgcattcttatcacaagaatgccccactctttcctttcttggcaccatgttttttctttcttggtaagtttgtacggtgaaagtttatgtccgattcagaatggaaagttttacaaaccaaaagttttgtatgtatgattctgatttggagtaaaaaaaatatgtataatgtttctctataaaaaaaattgcatgtataaattttctacgtataaatttttatgatgggataacgctcacgatagatcagaagcacgtgagctagcctgagcctttgggttcttttttatagatccgcccctataggcaaccaaacacggaattcctgtttggcgggtgatcgctgctccatccacccagcgatcaccccctgcctccttcctatactatatactcctccctcctctcctcccttcctcctctccttcttctctttctactagagtacaccacacaaaatattttaaaaaacaaaagttagaaaaatttatgtatagaaatactatataaaaaaaatttgaattcaaatttaaatttgaattgggcatgtaattttttgacttataaactttggatttataaactttaggtgtataaactttagatgtatagaaatactatatatagaaaatatttgaattcaaattttgaatataattcaaattcaaatttgaatcgggtatataaactttaggtctttaaatttaggtgtataaactttagatgtatagaaatactatatatgaaaaatatttgaattcaaattcaaatttgaatcggatatttgaattcaaattcaaattcaaatttaaatcggatataattcaaatttaaatttgaataggatatataaacttttaacttataaactttaggtctataaactttaggtgtataaactttagatgtacaaaaatactatatatataaaaaaatatttaaatttaaattcaaatttgaatcggatatataaacttttgacttataaacttttggtctctaaactttagatgtgtaaacttgagatgtataaactttagatgcataaatttactaaaatagaaaagtaatacggtaaaaaaaaggaaaccaggtggagggagggagggggaggaggggacctacccgatcgctaccaggtaggtagggcgatcgatcgcccattagaactacccaaccaaacatgtcctacgtgatttgaggccgaaggggtggcgagaatgaaattgagctttttattaaagtagatatttttgattcgttttacaattcagatgcaacagctgtatcactgacatacaatttgacttacaaagtctcttttataagatgcatcatggaaagaaaatagcgcatttgggaccgtatggagtatgatgcaatatatatgcttgtttgtccaagcattcgggaccaattgaccagatcaagtctttatgtacttcagctgcatagtccaattataacacatgttttattaagggactttctagacaaaggtcagtttttttttgaagtccctcaagctgcgcgtgcgcagcaactactcttactcaaatacttggttctctagggtccaatcttctattgattttttttcattcatttcagcgcttgtagcggtaatccttcggataatcttgaagagcctttatatatagtatatatatattcactctgtcctaaaatataaaatataagtacttttagactctaacgcggtctccgaaatactactttgaccaataatatctataaaaataaataaaataagttatatattacgatagtttatttaacgataaatctagtaacatcaatttcacataattgattattttctttttgctattaatagttaaagttgaaaatgtttgaacttgtcactatgctaaaaatgtttatatttcgtaacggagggattaaaaaaaaacaacggacggaaggttctcgttgtctaatcatgtgccgcgtagtaacacatatatagtcactcactgacatctctaaaattcagccctcgaatcatatggaaacatatggaaaccacatgactttccatcgttgtctgctcaacacaccgttggttgggagagtataatacgtacgactcctgagactttgcttccgacctgctacgcgataacaccaaaaacaattactttgggctcgtttggtttggagttaatttttgccctatcaaaatcttgttagtgtcaaaatattgacaaatattgacactaccaaattaagtagtattcaatttaaattattatgagtaaaatttgatagcaaaccaaacatgctactattgaaattagtaaaattttggtatggtaataatttagaatcaaaccaaacaggcccttcatttccatgtcgagtctcatgctcacttaacccacaagtgaagtagatcccaaaatattactaggagaaaatttaacccatcgtagaataacgaatatggatagacctctgtctagattcatggttctaggatagattaaatctcatcataaattgtaaaattttgggatgaacaaaataactacatagccgaaagttcaactgatagaaaactaatataattgcaataaaaccgagcaatcaaatgggtagggagtagggatggacagaaaggtcatgacttttgttagctcgctcagtttagctcgactcgtttcattttcttaaagagctaagctgacatttaagctcggtatagacaacgagccagctcagctcgtgagtcttaatgagctagggtagacaacacctcagcatgccacaggtgggttgtttctgcttctgggctgtcggcccaaacaaagagtaacaaaacacgctcaacccaagccactaggcaccagcgccgctcgtcgcccgctcattacgctggcaatgccgctcacgaattttttttattaaaagttttacaaaaaataattttctattttaaaaattaataaaagtggtcgcccgccgccctctggatcgcccttccagagggcggcaaatgtgacatggcagacggccatcgccctttgcaggcggcccccttaccgccctccgcaagggcgattttacactatgcggggggccgcctgcaaataggcggcgagggggcctggaattttgcaggcggccctcttgccgtcctggggaagggcgattttacactgtgcattggatatttttataattattaataggtatacaatcttttatattgaaaactcaatacaagattttagtctccaagattggtgaaatctgtagcgcccgttccgtcgtggcgcctagctggaaaattatctcttaaaaaccctaattgcgaaattgtttccttgcttgttgtttagtgtctgtgccatctcagatctcaaatccccgatctatcgtcgagttcaatcccgaatccaaatacttccaaatcaaatccctccgcaaaagtctattttgcctccccggggtcgatgggccgaatttctctcggcccatct

SEQ ID NO: 9061 - DNA, 24074 bp, Oryza sativa
  unsure (1)..(24074): unsure at all n locations
gcccatctccccctccctcccggcgctcgctctatttctctctcgctctctctccctcctcttcctccgctccgctccgctccgctccgctccgcccgcgcgctgcacgcgcgagcgcccctcctccgctccctccgctctgtccgcgcgtgcgtgagccgccgcgccgagcgcctccctcccccctccgctctgcccgcgcgcgagcgcgtgagccgcccgcgccgagccgagccctcctttctgctccctcgctgccgctccccgcgcgtcgttcgcgtgcgcgcccgcgtggtcgtcgcccgcgtcgcgtctgcgccgcccggccccgctgccctgccgcgcctgcagccgctcggccccgcagccagcgcgcgtgcccgagccgcgccactccatccgccgcgcctcccgttgcaagccgcgcgcgcgtgccgagtggccgaccgcctggtcaccgccatcgtcagcgcctgcccgcgcctgtcgcccgtgtcgccgttccgctccacaccgccccgccgtcatcgccgtcgtcatcgcctcggccccgccactccgcgcgcaagccgccaagggacggaggcagagccctcctccctctgccgcgacgcccccgctcccctcctccttttcccaaagtggcaaggaggcaagccccctttctctccctccttttcccctttttcctcccgccggcgtcatcctccctccgccctgtcgccgatttggacgcgagcgccgagcgccagctcgcgccttgaccgcccaaagtcggtttccaaaaccgacattgccgccctttaaagccccgggcgccctccctctcttcttctctcgttgtcccatcacctccactccattgttgccgcccctctgtttcgccgtcgccgttcgtcgttgcgcgtgtcggaggagccggcacgagcgaggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctcctccccttagttttcggtagtagctcgagtagcctccccgtagctagccggcaccgccccgaccgttgccgccgcttgccgtgtgctcgccgccgtcgccgcccgtgttccgtagcacccgctcgtcgccggcctcgctcggggtagctccgctcaatccgacgctagcaacgaattcccgtggccgcgtagatactctcaccgccgggaattggcccctcgtgacctcgtcgccgttttccccttttgctctccgccggttaccgccgccgaaatccgccgccgacggactccctccggcgaatccaagccgttggctcgctccctctcattcttcctcgtcatcccggtgtacgccccgtcgcccctcatcgtcgcaaggcgccccggagaaaccgccgccgcccgccgtccattcgcggccggcgccttcgtcttcctccctccagcccacgtggcagccacgtaggcgccacgtcggcgccagctcggccgaaatcgggtcgggccgaccccggtcagcccctcccgtgcgcgcgttccaccgcgagccgtgaggctgcgcgtgggcccgccgcatcctttccaccgcgaaccgcgcgcgtgcaccgcgtccctcccccgcccgcgcgcgtacgccgcgtgctcactccgcacggtgaaccgagtcaccgtcaagcgggtcccactcgggaccgcgcgtggtgagcccggtccaccggctctctctctcctccctcccgcgcgcgcgcgccttgggccgccttgggccggccggcccatttagctcggccggaccgctccatttctctcgggccgcgccctagccgcctgaggaaaagtctattttccctccctcttttcttttcttttcttttttttttcaaaaaggatttaattaaatcctttttctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatattgagcctatatttgaaatttaattatgttacttgaaaaatattatgcattgataggatcgcacttaatctgttgtcccgtctgcaaggcagattggcggacctacctagtttgttgcatttgatccttgttaattgttatgtcatgtccccttgtaaccatctagttgcgtctcgatattcgtgcatcctgtgcgagtatcgacggacgcctccaaacttaaaatctgaataacaacttgggtaaaacttgggttttacaaaagacttggaaaacccgacacctgggtcggtgcttgcgaactaaatgatgttccaaaaccgcggaccggggaacgtaccgggtgtacggtttcccgctcttgcacttaaggaccgtttccttggaatttcattcaaacataagacaagtacaaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgtagaggttaacaatctgttcgaacagccgtgcccacggtcatgggcggatgtgaggtgattcctagcgtagttttggttgactactgcttgtgaaattgctgttgtggaaaggagttcgatgtttgaaaaatctgcagctgatgggatcagctaggcccgggtggccgtttgaaagttgttggctcgggtggccgtttgaaaagctattggccgggtgccaaccttgtttcaattctaaagactgatacattgcacatactccgaccggacgagacgccctgtctcatccgcgtcgtttgagaagcactcacttagttgtttttagaaaagagtttaaataaaatcaattgcaaaaacaacagcctttctttgaagcctgcattaaacacttattccccatggcttgctgagtactctcgtactcacccttactctatataaataattcccccctagttgctgaagaagatgaagcggatcctgctgttgaggagttcttccaggagcaagccggctacgatgagttttagggtttcgacctagttcccaagtcgcgcctgtgttgtttggtccaagtcctggcttccgtttcccttttgtaatgcagttgtgagctcgggatctgtccgcagcccaaaatgactgtacctctactctataataaagagacctctgttgctgtgatatcctgtctccctgtgataccagcactgtttcctgggactggtatcgattaacaggttaatttggagcgtcacgagctagttccggtcgggactagttcggggcgtgacaaaatccaattttatcaattttttattcttatgcatacaaaaatacaccatcataattaaacattgtaatgataagatagttaagaagtgccatcgatacacgatacaaatttaacattgtgcctgatgaaaacaatatctgaaatcgccctcccccagggcgacaagggggccgcctgcaaaattccaggcccctcgctgcccatttgcaggcggccccccggacagtataaaatcgcccttgcggagggcggcaagggggccgcctgcaaatttgcttgacggccgtcgcccgagagcgaacggccgtctgccacgtcacatttgccgtcctatgtgaggacgatttgtgggcgactacttttgtcaatttttgaaatagaaaattgttttttaaaacttttaataaaaaaaattaaaaataaaaaaaattctgccgctcactgcctgtgatgcacgtcttcggcccaccgcacgcctctctctctcatcaaactgtcacggcgtgctcctgtctctcatctcgaactttcacgcaacgcctctctctctcatctcgaaccgctggcccaccacccccaccgtgccattcacggcccgccgctggttgtgtggccgcgccattcacacggattgctccagacaaggttggccgtagtcgacgatccgtactgctagtggggcaatagcaatgctcacttttagggaaaccatctttccttccgatttgtaaccctcatttagtcccggttattcaactagcactatgaatccgagattaaaaataatgatctttagtcccgggtaaaataactagaactaaagatcgatcttaacaccaacctaaacaaaaagatccctatctttagtcccggttggagttaccaaccgggactaaagagaggataacagcagtccagatgatcccatttcttcttttttttttattttctcctgaatcaagtggcatgcatatctccaaatcccaaatcaaagtagcatcccaaatccacatcacaaatcttaaagttatttatacacataaatcaaatacatcgcatatcctaaaaaaaaattacatacaaatcaaattacatcacaagttctataaaattcattgtaaatacatcacaaattcatatcgcacacaaatcaaatacatcacaggatcatgcaataaatcataaattctaaaaaaaaaaaccacagaggcgccgcccggctggccgctgccgccttctctccgcgccggccggccactgccgtgcagcgtcgcccgccactgcgtcaccgcccgctgccgcgctgccgcgtcggccgccgccccaccgtgcggccctgcgcgctgccgcccgctgccgcgccatccgccccccggccgacccgctctctcgctcgatccaaaaaaaagaggaaggaagaaagagataaggcaggagttagagaggaagaaagaaagaaagagatagagtttgttgtgtggacgagagagaggataagtaatagggattatatagtacgtgatgatttttattcccgttagtaacaccaacaggactaaagttaaatctttagtcccggttggtgttataaaccgggactaaagatcctaggcgcctgacacggtctgacatggaaccaactaggactaaaaataatctttagtcccggttggttttaccaatcgggactaaagatcatttttagtcctggttggtaacaccaaccgggaataaagatcatctagtcctgttgttcttataaaccgggactaaaaatcatttttagtcccgatttttaatagaaccgggactattgtagatttgggtcgaccgaccaaagatggtttctccaccagtgggtggcttcagtatcacgagttaatgcctccatgtccttggtgtgatatccgaattccataatcactttcctttatggtttatccaagtatcctagacttttagtctcttagatttgtgcagtaccactcatgtagtgatgtactcatgtgaactcaatctgaaattatttagctttgaattaatatcactttacctaggcacctagcactccaccagctaataattagtttatctgtgtatgaatttgggcatgaaatggtggtcgtgtcaaatggggggagggggaggatgaagagaacaactttgagatggacgaaagatgtcagtaagcctaccttcttagcgtaagtgagggagagaatggagataagaagtcaaaggctcatagattaggagtaaaaaggccaaagggaggtatttcactgtctccttccaagtgcaaagtaacgagaggaaagcgggctggttgttggaaataatttaaggtgatcaatgttccctacaagaaggagaatgggaaaatggaaacaaaggcaaagtgcatgttttgtcatcatgctatgcttgtcacgtcccgactttcgttcgggattaaaaatcaattaataatgtatttctagaaattaaattaaaagtttaagcaatttaatcaagtgaaagattgggagaattaaagattttcctctaaaaatcatggccaggagtattttgaaatattctttgtgccctaaaaatactctccagatttttccgtgaattttcggagctcaagaagtaattataataataaaaagttcatttaatcaatttaaataaaaagaaaacaaattaaaccggcctcctctccccgagccaccgacaggtgggccccacccgtcggggccatcccctacctccggctacccctcaaccgccgccatggtctccccacgtcgccgccgattccgccctctcctccacccgcgcgctcaccctcatcgcggggccacgtcgccccacctcctccacactccttcccccacttgcccccaaaatccggcacctaatcgccgccgccacccctcgatgtcgccccacttcctcgccggttgttgccgcccttccccggccatgcccgtgactcccgagcgctataaaaagcttccctgtgccatcctctctctttttccccattcgcccgagctcccatcgcgccctctcgagctccccgtgtcgctcctctctctccgccgttgctggtgatctccagccaccactcgccgccatcctagccatcgtcgcgtcgcgcggccaccaccaccggcttcgccgccgcgagatcaagcttggccaccacatttcctccccaaaccgccgcccgaacgccgctcccactgccgacccgagccccaccaccacccgccgtctccggccgcctattgccgccatccccgtccacctcaggctgtgccaccatgttgacgaccaaatttggaaatatcagtatcggagatgaagattagatcgaagcggaatcaaagataagggttatcgcggaaacagagtaagaatcggctggagtccggatcggctacgattgggatcggctaagtccgagtcagactgggttaggtgatgcagccgattctgacaatacgacttgtgtacaacatcgggttgagttgatatgcttcaagatgattgccacgcatggatagagtcctgagaagacaattatatctattaattaggatattttatgtaatttccttagagataagtgtcacgcccagaaattcacgaaccagaatttctaagctgaatgtgcattaaatccctgtccaggactagccagggtacacaaacgacaattgttgacatacagatccatgtcttacaaaaatataaaagtttacaaatgcagcggaaaagataaaacgaagtaaactcggaagcttgacttcagcagaggggcgactccattccacaggcaatccttgacgacagcgacgaaaccaacctctctgagacggctccaactagaaagatcttcagctctggtgtgggggaaaagagagcaagactgagtactacccactgtactcagcaagtcataccggaagaggaggtataatgcaggatataaccaaaggaagctaggggttcttttgcataaagcaggcatttcaaagcagtagttgaaagcagtacaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcacctataaccgcgggcacggctattcgaatagttttactctggccagaggtgtacaactgtacccacaagacacgattccacacatgtcgccatgccccgaagtatcaccatgatattgcaaagggggaaatcgtgacaaaaccctccacataaccctcccctaaccatccacaccacgctaaggtttcacccccacccctcaaaaggcagtgggcggtcccctcttgcgccgcggtgaatccggtagctggataaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcagtgtattttaattaactaacaccattgcggtggcaccaatccaaaactatgctcatagccaaagtctatgtaataatgtgatctccatttgtgtactagttgagctaagcatggctaagcatttcctaaaccaacatctaatcattttgatacccaagttatcaatggcatatggtaaacaataaatggctgagtaataggacccatcccacattacattgtaaaagaatgcaacatttaatagaaatgcgggatatttgtaaattgggtacaatatgatcaattgtaatgcatgacttgccttgctctcgcactgatgagaccacagcaacgtcttcgagaaaccgcggatcgacgaaatggccgaaaactacgcgacaaacaaagcacacaagcaaaacatgctataagactactgaaacaggaaacaaaaccatttttaatggattctttgtatttttcttgatttactgagacttgaatggacttaaacggagctcggatgaattacttatgaattttagaagataaactgtgtttttactaataaagaaaaagtctttaattaattattgcgcaataacacccagggctgacgtcatccaagggggggcggtgccgacaggtggggcccacgggtcagcggctcaaagggggtcggtccaccgtggaccgggaccacgcgggtggtccaccgccggtccactggaccgacggtccagatcggccgggaggccgatcggacggcacggcggcggctaggcacggctcggctcggcttcaaaaccggccggccggccatgacaaccggcggcgacgcgcacggtcgccggcgatggcaatcggcggcgcgggaagcgacggcggacggggtacaggactgcggcatcgaccaaaggcgacggcgagcgcgtggagagaggcggcgcaaacgagagagaggggaagaggtaggaggggggatcctcaccggcgagtatgtcggccggagcggaggatgaaggtggcggcgacgacccagcgatgtggaggggcggacgggcggcggcggcacctacggagggagttgagaaggattaggagtagagagagtgaccacggtggccaccattgttggccggagacgaaggagaatggatagctcaccgtcgtgcgaggagaaccgggctccggtggggtttagcggaaaccgagcggcgaccgaggtggctcacgcggcggcaatgctaatggcggcagcggcttggcgcggcggcggctctagcggctacggcgcgcgaccggatgtggcggcaagcggcggcgctagtggcgagcggcgcggcggcggtaggaggcacgggagagcgcggcgaaaaaaggaaaagggagagggggatgcagggaagctttataggggctcgagaggggcggacttggccgggaaaccccccgatttggccggcgacgtgggggaagagagagagagagtggggggtgggaattcaaatcgaatcccacccatttgcgggcgcgcgcgcgggcgagaatggcggggagggcggcgacgtggggacgtggagtgggggcgtggcgtggagcagagaaggcggcgacgcggacggtttcggcggcggttgccgtcgtggggcgggcggctagaggaaggggacgacctgacaggtgggccccacctgtcagcgtcccggagagaggggaaaggggaacgggccggcccaaaggaaggaggccgagcgcgggagggagtgggccgacggcccaatagagaaaaaagaaggaaaagaaaaagaaaaagaagaaaggatttttcctgggatttaaaattgcactttggtgatttttaattggttaaaattattttcaaggctctgaaaattccactaaaaatcctgttaatatattggagcatgggggaactcaagaaaaattccaccacgctatttccgattattaattgcatttattaattatggaattagctctaggttaattaaacaatttctttgcgcaatttatttaaccaattcttaaagcaagaaaaaggggaaacttctgggcgtgacaataagtgtgggcaaaagtctgccgtaaagacttatggtatcttagagtttgtttgagataatagttgtgtccgatatggacatatcttgtaattctcgggtataaatagaccccgaaccccatgtatcaattaattgacgttcaatacaatctcggcgcatcaccaccctttttactttcgttttgtttcgacgagtttttgttttcaggttgagctgcatcggtttcaatcttcaacaagaggtaaaacttgttatggcggcttgcgttctcgagattagtgcttccatcttaatgataatctaatcttgtctatgtaattcgtcgagttatcatatatcttatataatctttgataatatcgtcatctaacctataatcggctaacatctgttagtagaaggcagccgattaggttaaatagcgacgttagcttagattatgtaggatatctaccactctatgaaacttccaatggcttgattgtctagatatcgtccttcttttcatacttatagctacatcagttgagtttgatcttataagtcgtgattagaatctcaatctctagcctgcttcttggttgccgattagggtattatcggggtttcagccgatcttacctgatttaactataattattctatatgcttgattgacatgttaaatctgccctttatattaagatcttgttgcatttaagtatattaggccatcatttaatatattctatccgctttaatatcttaatatagagtggtatcggagtattagccgatacatgctagatctatctgatcggctatgctatgaatgtatataatctcattattaatatatattttgatctaagtgattcatactctctcagcaaggtgaccgatctatcccaatcacttgatttaagtatatgtcgatataaggattatatatcgttaatatctacagccgatcgtgtagatttagttctgatttgtttattaatgcttgccgatcgatgtatatatgacatcggcccaaaggtgaatgatatgtcatcggcacctagccgatcggctatcatttatggatttaaccgctgtttctttgtttttgtttcttgttgattgcaggatcaaatcaactggcacgctagcatatccgaaggcgagttttggacctgcactggagttaagcagatctcctaggcctcatgttttctgtcaacacgcttttggcacgcccggtgggaccgattagaagtcagagtcacaacagcaattttctccatggccgagaagcaaccaggatcgccatcgccgaactcggctagtcctggctcttttaaagagaagatctagaagctgggcttatctgagttgatgaagctaacattgtgaccatcactctggataaattgacacctgagcagcaaaaagatcttgatacgatgatgcagcaagcgcgaaatcagttcttgggctcattcacagagacctgcttgggaacacttgtttagaaatacaaagtgaaggtagttgctgatgttcctgggaccagttcttctaaagatggagaagggaaacaagctccaaatggctcggctcagtcgagtgataaaggtgctatagatggttctcaaggagaccaaggtgacggctctcaaggagtgcaaggtgttcaaggtgatggtgctcagggagttcaaggtgaaggccttaatcaaggcagcaatgtggcacagttgcagttcaataacttccaagatcaggttgactatgttgtgcaccatgctttgatcaatcagtctggaatattagtcaacactttgtcaaacatggtgaagtcgatggttgatggttcaatagctgaatatcaagctacgggaccagtttatctgcaaggaggtactttcccgaattatcagctcttaatcactgataatcagcaagccgttcagtcggttccccctaatgcaccatcggctcagccgacggcacaagcatcggctcccgcacctgctgcaccatcatcggcaccgggccagttagtcaatccccggttgttggttagagatcaaccacagcatagtggacagaatgtgaatcggctaacgcaagatcagattgcggctttgttcttacctcctcaatctactgttgacccaccccagcaacagtagattcagcaaacgccaccaaggcaacaggttgtacagccgattcagcaaacacctccgatccaacaggttgtgcagccaattcagtagacgccaccaggacgacaggttttgcaaccaattcagcaagcgccattaaggcaacaggtcattcagccgattcaacagcaaggcttgatgaatgcatcggctgggttcgcaacacctggtggtcagcctaggcaacatgatgcgaatcaagttgtctccgagcatttggttcatcacgtacaaccagatcaaacggtgatacctcaaattgttcccgagcatttggtgcacaatattcaataagactttcaaaattaccaagggggcaatttgaattatcagtatcaacctccgtcaccgcaagttcaatatcagcagggagggtcggctcagcctcagtttgttcctcaatacaatcaattcgagcccatgccacaacaacctcaagttgcacctcagcaacgaccatgggccgatatgattgtggatgtgatgaaggagcagtttgggcttaggccgaaggatgttggaaatttgtagcgacagccttatcatgaatggtttgagagagttcctttgcctactcggtttaaggttccagacttttcaaagttctcaaggcaagatagtacatcgacttatgaagacatcaaccgatttttggccaagtgcggtgaagcatcggctgtggacgccttaagggttaggttgttccaattatccttgtctggatcggcctttacttggttttcctctttaccatatggatcaattaatagttgggccgatttagagaagcaatttcatagctatttctacagtgggattcatgagatgaaattgtctgatctaatagcgatcaagcaaagatatgatgagcctgtgcatgagtatattcagaggtttcgagagatgaggaataagtgctacagcttgagtttgactgatgcccaattagccgatttggcttttcagggtatgattcttccgatcagggagaagttctcatctgaagactttgatagcttgtcgcatcttacacagaaggtaaccttgcatgaacagaggtttgcagaagccatgaagaactcaagaaggttaaccatgtctgtccttacatatatgggtcggataatgatgatgatgatgattctgaaatagcagcagccgagtgggtaagaagcaaaaaagttataccatgccaatgggtgaagaattctggaaaagaggagaggtatgactttgatattaccaaggctgacaagatttttgatttgctactccgagagaagcagattcaacttcccgctggtcacacaattccgtcggctgaagaattgggcaagaagaggtactgcaaatggcataattccgggtctcatactaccaacgattgcaaagtctttaggcagcagattcaagcggctattgagggaggcaagatcaaatttgatgattctaagaagccgatgaaggttgatggcaatccttttcctgtcaatatggtgcatacagctggccgaacagccgatggaggtcgtgcaagaggttttcaggtgaattcgactaaaattattaataaatatcagaggaagtataacaaatagcaggaaaaacattatggagaagatgatgatggctttgatcctcattagggttgggagttccttagattttgttggaatgaaggtatgagactgccatctatcgaggactgtcccggatgcagtgatattgcggagagctcgagccgatcgtatagtacgggcaatcggctgaggcaaacaagagttcctgttcatcaaagattgggtcccgtgaaccaagatcgtggccaggaggacaatgaaaacatgaaaactcaattgtgtccttctggtatctttacaaagaatcagaagaggagggttgaaagattgaggaacagggagcgctttcaggaggtcgaacaagaaatcaatcatcggctgaagaagacaaagccgaggcaggaatgaagcgttaagaatcaagctcctgaagccgatgaggcaaagaagttggcaaaagggaaaagtgttgtaatggcatcagttaacatggtttttaccttgtcagctgaatttgggatcaagcaagccgatgttgacgaagtggaagaagaatggctaagttggttctatcaccagaacaagcagtctttgagaagcctcaggggacagagaatcggcatcttaaaccattgtatataaatggctatgtcaatgggaagccgatgtctaagatgatggtcgatggtggggctgcggtaaatttgatgccttatgctacgttcaggaagttgggcagaaacgctgaagatctcatcaagacaaaaatggtgctcaaagactttggtggcaatccatcggaaaccaaaggggttctaaatgtggagctgacagtcggcagcaaaactatccctaccacattttttgtcgtcgatgggaagggttcttacagtttgttgcatggaagggattggattcatgccaattgtggtattccttcaaccatgcatcaatgcttgattcaatggcaaggcgacaagattgagatcgtgccagccgacaggccagtcaatgttgccagtgccgatttagctctttgggagatggatggtctcaattgcttatctggaaaagtttgggatggagattttttaaaagtgtccgattccgatatacagccaattgaagatggaaaacccaagctattattttgaggatgtcatggagggttcaaatgtctacaccaaggacaaagtagatgatctcgatgacaaacaaggacagggcttcatgtcggccgatgatttggaagaaattgatataggtccaggtgatcgaccgaggccgacatttattagtaagaatttatcttcagaattcagaaccaagttgatagaactgttgaaagaattcagagattgcttcgcttgagataactcaaaggagtgttaatgcaatcaagaagattcagcctccggtgaacaagacagaactacaagagatgatcggcaagataattttgttagaaggtttatttctaatttgtctggacggttagagccttttacaccattgttgagattgaaagccgatcaacagtttacttggggggcagagcaacagaaagccttggacaatattaagggatatcttagctctcctccggttttgattcctccgcagaaagggataccttttcagttatatttgtcggccggtgagaagtcaatcggctcggtcttgattcaggagcttgaagggaaagaaagagttgtattctgcttgagtcgtcggctcttggacgtagaaactagatattcccctgtggagaagttgtgcttgtgcttatatttttcatgtacaaggttaatgcattatctattgtccaatgaatgcactgtcatatgcaaagccgatgttgttaaatatatgttatcggctccaattttgaaaggaagggttggaaaatggatattttccttaactgagtttgatcttcggtatgagtcaccgaaggcgatcaaagggcaagctatagccgatttcattgttgatcatcatgatgattcaatcggctcagttgagattgtgccatggactttattctttgatggatcagtatgtactcatggttgcggtatcggcttagttataatttcccctcggggggcatgttttgagtttgcttatactattaaatcttatgtgaccaataattaagctgagtatgaagcagttctcaaagggttgcagttgttcaaggaagttgaagccgatgctattgaaatcatgggggattctttgctagtaatcagtcaattggcaggagaatatgagtgcaagaatgatacattgatggtttataatgaaaagtgccaagaactgatgaagggatttcggctggttactttgaagcatgtatctcgagagcagaatattgaagctaatgatttggctcaaggggcatcagggtataagccgatgatcaaacacgttaaggttgaggttgctacaataacagccgatgattggagatataatgtacattgatatttgcagaatcaatctcaatcggcttctcggaagttaagatataaagcgttgaagtatactttgttggatgatgagctctattatcggacgattgatggggtgttgcttaaatgtttgagtgccaatcaggctaaggttgcaatcggagaggtttatgagggaacttgtggcactcatcaatcggctcataagatgaagtggttgcttcggcgtgcagggtatttttggccgacgatgctagacgattgtttcaggtattacaaaggatgtcaagattgtcagaaatttgaagcgattcagcgagcaccggcgtcggctatgaatcctatcattaaaccatggccatttagaggttggggaattgatatgatcaggatgattaatccaccatcaagtaaaggacataagtttatattggtggcaaccgattatttcaccaagtgggtagaggcaattcctttgaagaaggttgattctggggatgctatacaatttgttcaagagcatataatctatcgatttggtattcctcaaaccattacaactgatcaaggttcgattttcatgtccgatgagtttgttcagtttgccgatagcatgggtatcaaattgttgaattcttcaccatattatgcgcaaactaatgggcaagccgaggcttctaataagagcttgattaagttgattaagagaaaaattcctgattatcctcggcaatggcatactcgtctagccgaagcatatcggatggcttgtcatggatcgatccaagtccctccctataagcctatttatggacatgaggctgtcttgccatgggaagttagaatcggctcgagaagaacggagttgcaagatgatttgacagccgatgagtattataatcttatggctgatgaaatagaggatttggttcaatcacggatgcgagcccttgcaaaggttactagggataaggaacgaattactcggcattataataagaaagtggtgcccaaagatttttcggaaggagaacttgtgtggaagttgattttgccgattgggactcgggatagcaaattcagcaagtggtcgccgaattgggaaggaccgttccaaatctataaagttgtatctaagggagcttacatgttgcaaggactcgatggagaagtttatggcagagcgctaaatggcaagtacttgaagaaatattacccaagtgtttgggttaatgcatgatcggctgatgttgccgatacatgatagccgatgtatttgcatcgccttgagatggccgatattgtcatatcgcccttagttgtttttctattgtaatcggttgtggtttgccgatgtacaaatggccgatattgttgtattgcccttagttgtttttataattttatcaatgcttttgacattgtaaaattaggggtgcacatatataaaattgcaaagtaccagagtatctttgctgattaaaaaaatttctaaggcctattacacagagagtcaccgagacaaatattgctggatagcagaaatagccctttgtctgatttgttctacttcttcaatggcttgggcatcttgagcatcggttccaggaattacttttaaagacttgtgagctcggcaacattcttggtagctgattttagtcttgccttctgctcttcgacgaattttgggaggtcggccagcttcttatgttctatatctagctcagcattgcattcttcaagttgtgccaagagctcaatcttgcgagtctcgagccgatcaatgttggatttgatcggaccctcagatagctgatcaagcttggacttctcgtcgtgcacaagttgtcgattggcttggattgtggcttcaatatccttgcgctcccgacgttcggctagtcttagcctagctttctccagcttgaattgatgctgctcaagataaacggctggagtaaggatatcggctagctcatctgggattagagcttggatctcgtgtaaccgagtcctgatcggcccacagtttaccaccaagttgtctagcgatgatgcttctagccgatgagagaagtcttcaagggttttctttacatcatcggacaagggaactaaagacttgctggtggtgtcttcttctgtttcttcgtccagataatctttaatgtcgaaagagaacagatcggctaaggcctgcaagaaggaatttgagaatagatgagtatcagcatgagttatatggccgatataaattcttgtgttaaaagacaagacttaccgggattgcaggagcagctggttgtgtttcttcctcaacatggtgactccctgttgacagaaaactccagtgcaggtccaaaactcaccttcggatgtatgagcatgccagttgatttgatcctacaatcaacaagaaacaaaggcaacgaaaccgtgattaaatccataaatgatagccgatcggctaggtgccgatgacatatcatttatctttaggccgatgtcatatgtgcatcgatcggcaaatattaataagcaaatcagaactaaatctactcagtcggttgtagatataaatgatatataacccttatatcaatatatacttaaatcaagtgattgggatagatcggtcaccttgccgagatagtataaatcacttagatcgaaatatatattaatggtgggattatatatattcatagcatagccgatcagatagatctagcatgtatcggctaatactccgatactactctatattaagatattaaagcaaccagaatataccaaacaggggcttaatatacttagatgcaacaagatcttaatataaatggcagatttaacatatcaattaagcatgtagaatagaattagttaaatcaggtaagatcggctgaaactccgatactaatctaatcagcaaccagaaggcaggctagatattatggttctaagcatgacttaatagatcaaactcaactaatgcagcattaagtatgaaaagaacaacaatatctagacaatcaagccgctggatgtttcatagagtgatagatatatcacatagtctaagtcaacatcgttatttaacctaatcagctgccttctattgacaaatgctagccgattataggttagatcacgatattatcaaagattatgtgagatatatgatagctcgacgaattacataaacaagattagagtgtcatgaagatggaagcactaatctcgataactcaagtcgtcataacaagttttacctcttgttgaagatcgaaaccgatgcagctcaacccgaaagcaagaactcctcgaaacaaagcaaaagtaaaagggtggcgatgcgccgaaattgtattgaatgtgtgttcatatttacatagggctcggggtctatttatacccgagaattacaagatacgtccataccggacacgactattatctctaacaaactgtaagataccgtaagtctttgcggcagacttttgcccacatttatctctaaggaatttacatgaaatatcctaattaatagatacaattgccttctcaggactctatccatgtacgacaatcatcttcaagcacatcaactcagacccggcgtcataaatgagtcatattgtcgtaatcggccgtatcacttaacctagtctgactctgacttagccgacctcatccgtggccgatctggactcagccgattcatgctctgttcttgaatcgatcttcacctctaactccgcttcgatccaaccaccctttccgatactgatattaccaaatttggtcgttaacacatgccccccaagtccgggatatttgataatgtttcggattggctgtatacatactccgaaccggtttcgcactttgctgttttctgaccgttatccaagcgctttaaatactaaccgctgcccctgagtaatctcacaccgttactcccgttttcaccgctcaagcgaagctctaccttctctctctccggcgattcctccggcgcaaaagcgatttccaagtgactccatcttcagcgagatctccgcccgcagcgatgtcgtcctctgccagcccatctgatgcgccatcagccgagtatgctgaggtaagtccccatcggctcaatcccttttcttagcagcaaatcaattttattttgccttatatcgctttcctcttctcgaccgctttggatttgtagcatctctccaacctagttgtgattcccagtctatcgcatgaaatctactactttctcggcccagtcggcaatcctgatcccactgagttcatcataggtgaaaccaataggattcccttcagattaaccaacccagatctaagccactagaagaacacctttaaatcttggccgtctctagagaaaacttcacccgagaaaatttggactacatggttcaagcgcatgtcggccagcaaaagagttcactaggacgaaatcggaatcgggcaagcactcgaccttaccatagccaactcagctaaggacgaacccctgatggcagctgcctcttatttctggtcaaacaccatcaatgccttcttgtttaaccatgggccgatgactccaactctcatagatatcagcatgattacgggtttggacgtcacttcatcggctaacgctatgggcttaaacacaaagaatcaatacgacttcaagaccaagagcataggcggctggtcaggctatgtagcagcatacatgggccaggattcgatcacccctcgagaacatgtggctttcttgttaatgtggctagagaaatttctcttttgtggatccagctgcggtcctacaaccaattggcagttcgtaaccgaagccttggaaacgaaaagacaatttcctttaggcaaaatcctcctcggctacttgtaccaaatgctaaataatgcatcggctaagctagctgtcggctcagtagtcggagcaggtggaccatggtggctactgcaatcctggctaaatctggtagtcatgaaagttgtcaatcggccatccgtgacagaagcagaattcccaagactggagccgatcacagatgatgatggagaagaacacactcatcgccgatgtatgtcatatggagaatatgcatccacaccggccgatgctggagcaaagttatcagccgaactgctcaaagactggttttgcagcttctatgagggtattcaaaaagatgctcgagtttgtggtttctttatggagactcaacagacctcgagctcccataggacttcagattcgaagacatcaatcatgaaagataccaaaaatccagggaagtcttcacagttgcaatcactccgtgcatccttcccgtcggcattcatcaagggagaaacatccaagtttcctatgagttttatcatccaatgagttctgccaggcaatttggaatgggccaactcccaatcggcttattctttgccgataagatccaatgccgaggagaaatctcatcaactttaatgatggatcggctgctcaatctccaaggacctcctctaggcagcattgacaacataaagctagcaacctttaggagcaaagtatttgacagatggtggggcgaatggaagttgcacttattccatcaatcaacttctatgtatatgacagacctctttctagatgttgtcccttaaataagtcttaactcacttaattttcatttgaataactgcttagccgattaatccttggctaactttccttttgacttgcagacaacagaatcctctccccctcaccagagcaacagcggcaaggatattgagtatgccccaggattgatccctaacggaggtgggccatctccccccgtcatcggctataatgcccccaagacttcagctcttcttcaagggctcatcagagaaccagccgatgccggcaagaagaggaaaaccagatcttcggccgtaaatatttcagccctagctccaaagaagaaaactaagacaaagaaaaccacaccagctgatgatctgcctgctctagatccatccattgaacaagctctggatgaagaagtaattgaagatgatgttgatgaggccgcagccgaagtaagtgatacagaacaaacaccatcggcttcacccaaacagacccctctaactccttctgctccagtccacttttcaagagtaagcagctctctttgatcccttttataatcattttatcttatggccgattacttacagatttagtaattgcagaaaaagaagactgctatgaagaagaaatcggctgcaacaacatctaaaccagctccaccagtaagatagtctcagtttttcattagtcaattctcagcccattttgtctaacacttgtctctttttagcctcctcctcctccttccccttctatacatcaatcatcaagtgaccagactccatcagctgtaggaagtcaccatgtggaagaagaagttcaaccaactgctcctgctatcccagtaggttttttttacaaaaaacattcaaatcggctatgcccatttaatctctaactctctttaaatcattgctgcaggtcttagccgattttttctcttttgaaatcagagattatcttgatgaaagagaagaagacaccataagcaaagccttagcccctttatccgatgatgtgaagaaagttctagaagatatttctcatcggctagaagcatcatcgctagatagcttggtagttgattgtggctcagttaagactcggcttcatgagattcaagctctaatcccagatgagctagccgatatcctcactccagccgtttaccttgagcaacaccaattcaaactggagaaagccaagttgagactggctgaacgacgggagcgcaaagacattgaagccacaatccaagctaatcggcaacttgtgcacgaagagaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 9062 - DNA, 64183 bp, Oryza sativa
  unsure (1)..(64183): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccattccacatagtaggttaaaggatgtaaatattggtatttggcctagggtgatcctagcgcggagtgtgtcctgacatacctcaacatccacttaccattgcaagactcaggtatcccatcaccagagaaagcgccgagaacattgttgctgcccattttgtcactgccggataaggctccactctctcgcgcgtgcatggaggaaccggcacttgccgcgtcgccgccaaagagggtgctcccctatctcacgactcttcgaatgttgtgatggcattagatggtgtgtttctggcaaccgaaggatgtggttgtgttcagtcaccaaatcatatatatagctcataatttccttcaactctgtttaatgttattcccatatgaacattgcagccagttcttgtctctactagaggatttttggttagataatctcttttatgttttcctcgataaccagcacttgagcaaacaaaccatctacttgggcccatctgctgcacttttgttattatactgcttcctaacatcaaagccaatcttaccaccatagctaacccaaaatttccaagcctcgtctacacagctaaacttcattccagtcctaggcatccaacatggtgtgctatccattctacaaataaataagaaaaccatctgtgacatatgtttgattggaagatgccccaaaaactgctattgaaaaccaatgaaataataagaatagatgcaagcaacaaaccttcacttctctgcattttggttgatcctactttcctccatctcctgttggctcatatttgtggaagcatctttggcgctaagagaaattgggagataagtagaacacatgatagatagaaatatgcctcaaaatttgttactggaagccaagaaaaccataaaaaaaaatagatgcaagcagcaatcttcacttgcctctctaaagtttggttgatcgtacttctctccatctcctgttcatttatcttcatagatccacttcagtgttgagagaaattggaagaggtatggcatgagagagagaaaatgaaaagactcataggaagcaagtccgtagaaattggaggaaaaaggagtcctgcaaaggttttggcatctaaaatcaacctgggcctactgctcttcccctaaggcccatttcatttttgccttatctaatccagaggatacagatggatggactggattggagctaatgccaccctctgcattagcttctctaatgtagaggacccaaatccccaaactagagttgaaaggccatattttgagcatcggtgcaaaaataggttgtggaggatagattgcaaacttcctacagtgaccacatgagcaacggaaactctaatgagcgatcaatcgccctggctattggctagcaatcgccccattcccccctccctccctccacctggtttcctttttttggcaccgcattacttttctattttagtaaatttatgcacctaaagtttatacacctcaagtttacacatctaaagtttagagaccaaaagtttataagtcaaaagtttatatatccgattcaaatttgaatttgaattcaaatatttttttatatatagtatttctatacatctaaaatttatacacctaaagtttatagacctaaagtttataagtcaaaagtttatatacccgtttcaaatttgaatttgaattatatctgattcaaatttgaatttgaattcaaaaattttctatatatagtatttctatacatctaaaatttatacacctaaagtttatagatccaaagtttataagtcaaaagtttacatacccgattcaaatttgaatttgaatttgaatttgaatttttatatatagtatttctatgggtgaatagccaaagtggtcctccaagtttcatcgaaagctcagtttagtccttgatgtttcaatctatccatattagtcattcaagttttcatcttagttcaaacttatccttgaaccaacaactctcttgataaatgacacttatacccccatcattcacatatataacagaaaattgcatgcttgatttttttttatagaaaatgcatagtaaattatgtaaaacgaaaataaattatgtactagcaaatgtatacgatagtaattgcttaagtttcatgtgcacatgttgaaataataggaaaaacatctgcaatgttatttattcatcttggttttctcttttctatctagtatatagctaaatacaaattaagggcaaaagggacattttctaatagaaatattgactacaaatagccatatggcatattaagtgggcccaaggatgatttcaagccaaaacaaatatttagaggagttatgtggacaaaatgaaacgtgaaggaccaaattgagccttcgatgaaacttgaaggactaaattagctattcatcctatttctatccataattttttctaacttttgtttttttaaaaaaaaattatggtgtactgtaataggaagaaaagatggggaggagaaagggggagaagaggaaggaatcggcatagggggaggggagtgcgggtgatctctcagtaggaccccatgagctactgattgttagttgtggtaaatataagtacatatattaaaacattgttccgcggttgagctttgacccaccggtcagaccaatgaaccaatgaaagcactactgatttgactgctggtccggttattttaactatgcttgcaactggtagcatcttaataatgtgtagtagtatgcatgccttttgtgaccttttaaagccatggttctctctctttctctgaccatttagggcttcagtaaatgctaagtactcaggcaggcagaggtacaagaagacaacattttttttctaataatggaaagaaaaaacaactcctaacatttaacatcttgcactagttattccttgagtccactctaaaggagatcctccactttccctaaagtatatctgttaattttatcttgtactgtatgcgtgtaacagaaaaaagaaaattgttaagttaatcatgcaccaatctagaggcgtattaagctaagtttttgggtaccaaatatgtacttgtccaaagtcaacaacaactaaagaaacgttagcaataacgtgtttgcaaaagagagacttgcaaatggtgtgcatctcaagaagagagacttgcatagtctcttctagtaatcatatagtaacacttgctaggacaactctaacattgtgcctacctgcagaatatctcagctcagcagcgatatggagggagccatggtaagcgctctgacgggggcactgaactctcttctcttcaagctcaatgacctgctcggaagcgaacacaaatctctcaaagggttaaggggggagatcaggttcctcgagagcgagcttcgcagcatgaactcgatgcttgagaggctcgcagacatggaggaaatcgatgcccagacaaaggagtagagggacagggtgcgggagatggcctacgacatcgaggattgcatcgacctcttcgtgcatcacctcggctccctcaccgggaaagccggggtcatcaagaagatggcatggagaatcaaggggctacagttgtcgcatcggatcagcgggcggatacaagagctgaaggctcgtgtcatggacgagagcgatcggtacagaaggtacgacacgatgaacatctccagcatgagctctgaagcacatctgcacagagatgcctccggttctagaactagatcagttgatcctcgattgtccgctctctacacggaggcggagagacttgttggaatcgatggaccaaaggataagatcatcaaatggctaatggatacgcaaggaggcatctcacaacggctcagaacaatggcgatcgttgggtgtggaggtttgggcaagaccacacttgcaaaccaagtttaccttgaagttaaaaatcagtttgattgcagcgcttttgtgaccgtgtcgcaaaatcctgacgtgaagcatgttctggcaaaattcctctctgatgtttccggggccattggtggtgcattggctgatgaacatcacttaatcaacaagctaagagaatacctccaggataaaaggtatgttgggtttcagttttggattctagaaccaatgttttcttacgacaaaaggagcataaattaatcaatttcttttactattaattttggtgccttttaagtattgaggtaccgaaatgtagaaacgatacaattagcatccttagaagataagttgtagaaacaatacaggctcaaatgatgttccctttctattgctttttggaacaaacttttctgtatcaatacatccttggttgataattaaaagtcatgtgaaacagatattttcttgtcattgatgatatatgggatgcacaaacttggagaataattgagtgtgcattggtcaagaacagtcaaggtagcagaatagtcaccacaacacgtataaatgaaatagctaaatcttgctgctgctcttatggtgatcaagtatatgaaatgaaagctctttgtgctactgactccaaaagattgtttttcagaagaattttcaattctgatgaaaggtgccctcctcaattgagggaagctgccaataacatattgagaaagtgcggtggcttaccattggctattatttctatatcaagtttgctggctaccaaaccaaaatcattagaccagtgggataaggtgaaaagtcgaattaattatacacaagaaaacagtccagatattgaaacaatggcatgggttttatctctcagctactttgatcttcctcatcatctaaagacatgtttaatgtatttgagtatatttccagaagattatgtgataaagaaagagcgtctaataggtagatggattgctgaaggattcattcatgcaaaacaaggggaaagcctatatgagataggagagaattatttcaatgagctcatcaataggagcttgctccagccagtagacatagaggatgatggtcaggtgcatgcttgccgagtgcacgataccatccttgatttcgtcgtgtccagatcaaatgaagaaaattttgttactatggttggtgcttcagatctcacatctactccaactggcaagattcgtcgcctatcattccataaaaacagtgaaggaagtgtcacaatgccaacatacctgctcagatcccatgtccggtcattgacgacatttttgcacgctggacaggtgcctcctcttctgggtttttatggtctgcgtgtgttggaccttgaaaattgtagtggattgaaaaaccatgatcttaaaagtataggaagactaattcagttgaggtatctgaacatcaaagggacagatataagtgatctgccatgtcagatacgggaacttcaatatctggagacattagacatcagatcaactcatgtgaaagaattgccttcagcaattgttcagcttcaacggttggcgcatctgcttgttgattgccatgttaaactacctgatggaattggaaatatgcaagcattggaagagctaacaggtttctctgttttcatgtatccttcaacatttctgcaagagataggaaagatctccagtctaagggtgttgagggtagtttggaactacgtcgactttcaaggaaatgcagaaacttacagggaaaatctggccatttctctcaccaagctaggcacatgctaccttgagtctctttctcttgatatccatggacatgacgaggaagacgatttctcactacatttgtggacccttgctccttgtagactccggaaattatacattggtcgatggcatcccatttccaggataccaaactggactgaatcccttgcaaaccttcagtacttgcatatatatgtcaaaagaattaaccaagaagatctgaggatgcttggaagcataccttctctcctcactctatacctattctccgatgaggcccctaaagagaagctcaccatcagtagccaaggattccaatctctaacattctttaagattcactgctatcatatgggattggtttttgaggcaggatctatggcaaagctcgagtaccttcatatcctgatcagtgcatttcaagtgaagtcttgggatggcagctttgattttgggattcagcatctctactgcctcaccaaggtgtatgcctatattaactgttatggcttgaccgctgaggaggctgaagctgcagtgaatgccattatgatttctgttgacacgatccctaattgtcccaagctgcagattgataggcgatatgcacccttgtgatgaagaataaatattttttttttgctaactgatgcacatactgctgctgtgatctcaattgttacatctatttttcacttccatatatagctttgctcctgtaatttctttcagcagtatcaaattaaagggcttgaggtttggcaatgatttggtccaaagacttcatttcatttaaatggatgttccaattaatctttcttgcatatatttgttcaataaccaaagggagagaacggttacaaaaatcaaaaaagaaaaaaaatcaaactaccaagcctgagttaacttgaagaccctccttgtggtctgaccacagttaaacttttaaaagttcaggaccacaatttagttcagctagactagcactagacaattagaccaccagcctaaaaacagtcatttataactccagttgactcaatatttagactatagagaaaagcaagatgaaatgttcaaaaacatttctggtgtggcggatatcatttgtactggataagggggcatctgtttgttagtaattgttttttttccttacctatcaacctcattttttaacttgtatatcaacattcaacatcttacatgtcgattttttttttgggttgaaacaactcaagttacttttctgaagaattggtactttattgtagatcatgctaataaaaaaattataacatttttggtaaaagaaaatatagcctagataagcataaaaataaatctagattaatgtagtaaatgaaaaacaaagaaatttaaaagtcacactcaatttgtactaaaatttgcagttttttttaacattgtgcgtgtgtaaggatgtttgttacacaagattaattgactaaggcgcagggatttgtggctaaagcgcagggggcagtgggaaactgcacaagaaagaaaagttgcctgagagtaaaggagctcattggtgtgggagaacggagaagaggaccacacctccgactcctccccatctagctagtgtcatattttatctcttagtcctgccgacacatggctcactggttcaaagtgcaatacattggtaccaatacctagccataagtgaaaattattggttaggggtagcccaaaatgaaactttggtaaatatgcctatccttacatacaattcactcttagaacttctgaattattactctttccttagccatccacatgcattcgtagattttctgattcttcttttgatatttaaaaaggctacaaacatttgcatcattttcctaatctttagttattcagccttgcttttgaattttttaagagtaccctttttctcagatggttatggtgtattggcataaaaagaatgtccaggacatatcatgaagattatccatattcagccgaaaactagaaaatacatgtgtggaactcagaataatagcacttctcatagcctaactgaaagaagggtagaaagatatgtcatcaatcaccgcacggtcgtttggtgtcactgaaaaaagatagttgacattattggtatgtacttaggcctaaagggaacaataattctaagattacatcatcttattaaccacatatagcacactgattttaaacaatttggattgtgaataaaaaactcctacgtgtgaagaagcagcagtaaagtggggaaacaattagcatgtacctgaaaccctaagaaagttaagacatcaaagtcatatgcaatattgcagcattatataatgaatggatggtgagcggcgctgccaatgtaccagttcgagaataagctaaccctgtgatacatccgatgacaaacaactggaatgaattatttatggagaagtgtgctatgctgaacatgagtgaactgacaattacggcatccttccatttcattgaggatgacagggctgttaggaggaatccacggtaaatggtttcttctgacaatggagcaatcacacagtataggaaaacacacaatagcctagaggttggactgtcagaaagtatttcccttaacataggatcatatgtatcctgcagtagaatcgaaacaaagaattagcaccttactaattgaaatataaaagtatggtattgtaattgagcaagcctgataataggcctgacgtggaacttcttgaattgcatctgacctcaagacctatcaatctgtcagctactacggttgtgagtgaaaccacggtcatcagaaatatcaaacctagcacagtttcttttacccagctgtgttgtggataaagcttcccttgaaagaaggcccaaagtttatgatcctttttcgtggagtactgcaatagtgctaaagccaaagtaagctctgtcaattgaagaacgaccgtggaagaaacctaaaatgaactaagcagttaaaataatgtatattaagatgaatcaatcaaaacgaagtactaaaaaatcgataccacttactgtggtgagtggatcaagtgaagggcaatgtagcagttcggccactacaccaagccctccaaagctgaaagggatatgaaagataaagaaataagctgcaaatgttctccatatatcctcgacctcccaaggaatatttggagagagcaccgaaaactcctgaaatatcatcacaatgcatcattttacaatgatttctagtttagaatcacaactgcaatttcacatcataattaattgcagatatcatagcctggagaccaaattgaagttgtcaaccttatagaggaaactgggcaaccaaccaggcatcgggacgtgtcaatcatactagaccaacagaatcacgaatttcactccaagatcatttcaaaccacaagtatatctctaccatcctatttttagatgttcatagagaaattcttctaatgcggtaaaagcacctcaaggagatgtcaagaactaccaaacatgatacgccggtaagcaagcaaaaaagtcgatcatgcaactacccgagggaggcattacatcgaacagttggcgggcaccgtcctcgtcgccaccgggggagggagagggagagcatgagcagccgagaaagcgacgacgcaggagcgggagcgtggtcggagccccgagctccgccgcccagatacgaggaggagccccgccgccgcagcctccgggcctgcagtggggaaggcgacgcgacggggcgtgagctgccgctgccccggcggccaagagcatctcgcaactgaagtggcgcgcgcgcgtgaaccgctcgtctctgaagtctaatccttcatgtcgctgctgccaaaggtgggtcttttttataataaaaaaaatcaatttaggctatattttgttagcgatgttttagtttagaccatcgaattcttttctcaagcatataaataatctcaaatatgttggcttataatcgacaatgaacttttatagctatatgtaatatcatttcttctacgtatgacaaatagggtgtagatgtataaaagagttgaggagtggtctaaggccccgtttgctagggctccaaactccaactccagtgagagctagctcctattggagttgaagactcgttaaaaagtgtttggcaagtttcagctctaaatctgaaaaaaaagaaaaaaatgaaaaaagaaaacccagccgccggccgcgcgttgccagcccgccggccgttcgccgtccccaggcgctccgccggccgccagccgccatcatccccaggcacgctgcgcgccgccggccgttcaccgcccccgcagctaggttggatcgggaggaagatgggggatgagaaagaacggtaggagaggaggagtgaagggtagttgagtggaatttttgtgtaaatagaccaaaaaattaaagggtagtgggttttttggggtggagtagagttgtagagcagcaaaaacccagctccacccacgtagttcattttctaggagtagctctgctacctccacttcaaaaaagggaggatctggaccgtttgtcatagtttcggctccaggtaagttggagttgggagctagagctgtgccaaacggggcctaaagtgccacaaaggttaaaaataagataaaaaaaacattggttaaagggtgattcgaagcaaaacatcaataataaaagatgattcaaagtgaaatttactctttttcagtggagcaaaaggtggttatttggttggctacttggctcatttggtttgaggcaatatttctcatatttgacacttaagaaatttcattggaaaatggctacactcggtacgtttggcagagtactaacgagaaaaataacagatagataattgtcaagagacacttagtcctggacaaatcggggataagcaggaaaatattttttcccacctatcctaagaatgagatgggtttgaaatgtaaagtctaatattttgatatgaataatgtggatttgctgaagacctgaagttgattctaagacatgttgtctgtgcatactccctctgtccccaaaaatagtgattcctggatgcccgaggtaattttagctaccattatcaaagaccaaaatacccttgtataagtacaacatccattccatcattcaaataaaaaaacaaacttccgtgcacaagtactactctcgtgcagagtgcgtgtgtgaatgagagagggagtagacgagagaaacgagagagagaggagagaagtttgcgtgaacaagtgggtagactgctatcctggttgctctgctgtgactgtactgctatctcatttaatgcatcacagatcgcttttttctatgacaaatgctcctcttcagaaattgattctttttaggacaaaggaactagatatttaggagcgatacgaggctgaaaagttgtcttgcacatgttgtggcattactaatatatatacttgattgaattatgaacaattctttataaggattattaaataatatatattttaaaatttagaaatagcttcaaacaagccatctatgcaatatcggtgtagaaatttacagatagtattggtactaggggcggcgtctagggatagtttgggaaccaaccataagtcataagctgaaaataacatgttatccactcatggagcatcccaccaatctagaggtggtggtaggataatatactcatcaccaccaagggggtgtttagattcaggggtgtaaagttttgacgtgtcacatcgggtattatatagagcgtcgcatgggtgttcgggcagtaataaaaaaactaattacaaaattcgtcaataaaccacaagacgaatttattaagcctaattaatccgtcattagcaaatgtttactgtagcaccacattgtcaaatcatggagcaattagccttaaaagattcgtctcacaaattagtcgcaatctgtgcaattagttattattttagcctatatttaatacttcatacagatgttcaaatgttcgatgtgatagggtgaaaatttttgcggtgggatctaaacagggcccaagttctttcatacagtaaagattgaaatataagtaagaacacatccattttctttgggatgctgaaagcctgaacttaccagccatgtttctatctcttttcagaccttttcttggtgttaacatcgtaaacagaaaggaacagcttttaaagtctacttcgttattaaccagaggttttggaatccggttacagcaacaaaaattcgggttccaccaaaatggacgaattttggaaattttggctgaaatttgaaccaaatgtgacaaatttgaccaaaaccaaaccaatttcagatgaaatgggagtgaaatggtgtctcgaacctcacagaaatgggcgaaattcgcccaaattcggacctttcagtccaaatcccagaaccgttaagaaaacaggaaagttcaccgcaataaacatactcaagacatttaccacaaagggacaatctgttctcccacaaggtaccgcatcaatccatcacacaaattaacaaacatcacaggcaaattatctcctttcaaatctactacagatgccaagtgcatcttattaagttttcccagctaatttgttttagaagtaatttctcccagctaattaagcagatatgagttgcatctccacttcatcctgtaatttcttgcagctttcctaggggacagaagatcctgcaatatttgtgatgctttgtctgaagaactcttcaacttctgcggcatcctcaggaagtggcatctcatccatcagcagcttgacagcaaatgtgatacacatgtcccattcggacggctctccgtatatcgatgctagggctgcttctgcacctgaaacacctgaaacaagaaaatttttaccaggactgttttgatccagagctgaagttgttcagtgtaaagcttaccattgtctgctttgttctccataggattggtggcaccagtggcatgctgatcaagagcactggcagctgcaccattgctgtccttgaggccagctccagcatcatcagctatcaaggcatcctcctgcttaaatgcatctgcacctgaaagtttcttgtccattggagtattgagagttggcacaccgtccttctggtttgtattttcactagtgctgttcttcacctcagctgaggtatcaatcactcggacaccagtcttctcagtaacatcgttaccggtgccggttttcgcctctcccttggaagctgtcttcttcctcttccttgaataaacagcctgttcattaccattcctgttcttcccagtttcaaatttctggagctcatcctgtgatgtccacaatgcaggctcttttaccctgtggcgcgccgaacgtttaccgcgtgtttttgggtctatgcgttcagtgatctctgtttttatttctagaagtttgtatttagtatcttcaccattgttgtcctttaatttaggtgccgtttcagatgcactgcttgacatgctgtctctttcagttgatttcatcatctttgagccaacactccgatcattcacatattttcttatattccttacagagttcagaagcccctgaagtggtgcccaaggtgtatgattccttccccttgggcggtccgaacgctttccatgaatcttgggaagcataggttcagaatctcctgatgatcctgacaaaaagtaaactacattcaattcattgacattgaaacagggttgttgagatatgcatccaaattacaaattactaatatcaaggggggaagtaaatacaacagtactgacagaattcaactgatttttaacatgaattcattgcccttctgcttggtaaactaagataaactgttactttcaaagggggaagaggtgcaggcaaatgaatgacatatgaaaagatttcccttttggcatgatcttccttttgagaaattatttccctctagtgtttcttctggttattcctaaaacataaattagatagcttttcagcacaataccaaagtaaattagagtggataactcattaaaaaataccttaaaaacaagaatgaactagtagtgaagaatatagaaatgcaagacactgatcatccaatagaatttcaaggaatggaaagatggattaacacgcatccaaaacttttctatatatgaatttcttattatgttgttttaaatctattttctaacttcataatatttaatccgttagcttgtaccctcaaataatcatcacaaatcattcagttattcagccattcagcacagaagaacaggagaatgcacagcttggtatttagcactatgaaatatattgattaataatcaatagttttagttggagataactgctatttaacaacctatgtaaggcatattctatttggcagaaatttttcacgttttcctactggaattaaactgtttcttgtaaagttcatgtattccaaaggaagcttaagtgatggctttcatgatttgtcttgattattggaagaaccattatcataagtttgtaaacagcacagggatacacattgtagaaagcctgtgcactggggtacggcggatgtcatggtcaataataatcaactggttaggagaaggaaatttacagtttgctgaataatagggttaaaaaagaaggttgggtgttcatcattggtcggnnnatacctaatgcaatgatatgatttactcataccatagtccaaaacaaatgagaaaagttttggatgcgtgttaatccatctttccattcatccaggcaaaaacctataaaatctcatttgttttgattgatttttagtggattcattatgtccagatagattaaaacaaaacaaggtacaggtttcatattgtcaggattgaagctaattaagcacccctatcgatgtagttggaccatgggtacgtaatcctcaacccccatccctaccctcatgagaaaaaccatcattcattaggtgatgtatatatatagtttttctttctcgaacacactgaagatctgcgtatcattttattaataagaagaagaagatatacacagggagggaaatccgaaaaatccccaccctaaacattaacacaagttacaaaaaactcaaaaacaggtaaacaagaccatttaacccgcaagggccatcgacctagccaagacctctcagagctttgaagttctagctaagcaccaaactgtgccttcatatgctactgattgaagcaccattgacaccctcagaattgagccactaaaaacacaatcattctgtgattccaaatttcccaataagccaccaaaattataggcgggtttagccatttcttcctttctttgttggtgtcattcactgccctagaccaccagcttgagaaacgatgtgtgtcaggggtcggggtgaggccaagatatttatagtttgaagttagcttttggggtagaggaaagtatgggatgggccagaattacctcttatggggccatgccaaaccaagtggtgatttttgcatgctaggacaactagccaagtccatcacaccaaactatgtggtgtagcaactagtcgtgttagcctacttggcaaggatggaaggcaaattcgccaatcaagtaggcagctagaatcatgaggccagttaggctgacattattttcctgcagaactccaccaatttttcttttccctatagttaaggccacaagtacggaaatacctaaccatgcccttaaaaatccaggatctagtatattttagtttagttatggggttgcaacttgtaatttactatgccacattcctttctaaattacatatggaacataggtctcatctatttcatcaacttacggaaagaaaatctaaatgagtataccaattaatccactaactatgacttaagctatcggacgaacagaattctactacaaatcagtttaccttatgtcgtaatcaccctttataataactagctacttacacagattgagaaggagagtgatatgaagaaatctctcttaccaactagatctgcgtgcatgtagatggagatgttgtcgaggatatcgtagaaacacaagcgaagattcaagaatatgtttgacgaacctagagatcttctcttgaattttatcccctcaaagaccaagaaaggaagaggaaaatactagaacttgcttgggattcctcaatagtagcaaggagaaggtttaaataaaatgtatatggggaatggactatttgctagaataagggtgaggatcccctcgcttcgtaggtgagaactatttattgcgtagagatatgtctattccctttctatttctaaaattaaatgacaaatatggttacatctacacgctccccttgagacctctaacgggcatgcgagttgctcttaaggaattgcgtcatccatctataaagtgataaaggttcaatatagtatgagttggtgttgtcgctatctgtggtatgtaccaggtgtttggtcttctgcttagtcactctgcacatgtgtatacccaagtgacttgaagtgtttatcttcagttccgtgttgggtattgttatgataaatctcgactacttttccttcatgaatcggactctttatgatggtgaaacacctctctatttctctttttttgagtggggaaaaatccccatattgtagtagcattgagttctctcgctctcttctagcttattaatacatctcccacactatagtaggattgaatttcgctcaccctctcccaacatattatttttactggttaatttcatcatgtatgtgtatagaaagtggaatggttgaaacaatgttgatctggacttgtttagatcaaaacaacacttctttttggatggttttccacaaccttttgaagataagtttagaatgtggtccccacattatggccagtgagcagcccccagcaaaacaccttatattgtgctatcaaatgatactgttaccaggatgttctgtagtaacagatttcaccggcgaacagcgtgcaatatattccaaatgttccagctatagctttctcttttcttttcttttcttttcttttcttttcttactatatatatagcttcttcttttttctttttcttttttttttttgcggcgaggagttccagctatagctttcatggcaaaacaaagaggctgtgctagctgccaattgccaaaaacagtagaaacaaattaatggcaacagcaggacgccaggaagaacgtagcaacagctgaattgatttattagccagctcaatccaaacggcattattcacaaactcgatatcaaagtagagttgactaatttggaatggtacttactaatgagagatgacatcgaagatttgttggaactcattaaaatctcatcaactaatatagcaaccaaggtatgtcttggaaatgcacatacttgacggttcttggtatttttctcatggtacatacaataagcgaatgcagcttcatgaaggtaaagggatcggttcacctctggctatttgcatgccaaattttcaagcttctaaaagccccggtcggaagctacagaaccagatagatatctgcgatcacggaggcaagacaacattctggcacaagatgagatctgatagagttttcccgtgccgatcaatccttctcgaagaattcacaccgccatcgaggatattcctcacgacaacgttcagggagctgattcctgggacatcataaatctcaatacttacattctcgagcggatcataccgaacctgatttgctcgatcagcgggaaacaaggaggaatcaagaaggggtgaaacagcattcttgacccaatctcgagtgatcactgccctcagccgaccaatgtcatcagggaaatgcggaatgatggagaaattcaaatcattccctttatcaccggccctgctgtgagctacgtggtatagaggaatctttgttccagatggagaaggaacagcagatggcagtgtgtccatgtttgtgttcaagggaagagtgcccattgcacaccttcttgggcacttgtgttgttgttgatcacacatttgacccttgtcagcattcgtagcctgattctgtggagaaggaatacttgatttcttcatatttacttgccaaaagatcttctcccgatcaacctgtacaaaatacaaatctcagtgtcatccgtagaaatctatgtgttataatctctaaatgttttctctggtagaacccaaaaatatgaacatttgtaatctctcctggaatgaagtacagtgattatccataccagtattttctgcagagttatttccttcttctgcccagtgctgtaaatcatgaaacaaacatgtcagatggttttgcaagttcagaaacaagagaaaattgcagacaccttctccattaaaagtgcaaatacagtagttttcatgagctctcacatgattagctttagtatagcggtatagctcatccatctgagcggtgcataattctgtgcatgaacttatgctattctcaactacaaggcagcatctagatctgagcattgttgataaaagcaaagaatacttgtaaataccttatgccgccaccaccagccggcccatttgtataaagtgcaatgaactcttcaacaaatttgatagcatgttcttccagctcaaatagcccatccatccggaacctgacatccatcacttgtttgacagaactgtctttgttatctccaatggctttcaaactatcatatcctattatgtatgagataatttttccttcaatgccaggatatgtttcatccatccatgacctaacctaattccagaagaaaagatgcaagtggttaaactgcctttgtgttatcacttgtagtgtaaaacatatatttcaattcttaacacatcaggggttatttgaagaaaatatgggaagtactttcatggacttacgaggtatttgctgcatgagctcgcttcaaacattcttggccaccgtatgatatctctccccagcctttccatccgctctcctatataaaatatgtggattaagtgacccacttgacaaactatctgtagctgatgttaaaaagtactatttatccaagccatttcggaaacactattgtttacttcaaatataaaaagaccataatcaaatttcagctatacgacaactaattcaaatactacgcaaacctcaaggcagtgcatttatggagtttaaatattatgtcacatgtcaatactatgtgttcagatgctaagttgaacaaaaagttaaatgaaaaaattcaaataactgacaattaaagtaaaacatacagtaggaagcaattggaggagtttctcgggccagcaaggattggatggttttgctcctttgcactggaccttgtcttttgatatttgctggaacttcacatcacggaaatctacaacctgatccaagaaaatattataactgttcagaaaagaagctacctagaactgaaaccggcatttggtctcaccagatcaggagtaatatagtttgcaggatctccaacttcgtacagaagctgttctgcacatgtgctgtagcttagaagacctccgctgccctctgcctttccaacaaacacttctcctttgtaactgacttcggcatatggaagagacaaatccagaagctgttcaaaagaaaaatctcgatatgcatctcctgctctttaccacaagtagagcataaaatgaacatgaatcataactgtagtgaaaaatcatcatcctagtgattttgaagaagaactgtaccagggtgcatgaaataccctccagtgagttggcatccacattccaaaagatggctagccaatgtcccttgtgacaactcctcaaagtcattccaattccaacctaattcatataccttatgttgaaagggagagaggaaaggattaactaaacaaatatggtattggagaaaatcagccttaattgcattactactttgcataatctaaagaaaatgagcataacaaaaagctgagtagctgacaaaatgacagggtcagcttttatatatcaaggaaaccagaagaatctccaaacttatgcatcatgtttaatttgagccagttaccataaaacatatgtcaaatctttgtgtatttatccgcaggatagacatgctaataactgagctttcgagatttcctaatcacatattttcttttacatgcatgttgcaaaacaattcagaacaccctgttcctgaagcaatatccactttaacatttacattggcacaaagagagttaaaatagtcattatattgtttgcgaacataagaacaactgaacaagctattcaaagcataccataggtgctaagaacagcgcagcatcagcaacccgagaagtaataacaacttgtggtttgccattttctaggcagtgtacaattgaggccacaccaagatatgtgcttccgcccttcacatacaacaaaactaccatcaaatagataaccaaaataggaaattttggttgaacataagcacatttgagtgaaaaatggttaaaacaacacctgtatcaaaataaggcaagagaaatatatgttaataatcaaaactagggcatagcatctcctgatgagtaaatttctatttgattaagtttatctacatctcccagtaataatcaaaagtccacctcatgtgaccaaagttttctatggctgaaccacatggcacgtacattaaaaataggtaactcgcataatgtaacttcaaaattttggatgctactgaatactgatcaattgtgggtaattgtcgtatgtttaaaaagcattaaggttgttagaaggaaatggactaacatgatgtcaaaacgtgtcagagaaatcaaaatagattacctgtcgcaccccagttgattcattagaaaatacagaatttcctgaaaaaagagccaaactaagcttgaatccagcttgaacgactgaatcatgtaacccatgctaggccttactagcacaagaagaaaccaaaagtacctgaagatgtttcataagctacagcgactgttatttccaatcccaaattagatgccagctccagaacttcttcttgagctccaagtggatccactgataaattccaaaggcacatacattatctaaacaagcaaaagaacaaattaggcaataccaaactatagtttgcaatgtcttaccagcgcccatgttagttattatgcaaactcctctatccaaggctaagggtagaagcacagacagccactccttaactgcatgtgaccatattaagaaaaggtgcactaaaaaagaaatcttatctaaaatactaaacacaacacagtaaaataaatttctagtcttctcctccagagaaaaatacacaaataagctatacagtacaaaaatcacataagcttctctatgatttggggcaaagtactctccacaatctcaaaaacagagaaaacagatactgcatacttttagaattgaaaagtgtatacctcggggatcatatccttttcctcccgacatcatgatttggtagcgatccacgagagttcgctcggccaaacactcgagcacaaggtagttaagttccttgactctctccagcaacttgagagcagccatgggccggtcacccccaaatccagcaccacagccaacataaacggtgtccctgcaccgctgaggattgctcctctatcaaccaatagcagtatcagccgaactgaaccatccatttcactaactcgcataattaacatttaacagattttttttcaaattatatagcaagcactaaccaactggaccacacagtcatgaagttcttccattgttactgatgcatcccacggcaaattattcctcagtgaaccaggagcggaactaacagattgctcttaatcagagaaaaatccggaagaagctggatgagaaatcagtccatgtaaaggatggaattctcaaatctatgccacgccgagacatgaagtggcgtggagtggggagtaggaatacgagagaggagtggatatatacctccgattcgattcgaggaccgcgatgggggggccggccgcgcgcgtcgctgctccagacctgctcgccggcggccgtgctcgcgagagaggaggcaagggggcggggccgtcgccggcggggagcgcgcggaggcgagacgacgctggaggaggggggaaaagctgcacgtgcgtgcctctcctccggcacggctatgctgatcggagttcggagatggttggaggcaagggcatttttgacatttactatttttaagtctattttttaaaatattaaaatgtacgaaaccatttaatttcacgtaacattttacacgttcaatcttattaaaaatttagtttaaatatgtaaaaatataagctaattttatattttctttttatgataaaacaagtaaaaataaataatatttatgtttatacttttaataaaataaacggttaagcgccgggttaaaaatcagtagtgttgtatattaaaaataggagggggtaatattgaaatgttataaagggaagattttagtcatatggtccgtgataatttaaatgctaagggcaaaaacaacataaatttctcaattagtaaataaggatttactcgtgaagttatgttgaaagagtatgaacgagagagattttgggagagagtacgaggaaggaaataaaaataaaagaattacctattaatctatttgacatttggcggaaacacacaatttttttttataaatttgaatcgttttaagatttatacagtaccacaatcttaatttctatctcctccctcctaactctcacagtcccacatgctgccacttctccacctccgcttcctcactaggtcattgtgtgtggcctcgctagtgttagcaaagcttatgtgtggcttcgctagtgttagcaaagcccatcatacattctctccctcgtccccgcctatcctccttaacccggtggtgtattcctgttgtcttcctcatctttgacggctcccctcgcttgttgcatcgtcactgtctctacctgctaaccactcactctattttatccctatcatcaataccgacccactataacaccactcgcagtcgactctttggcttaatcatcgccgccgtctcaccgcccactacgaggctaccgccactcaccgctatctctttaaatccgagtaactttctctgtctccgcctatacctcatccctgatagccaaccggtcggggtcgcagtcgttgaaaatcaacgagcttgccagagtggaaagaacgatgtaatgtgcacgaatctcggagtgtctagggtcgaaaatctgccgaatcgggcttaaattcaaaagaaaaagataaaaaaaagaagaagaagaagaagaagaagaagagagaaaatggcgattacccccgtcgattccccctcccctccatctccgatcagcagagccaacctgcacttctcccgcctcctcgcgctcccggccggtgacggcgagctggctctcggtgttaacacggcgaccccccaccctagcatcctcctgtgtgtgcggcctccttgcgagcaggtctggagcggcggcgcgcgcggccggccccccatctcggtcctcgaatcgaatcggaggtatccattcctctctcatgtgatggcttggcattggtggggattttgtgctctgctgatgctaattggtagtagtaatttggtactgcgcactgaactactgatgatgatgttggaaaaccatgacggcagttttatcactgaattgaactagtagtgtgtggcaacttctgccaatctacctggaatgtgaagtttctgcagataactaataacttcgcttctgccaaatttcttaccctcacattgattatatttgtttgcttaattgtagatagtacttcagtttggaaaaatgtcaggagattaaaattggtggaagccacttggcgcaagtgctactcttcactcttcagtcactgaataatgaagtatccctgtacaatgaaaaggtatttctggcattttatgatgagaggataatcaccttttttcaggaataagtaaaagatttgggcatcattgcatcaagccgaacaaaaaggtttataaaacatcaaacacatcctgtgtgttgagcacaatggtcaaacgactggaacaaaggaaaaaaaaaccgacaattcgacctaagctactgacagaaactaaggaatcagactactaaatgaggcaagctcttactgtgcgacccactaattcgcttcttctgcaattgacgcaatgatccaagaacaagcacttttgcagaagtggaggtgagacatctttgcaggggttggcctgttgacaggaagcctattgagtttacaaaatggtggcatggtgtaatgttgtaatattttgctactcacttcagtttgcagttaatgagttttggagtaatcatagcattagccaaatgttttctgacatagcaaaggtctccaaggtctcaggctctcagcttaccatggcagacctggtcttactgattgtgcactatttcctcatagatattccccttctagcagtaatagcataattcccttctttctgtggaatttcgtatgttcaaattatttcaatattgcctcagttttatactttgctggtgttaattgctactgaactactgataatattggaaaacctggccttatatggaattactgaagtaccttcccttcgatctcagtttaccatgggagacctggccttactagattgtgtactagtttctggtcatagatgttccccttttatgggcagtaccttattaataatcccttttctttccttttgacactgacagtctttaaattacttcaatactaacgaatttgctagtgctaattggtactgacaatgttggaaaaccgcagcagtaattggtgtggcatgttctgcctgagatgttcagttaataacgttgttccagtctactttgttacactcagattgcctttttgtttgttttactttaggtagtacttcagtttgcaaaagacgatgatattggatttggtggaagtcactcggcacaagtgctgctgtcaagagacaggaagctgacccctgtacaatgtaaagtcattgctgccatgcacaggaatcctgtgcatatatgatccaagatgcaacactttcgcacaagcggagatcaggattcaggagataagttcagcttactgaagacctgctgagttcagcttgaagttgacaagttttgcagaaatagctgactcttttttcacattggagcctgtgaaactgttgtaaattcttgatgacgctagatctttttgttttgtatattcttcagtaaatgtaaatataatgtaagatgcacttttaagtacgaatcctgatataaggggcacagcagctctgttttgcagctgctagtatggtggtcatgtaaatcgatgcaagaaaagcaccagggtgtcagtggcactcgtgctatagttgacatttgcagtttaataaaaagatgaaatgattgttctatattctcagtcataccatatgtcatccattgaggttaaaaaaacttttgtgatggatgattgtgagccttttgttgcatgtgatcacttcagtcaataattcagtaacaatggtgcatgcttataaccattgctcatggtgaatctgaaactgctgtttttggagcctgttgtcaattcttgctcatatgtaaacctgaaggatgacaacatgctggcttgtttgcttcacaacctgctgattatatccatactggggcaataactgattgtgtacttcagtacttcagaagatacagataaggaaacagagaaagaactccaactgaatgtgcaccactcaagaagtctgacagatcaatgaatagaattgggaatatatttattgaacagggaatatcgttacaataatgttacttacattgaatccaaccaatcaacaaataactcatctttgcatagattagtcaataaactaagggacatctatctactctgccctacatactacacaagaatatcaacaaatatcgcctctgcactacagattacagctcttcttagaaagacaatgtcaatgccagtgttcttggtggctagctatctccaggatgctagctagtctgcaagatcgaagaggtcgtccatggagaagtcgatgcagctcgtgtcatcggtgctgacgtcgatgtagctgagcacctcgtcaatgctctccgggaaatccgaatcacaccacgccggcaccgcctcgccgtccatggaggaggaatacttctgcttgtccatgaggttcaccgccgctgctgcaccacctccggtgtcagcttgctctagtggcaggacgatcggttcggcgtgatcacggaacaccgtgtcgatcaacgggccggaggagctctgatcggcgccatcagcatccatcggcagaggatcgtgctgtggcggagaccccagctgctcgaacatggcggtctctgacacgccaccgtcgttgtcagtgtgggcgccggcagtgaagtcgatgtagctgagcgcctcatcagtgctctctggaaaatcgaaatcacaccacgcctgcgctgcctcgccgtccatggaggaggagtatttcagcttgtccgtgaggctcaccattgctgtggtagtctctgctccgcctccggtgtcagcttgctctggtggcaggacggtcatgtcggggagatcacggaacgccgggtcgatcacgccagagcagctctgatgatcggcgcaatcggcattgccaggagggagatccaccattgccacgggcgcgagcggaggctcctgctgctcgaacggggcgctctctgacatgggaggccagcgctgttgccaggagggctccatgccggcggtgaagtcgacgtagctgagtacctccggaaaattgaaatcacacaacgccatggagtagttctggttcaccactgctgcggatacggtggtctctgcctctccggcgtcggcttgctcacagaacgccggatcgatgacaccgtaggagctctgatgatcggcgcaatcagcattgccaggaggcccttgctgctcgaacagggcggtctctgacatgggagtgcagggcgtggcgcgttccatgccaccgtcatctggctcaggtggcaagacgatcaggtcagcaagatcgcggaacgccggatcgatgacaccgtaggagctctgatcgtcgccatctgctgctagcggaagaacgggctgctcggacatggcgtccgtgaggttcaccaccgctgcggtagtctctgtagtgtctccggcatcagcttgctccggcatcatgtcggggagatcgtggaacacaggctcgatcgcgccggagaagctctgaccagcggattcggcgcaatccacggcgctcggctgcacgaacagggcggtctctgtcacggcgcgccggggcgcggcgcgttgtccaccgtcgacgtcgtcgtcatggacgcgggcgcccaggcgttccggctcccgcttgcgcttcttgccgtggccgctgaaacggacgcggtaaagccggatcggccacgaggcgagatcatcgggcgccgtgatggcgtactcgtgcatcacccaccccgagctgcccctctccccctcggcgaagaagctcagcatgtacttccgccactcgatctccaacccgccgccgacttcgccgccgccgtcgccgcctgggacgctcagcctctcaccgtcgacgcaaacccgctgcccctgccagaaccccccaccctcgacggtacgcttctgccgcttccccttgacgttcttggcgcgcgcctcggcgaagaagaaggcctcgtcgccgccccggccgtgatcggcgaggagcatccatggcggcgcgccgaggggatccgcctcgtggatgacgccgtggagcgggatgggctgcttccggaggcgccggagcaggtagcgggagacgagctcgtcgtcggcggggtcgaacctgacgcccggcggaagcccatccgccgccgccgccatagccgcctcgatcgctcgaattctagggttttgggggtgaattctagggtttggggggaaaaggagggaaggaggcgaggagaggcggaagcgtgtgtaacggggctggatttgaatttatcagatggggtgacgtcagcgcgacgcgaggccagcgtttttctcacgcgcgcgccttctcctctgccgcgcgagcaacttcagggctcagtttgataaaatttgagcgatttggttttggaagaaagtttctaaaattcgagcagaggtttcaactatcgctgatgctatgctccatgcgccctgcaagtacttagtcctgaacttctgaagatttggtacatgtttctcaacttctgaaggattttgtccctgttctgatcttctgaaagtgaatttggataattgaacttctaaagacagtcaaattacaggagaaaaaacagagtattcctggagattttaacagagcatctcttgaagaataagtttgattttgagcgtgtgtttttttttaactaggactcccatttctcttactagaaatgagatagcgattacaaaggtctcgtaatattttgagcgtgtgttttcattcagtttcaaatatatgtcgtgatgatgtgatagatctgacgagaatagccttgctctcaacattgtcaatgtcccgctatttttacccttctcaggactaaaaagttcagaaatgaaaaccattcagagtcataagaattcagagaagttcagagacattttgtaagggacaatttcttatttgaccctgttttgaactgtaactgccaatttaaccatactttttgaagtttgcttatttgaccctcctttttgaaaacgaagctgccgtctgaccccccctttccactactccgttagggttgaataaaagaaaagaaaagaaaatgctactaatattcctaatgcccaaaataccctcagaaaccctatccatctctctcatgtgacactctctctctctcgttcgaatcgtgagtcggcggcgatctgctcctgcggcggcggtgatctgacggggcggtggaggagctcatctgaggggacggcggcggcgctcagagtgcgcttggaggagctccgaaggggcggcggtgggcgtcggcaagggggcgctcggccggcgtcgacgagggggctgcgagggggccgcgacgggcgtcggcagcggagggacgcggaaagagcgggtccgtgccggcaccggctcgtggagagaggaagcggcggcggcgcacggaggggacgaccggccgtgccggctcgtgggggacggtagcggcggcggcggaggggctcggagggagcggatccacgccggtgcagcctcgtggggggatagagcggcgacggcggcggaggggcatggagggagtaaatccgcggcggcgccacctcatgatgggagggatcgacggcggaggggcacggagcgagcggatcctggccggcgccacctcgtggagggagggagaggcgacgtgcgggagctcggcggaggaagctgcggcggcgtgcggaggaagttccggcggcggtgatgtggcggatccggcgacggttcgatggcgatgaggcggatctggcgatggctcgacggtggcggcggcggctgcgctgttcctcgatctggacgcggaggacgagttgcggtggcgatgctccttctcgcttcgaagaggacagagacgcggtctttcttgttccgaacaaggaggaagacgacacaaacgtgtgaataagaagggcacaaacgtcatttcttgtttaagttaacaccgttacgttgatttaatggaaggggatcagatctgatcttcagttttgaaaatgagggtcaaataagcaaacttgaaaaagtagggtcaaattggtagttagttaggttctaaaacagggtcaaaagcgcaattgcccctttctgtaacggagtgaaatctgcatgcatttcaccggtttagagatttcgattctgatggcctcatgggcactttacacataccagatgaaatgaagggcagagtctattagtgctcacttttctcatgttccttatcatatttcagctataagggtttgatatgttaatgcaatataatactacctcatatgtcattcctattgcccaacagaaaacctctatttacattaaaaatacaatcagctgtttatttgcaaaaactatcttgacacactattgcaagtcagacaagatcagcaactccaacgtgtttgcaagaatattatttatgattaataaagctctctctttcttattaaaaaaaatcttcgctcaatggaacaataaatttttgaaaaaaccttaagtattcgagaccattttcatcatatgcacttagccttccttttggagaaaagattttcttttcagttttgctatttcacttgcgacggatctttaggctcctgtctttcaatttttcttttgtaggatcttgtatcaagattcgtgttcacgtatattcaacttgcagttaaacatagttacagtgcaccaaaattagattttacaactgttgtctctagatttatgatttttttacatgtttgtccttttttatttgattcaaaatgggttgtatctattggttgaaaattctacaagatttgaagttccaaatccgtcgaaagatcatagtccatttttttcccctcaaaatcgttctccattcacatagaaaatcctccaaatatcaccctttccaaaggacgcttgctggtgccggcctacgttgttgaggcgcaggtggcaggagttagaaagggggcagaggggtatgtgtcgcgagaagaaaagagttctagggctgtgttcggttggtagtgttgggaactaatctctcacgcattaaaaatggagtgactcgttagcgcataattaattgagtattagctatttttttgaaaaatgtattaatatgattttttaaagcaactttagtatagattttttttaaaaaaaaatacatcgtttagtagtttaaaaagtgtgtacgtagaaaaggggctcgggactggtcgtgcccaggcttggccgggccgggctgcccatttggctacaatctcattctagaattgtgggcaacttgatccacgcaatgaaaccaaatcaacaccctctaggaagatggaagaatctgttggccctttggatcagacgacaccttgctgatcttgtctgacctgcaatagtgtatcaatatagcttttgcaaataaacagcagattgtatttttggtgtacagaaaagtttcctgttgtaaagcacaaaaggatatagttgcgcaataggaatgacatatgaggtagtattatttatattacggacctcttcactttgatgctaaaaaaaccttactaaaatttggcaatgccaaaattttggtaactataccaaaattttggcaggatttcttatatagttataaaaatttggtagcaactaaatgtagctatttttttggcaactttaccaaaatttgttaaggttgaaaatgacatcaaagtaaacaggccctacattaacatataaaatgcttatagctgaaaatatgataaggaacataagttttttgttgttgttgttgtcgtcgtcgtcgtcaagaagccttctttgaacttctctgaattctgatgtccttgaattgaaatcgccgaaccgatacaagtctgaaggcttcattccatttctgaacttctttgaattctgatgactcggaatgatttccatctcttaactttttggtcctgacaagggtaaaaatagcagaaggacactgacaatattgagaacaaggctattcttcgagagatgctctgtaaaaatcttcagcgatactctgtttttccccttccattgaattatcccaatataattaccgaagttgaggacttggataggataaaatcttcagaagttaaggaattggtacttgcaaggtgcaccgaagcatagcatcagcggtagttcaaatctctagtcgaattcagaaatgtctctgaacttctcttcgttaaaaacttacaatccctgcagacttcacttcattacagaaagacagaaatgtctctgaacttctcggaatgctgatgactctgagtggttgagatcagaagtacttcagacaatactctgtcccccctcttcttcaattaccctaattctactttcggtatccttcagaaagttcagaacatggacaaaatctccataagttcaggacttggtaaaaacagcagaaggacactgacaaacctattcttcaagagatgttctttaaaagtcttcagcaatagtatatactttttctcctgcaatttgactgtctacataagtactagcaacactcttgtcatccctccaattgaattgccccaatgtattactactattttcagaagtgcaggctgtacggagcttatcagcagcagcgatagttcaaaccactgcttcgattttagaaactaatcaaaacaagttccaattccaaaaccaaatcgcacagatttcatcaaacttccagaagaagaacacaaaaaatccgcaacccagactcaaatcccctcaaccgtcgctcgcgcgggagggggtaacacgcgcgcgtgagaaacacgctggcctcgcgtcacgctgacgtcatccccccatccgataaattcaaatccacagcaccgttgcacacgcttccgcctctcctcgcctcctcccttcctttcccccccaaaccctagaattcccccccacaaaaccctagaattcgcgcgatcgaggcggctatggcggcggccgcggatgggcttccgccgggcgtcaggttcgaccccgccgacgacgagctcgtctcccgctacctgctccggcgcctccggaagcagcccatcccgctccacggcgtcatccacgaggcggatcccctcggcgcgccgccatggatgctcctcgccgctcacggccggggcggcgacgaggccttcttcttcgccgaggcgcgcgccaagaacgtcagggggaagcggcagaagcgtaccgtcgagggtggggggttctggcaggggcagcgggtgtgcatcgacggcgagaggctgcgcgtccccggcgacggcggcggcggcgaagtcggcggggaattggagatcgagtggcggaagtacatgctgagcttcttcgccgagggggagaggggcagctcggggtgggtgatgcacgagtacgccatcacggcgcccgctgacctcgcctcgtcgccgatccggctttaccgcgtccggttcagcggccacggcaagaagcgcaagcgggagccggaacgcctgggcgcccgcgtccacgacgacgacgtcgacggtggagaacgcgccgcgccccggcgcgccgtggcagagaccgccctgttcgtgcagcagtcgagcgccgtggattgcgccgaatccgccgatcagagcttctccggcgtgatcgagcctgtgttccacgatctccccgacatgatgccagagcaagctgatgccggagacactgcagagactacagcagcggtggtgaacctcacggacgccatgaccgagcagcccgttcttccgctagcagcagatggcgacgatcagagctcctacggtgtcatcgatccggcgttccgcgatcttgctgacctgatggtcctgccacctgtgctcgcgcagcaggagcctccgctcgcgcccgtggcaatggtggatctccctcctggcaatgctgattgcgccgatcatcagagctgctctggcgtgatcgacccggcgttccgtgatctccccgacatgaccgtgctgccaccagagcaagctgacaccggaggcggagcagagactaccacagcaatggtgagcctcacggacaagctgaaatactcctcctccatggacggcgaggcagcgccggcgtggtgtgatttcgattttccagagagcactgatgaggtgctcagctacatgaacttcaccgccggtgcccacgacaacaatgacggcagtgtgggacgcgccgcgccatggcgtcccgtgtcagagatcgccatgttcgagcagccgagcgccgtggatctccctcctggcgatgctgattgcactgaatccgccgatcagagcttctccggcgtgatcgagccggtgttccatgatctccccgacatgatccgtgagcaagctgatgccggagacaccgcagagactactgcagcggtggtgaaccagaactactccatggcgttgtgtgatttcgacagcggcattgacttcaccgccggcgcccacgacagcggcatggaacgcgccacgccctggactcccatgtcagaggccgccctgttcgagcagcaagggcctccgctcgctcccgcggcagtggtggatctccctcctggcaatgctgattgtgccgatcatcagagctcctacggtgacatgatcgtcctgccatcagagcaagctggcgccggaggcggagcagagactaccgaggccctgttcgaccagcccgttccgccgcttgcagcagattgcgccaatcagggctcctacggcgtgatcgacccggtgttccgcgatctcgccgacttgatcgttctgccaccagagcaggccgacgccatggacggcgaggcggcgccggcgtggtgtgatttcgattttccggagaacattgatgaggcgctcagctacgtcgacttcaccgccggcgcccacgctgacaacgacggtggcgtgtcagagaccgccatgttcgagcagccggggtctccgccacagcacgatcctctgctgatggatgctgatggcgccgatcagagctcctcctccggcgcgctgatcgacacggtgttcggtgatcacgccgaaccgatcgtcctgccactggagcaagctgacaccggaggtggtgcagcagcggcggtgaaactcatggacaagcagaagtactcctcctcctccatggatggcgaggaggcgccggcgtggtgtgattcggatttcccggagagcattgacgaggtgctcagctatgtcgacttcagcaccgatggcgcgagctgcgacttctccatggacgagctcttcgatcttgcagattagttagcatcctggagatagcaagccaccaagaacactggcattgacattgtctttctaagaagagctgtaatcagtagcgcaaaggcgagatttgttgatattctggtgtaatctgtagactagaggcagagtagatagatgttccttagtttattgactaatctatgcatagatgagttatttgtttattgattgaactcaatgtaagtaacattattgtaagtaatgaatatactcccttttcaatcattatattccctattcaaaatcaatatactgcattgatctgccaaacatcttgagtggtgcacattcaatgaagttctttctttcagattcagtgaagtgctgattctttatgagtggagtcataaatatcccaaatatcccaagtaaacattcagttataactccggtgttgttctgacaacacctaatgttgtcagtatggatatagccagcatgttgtgatccttcaggttttgcataacatggatataatgaaataatccttcaagaattgacaacaggctccggaaacagcagtttcagattcaccatgagcaatgtttataagcatgcaccattcttactgaattattgactgaagtgattacatgcaacaaaaggctcacaatcactcatcacaagaccatcttgaccttagtggtgatatgtgatatgattctgacttctgggaatatagaacaaatattcgaatcacatccttttatttgcactgcaaatgtcacttataacacaacgaccacactagcagctgcaaaacagagctgtagttcccctaacttatgtcaggtaccaggatcaacacttacaattacatcttacattatatttgcatctactgaaatactgaaacgaagacatctatcatcctcaacaatttacaacaatttcgcaggttccaatgcaacaagagacagctatctctgcaaaacttgttaatgtcaagctgaagatatgacaatgccggaccattcactgtgccatcattttgtgaactcagtaggcctccaggtctcatctcctgaatcccaatctccacttctgcggaagtgttggatcttggatcatagatgcacagggttcctgtggatgggtgactttacattgtacaagggtacctgccaatctccagtcagcctcctgtctcttgccagcagcacttgtgccaactgccaagtgacttccaccaaatttagtatcatcatctcttgcaaactgaagtactacctacaattaaagaaacataaatgcaatctgagggtaacaaagtagatagaacaaagttattaactgaaaaaatctcaggcagaacatgaacaccaattagagtcacggttttccaacattatcagtaccaattagcacgagcagattcgtgtgtactgaagtaatccaaagatataaaattaaaaacgaaagagaagggattataaataagatatttctggtaaaggggagcatccatgccgaatttcattatatacttattcatgattcatcctttcctgtattaccaagaaacagaaagtctcatgacagtgagtttgcctaacctctgtagccacagaacatgccatccccaatttggtaggattactgggtcagaatcagtaacggaataacaccagtacaccacaccctcaatgaagcccattaggctatgcttccaaggctgcagttagctgttcacatgaagccaccaatacgtcatacgttagaggatatattagctacaaagcaatgataactcaaactggcccccacgaaactttgagtttcgcaagtttcaaattcaatgaagtatgatattcagcagtaggatcacaacgcattctgcatccaggaactaacaaacttttttccagtcgtttttgacctctgtgctcagcacatatggtgtgcctgatgtttcataaaccgtttgtccgtctcaatgcaatgatgcccaaatctgttgcttattcctgaaaaaaaaaagatgactatcatcccatgttctaataccagcaatacctttacattgtacaggggtacttcattcttcagtcttcagtgactgaagagtgaaaagcagcacttgtgccaagtgacctccacaaattttaatctcctcaccttttccaaactgaagcactatctacaattaaccaaacataaaaaatcaattcaatttgagggtaagaaagttggcactaaagaagtaattagttatctgaattctgaagaaactgggcattccaggcagaagctgccacacaccactagttcaatacaataatgataaaatcgccgtaattgtttttccaacattatcggtagtagttcggtaccagagacaatattgtagtaactttaaaatatgccaaattcaacagagagaatgggattatgcatttatgctcatgcctgagatgttattactgacagaaggggaattttagagtgaattgcaccttgagccacctttgattaccattgttacaatttggactaggttaaagccaaacttttcactttgggccagatatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccacgctcaagctcatgctcgacctccgctagtgctacatgttatgctgcacgcctgcgctaaatttccacatgtcgctcgagcttcaacaagttttgcagcgctcaagctccgccttcgtagtgccgcctgcatttgagctcgaaatcaactttggcgggtggctaccctgtgaagggttttgcttcttgccttttcatgcactacacctgatcgagaaagagaccttgagctgtacaaagaaaagagaggaagaaagggagctggaggaagaagaagagagtctaaattgaaactttgtgtaaacatacccggtccaaagtgaaaagtttactttttcactggtccaagttacaacacaggtaagaaaaaatagcccaagatgcaatttactcggaattttatctactgtacgagagaaggaaggaactagtgcatagcataatcagtaggggtgcgaggtctccgatgctaagccgagaccgaatcgaggggaaggctacatgggagagcgtcagggttggggggctgggggcattgcgcaacatcccgccggcttcccagtccgggttcgcgcccccacgggccacggcgtcggcggcgatggtagcggcggcgttgaacaatggatggaagagaaagagaccaagtaataccggattaggtggaaacggagggggagagtagtaggatgtgcaccggagttggagaccggcggcggcgcggcgatggctggagcacggcggtattggttggcttcggctcataataagccaaaaaaaataggagtataataataacgaggcaatggtaatttttatgtttcacctattggcggtttaaaagctaatattaaagaaaaaaaccattgaaaaagtgactaaaataaattaaaatgaattttgaaaatatttaattgtgtgtggtgtgtggggtggggggggagaaaaattatatgtttaagagtatttgtatactattttgcttcaaatccatccaaaattccaggcaataatcgtgatgatgaaatttaaataaatttgcctccaagatcgaacataccaaacggcagaatttcggtttttatttgattaccagtagtcatgcacgtgcaatgcgtgttttcatatatgttgtttcaaaaataaaaatactggattgttgcttcatttccatctctaatgagaattatagttacaaaagcgataaatttctcctaaacaactgaagtttacttcataaataaatgacaaataagggtctttatttgaaaacaataatttgagtatcaatcgttgtttacatatgaaagccatcacaagttcataaatctgtgaggtattagttactaaaggtatttttcacgttcatactgtcgtgtacttttaagcaacctaggaaacaaacagagcaatgacatgatccatttttcttgtgtgcttttcagggtagattctataattcagtgattcaaattccatcacaaccaactttcaggtttgaagcgtgattcagataataccatatacacgttaggaactccacaccatgttctaatattttcttctttagacaaacaaacacacgcaagttttaggtgaggtttttttctcctaaaaatgaagatgaatataaagattaagtttttgacataaaacaagatggtattaacgtatgattgattgagttttaattattacaaacgtaaaaaaatagattaatatgatattttagagcaactttcatatagaaaatttttgcacgaaaagcaccgtctagcggtttgaaaaacgtgccacgaaaatcttaatcttcattaaactcttgttggagaaaagaacgggacataattaatacctcaccaagaacacctgtagtttctgctacacaagcaggagcatgcttagcattatattatcaaacatgatgaagggctcactgctgtactgttgagctaccgtagagcactatacttagccatcttccagattttttgctactacaaatctgctatagcaaagcaagcataacttaaaaaaaaggggaaaaaaccatggtgctgtcaggatttctcaaatctcccaagagaacatccctgctttacccagatattttttttaactgataccggcaaaaaaaaaaaaaggagtaactgtagatatcctctcgccatagcaatctgcaacaaatatatttgctgtaagctcaaaaatgaacatctatctgctttcaaaagggaaaaaaaacagctaatgaaatataaaaaatctgcatatcctttcttttccctgatcagaatatttttcacaatgctctaccaatcccgactttctcattgccatttctgatggtgctatcaaatccacggttgctgtcatccatatcaagccacgcagtgctgacaaaggaaaagattaaaaaaaatagagtaaaatacaccagtggtccttaaacttgtcaggaggtttcacttgttgggatacgcgtaggctacgatagcataaatcaaaattttctatcgcgtaaaccaggaaccatgcaagtattagatcataaatcgttaccgctcgacgcgctgcgcagcggaagaagacgctgagaagtcgaaggaactctcacgaagtagcgcgcgtcgatatagaggaagtagtcaatcgcaccggctcgaccttctccttctcgtgcgttctcctcgccgtactcccacgctgatcaacaccgcaaaccagcggcgcctctaccggtatccacacgtatagggacagaacgctacgcgcagatgtgctagcacccgcgcgcggctagggttttgctcggggagggaagtgacggctagggtttctcacgtaatgcaatacctcctccggtcacacccctcacgaatatataggatcaatcactcgggcctcgaaggtccgtaggactcctatctgaattaagctcatattggatctctatacaatccccttattccggcccattaagcgtgcgaccctataggttcatatatactcgactgtaacccgaaaactccttttcggtccacgcgtcaacagcggcccctagcagaacgtattgacccaccgggcatacataaagatcatatcggctgaacctctagtgtatacttgtatgaacccctttgcctcacaatatcgattaagctcaaggctagatatgtgccattctctaatagctcaatcattcgctcgaacatgttgatagattatataacttgtgattgactcctcaatcacctttggcatggccatgcacttccataatctacatcatcgaggagcccagagatatctctccataggaggggcaaatcccatcttgattattcatatcccactacatgtttcatagcatacccgaaaactacttttataactacccaattatggagtagcgtttagcagtccctaagtaagctactacacatgttgagaaccatgataatctcaggtctaaggattcaacaccaacactcaatgagatcactgatgacacaacacatatggctcttgcaatgtctcatgttgggtctatccaacaacatgttcaccaacatgtgtccacattattaatttggtatctctataccatgatccatgagatatgattatcaattaatacatgtgctgatcatataaacatatttgttccacatatgatatttgatcagggatcctttaaaaatagtaataaacaacataaagagtctcatgaaataatcacatattcattaaccaataaggagttatctatttcaaggaacaatgtcggataaatatgtaaacatagtatgtgatacatatcatctctatgattgcctctagggcatatcactaacatcacttaggtccacaaacttgcatagtgcacatcgaagtccctaaacttggtttattgtatcatcccggtccaaagccacgtttgactgtggttgacatagaatttttttatattttttctcgcttcttccttcttttttctctttcttccttcttttttctcggtggtgagaggcagcacgaggtgaggggctgtcacagtggtgaagagagaaaaaaataaaaaaatttcatgtcatcgttcacgtcgcgtgccacgtaggcaagaccgcggtcaaacgcggctttgaaccgggatgatacaataaaccaagtttagggacctagatgcgcgctttgcaagttcatgtacctaaatgaaacctcccaacaagtttaaggaccgctggtgcattttactataaaaaaataagttgaatgaaggatactgtatctgagtgagcattccatcgagcaacttgtgtgcaacacacagagggacggagagtaccgtaagaacatgtggagaagaaatgggggaggaggcagtgttgaacattggcgggggcaggcacctcctcggagcatctccttctccgaggattcagcgagcttcagttgtgtgaaatcgtccatgaatatgcattcccaggttaatacatggccagagggagctgcgagagggagcgaaagcgaaaggagacgcaccagagaatctgatggctgtggaatgtttcttgaatctttcctgctaacaccgtgattttacgtattcgctatgcatttacgattagtcttgtgtttttttttaggagatcagatagcattgtcgtgtatgcttcgtgcatcaccaaactagtatcattgatatgtcacgtgcaattggagtaccgtcagatgtcctttaagcaggctaataaatagcgttcgtagcggccgctatagtggcagtggacctctaccgctaccgctacaatgtagcatactgcaaatagcgtattagaatttagcggccgctatagcacttcatgaccgctatagcagcccgctatagcgcttcacgactgctatagcagcccgctattgattttgttggattgctataatgattaaacggtgtgcttcacatatggatagaataacttagcattgtataccttcttttatcttatatatttatatgttactagaaaagttgcccgtgcgttgcaacgggtgaaggtatgcggtcggtagtacattaaggtgaaatttactgtgggaattcacttggatatacatatatttttagaaaatcatgagtgcagttaggagtccgatagtctaaagttaccatgtgagtttttttagtgagatgtcatatacgacgacttctatatttccaaaagcgaaataacttaaaaactaactcaaatacggatatgtattatttccaaagcgaatgaacttaaaatccgactcatacatggataacatacttaaataccgacaaaaacatcttcaatttttataatagtagagatttcataatttttatgttatgaaatgtaggagtaattaaacatgcagtctaaattttaaattttaagtgaaacttgatgttaatattgatatacaatcttaatttatggtcatttttcttaattctgttattgaaacttagcgtctgcaatagcgcctgctctccacaatccgctacctagacactaatccgctagcgactcgctatatgctatttattactttgccttcatgtgaaatcgctgaaccacaacgatgcctacacacttcgctctgttgaggaaatgtttctaaaatatctatctatttttttttaacgatcagcaccaccagacagcacaatggttcattgaatagagtagggaaaacccctgaaaagcagtagccaagaaataaaaaaaaaaccactaccacgcatcggcaatacctacacacagccaagagaagattagcactgtacccgctgccgctaagcgtgaccggttaccactagaccaacaaggaagctacatcgagacctcctaacaccaagccatacgcagccaagcaccgaactcaactctagccatacctttgagattgagggggagagagtgacagaaaagaatggatcattctttcctctaaggccagccaacatggccaacttgcaaaaggtaggattgcgccacaagaggacaagatatcttcagaaagcttgcaccagctgtctgagagaatttttggcaaaaggacctcctagatgacatctccacggagaagagcgacgatgagcaatgacaccgctgtccgtcaagatctcggggagaaccaagacagggtttacactcagtagccccaccaaaagaaaggggacgactcgataatgccccaaagaggaaaaacgcgcttgaaacgcagttgttgctagtctggcaagactgagctaggtttacacccgcctcccgcctcccgccccctagtcgatccacagctaatgctccattgctccaccttcggctatcctccgtcagtgcgtggacactgctgcaccgagacccccgaccagcctccgcatgcttccacgtggcctctcgcggacagccgccgccagttgagcatcctcgcaccgcgccggctgtccccctgtagtgccaatgctactcggcgccacgtctgctcccgccgcaattaggccccaccaccaccatgttggatcgccgccctgctttccatcggtgaggtgggggaaggggggaaaggggtggcagcagggctaggtttcgcctcctgtgccgcccgcgcgtggtgacacagggtgggagcaggtctagctgtctgcttgtatacagattgaagcttgttcccatctctgaattctgatctgaatgatttctgtttctgaactttgggtccttcaaaaaagataaggtaaatgtaagtatgaactttgggtcctttaacaagggtataagacaggaggagcagatcatcgggagacagcagaaaaaggataaaggtaaatgtgagtatggcattaataagtggcatgacagcaatttcagcagttcgtatacatggtaaattgttgacagaaaacagtaaactctaatcatccaaaaagacatgtcgcagtatatatatacctcactctccataagaacatatctcacaagctaaatgttcagggtaaccacctgaacagcgttatccttgtcaacaacaaacgatctggttacctttcctgaaggcgttgctacttctaccgtgtatgacccatggtagcctctgaacttcaactctccatggtgatccacgttgccagtaatgctggttagccactcttgcttcagtgcaatgtaccttttgccagcctcattgatcgttccatcaacatcaaccaggtgagcgtgttctcggaacatgaacagctcccagaatccccaaaggataatcccctccacggaaggatgcgcaaaggcttcgcgaaggtacacctccagatcatcggctcggatgtgttcattctcagccgtgacatccaattcggtgatccagatagggagacccagtatggagagcttgtccagggaatcgcagatgatgtcacccactggatgcgtgatatgaccttgcaagccaatcccaccaactggagcacccctttcttggagatcaacaatctgttcaattaatttttctggtgtagattttgagtcgcatcgatcttcaacattgtagtcgttcacaaagagtactgctgaagggtcaagtttatgtgcttccctaaacatgtgagctctaatatcatttcccagtctatcttggtagaaagacccatgaagcatctcgttgtttacatcatgatgtttaaactgacctttgtaccttgacaacagactttgcaaacgattctgtatagcagccatcaggtggtgaccatgtaatgatcgaatccatggctggactgaatcttctacttcccagaataagcagtgaccacgaacttgaatgttatgtttccggcaaaattcaagcaactcatcagaatctttataatttagtctcccttgttcagcctctgtccagtaccacttcagttcattttcaaatacagcccaattaaagttcttcatgaagaaatcagcaagatcctcattctcaatgttacttctccctatgcatgatccaaatggaaaactgttctcggtctgttgtatcttgatagatgaaccaaaaaggtttgcagcatctgatccctggaacttcaggatgacatcacgcttccttacctatttgggaaaaagaaggaaatgtaacttcaatgttgcccacaatcactattataagcaaagcaatggatactttatagaataaaattttggtctaaaattgccatgaagaaaataaagattcttttcaagcttctgcagacataaatttatcatcttaacatacaaaagaagtaaggaaagtttaccttgtcagttttctccttcagatattcaaaacgtgcttttctatcaacagcataaatttggaaccccataactctgagatcaacacctggaggcggtccctgaacatatgcagtaactttggatggcttcttttcaagcttgaatgctcctttgagttcataccattgatcgccatcagcttctacttgcccaccattaacccactgatgatctacagcaagacaaacatttacatggtaacgtccatgtcctccagacccagcacgtacccaagcagaaactctgtaagtggtgtgcagcctaagcttgtcagttatcaactgggaagggcccatccacacatcagtgcggtttgtggcaagaatataagaacctcttatatgttgcttagctgaggggtccttcaagatggcagaaagcatatggggtgattcagtatggatactcaatcgacatgaccccatgggactccacccagaaagcccatgactgaaagcactgttatgtattacattagctccatatgaaacattctgcagtataaagaaattatccttgattcagaattggtgttcaaaatttcactgtccatcatcatgatttgataaacttctaaacatgtatcaagatcatttaaataagaatgttagtcagaaggaattagtttaaacctcaattcttgggcggggtgcagcatggagttttcttgctggagataggacaaggccatcaacaagaatatcaatgcctgcaggtggcccctctacgaaaataacagcttttgaaaacggggcatggaggaggaactttccttttagatgtgtccattgcttatcagatgccgggttcctttgtatacaagaatatgttagtaaaccagtctatgtttacaaaaataacgctgccacttgtcacagaaagtgtaaccaatgaaataagcatatacttactttgcaaggcttacatatcgctcacggccatattcttgtacccacagagtaacgcagacttctgtatcattggcactcccaaatatgcggacagcagaacttatctcataaagaacttttctctgtaccctgccagtgatatcttgctggataccgttccaattgtggacccgtccagtggctgaagcaaaatagctgccatttagaggcttgacatttccataagcagtaagctcatgcctacagatattgcatcctcttccagaccaattgtttaacccttcgtcaaagtgaggattcttaacgatggtatcaactccacttggtacttttacttcctttggaaagaaagattaagaagtaataagcatcggctaaaaaggcaatgtttgtattatatagcaggaaaagcatgaatgaacatatgatgagataaatccactgaaggtagaagcagacatatttaaatttgtaaaaaaaatcaactatgtgttacccctttgcactaaaaaacctatttgggaatacattaggtcagaaaaatagcaatggttcaaaacataaattttggctaagaagaattttagcactctacattcaataatcagtaaattcaagctagttgctcagcctcctaattatacttccgagaaacatgtatcacgccaagattcacatgaagaaaaagttaataacgtttcttagaaaaaggttaaagcaaatgctggtggaaaagcactcacttttaactgctgatatccagagcaagttacatttacggaatcaatgataaggtccacgccagcaggaggtccttccaggtagaatactacacgttttggcatatttgtcaagcaaaaggatccttccatcttctcccacttttcttttgaagctaacaggctattaaatcaagaagggaaaaattagaggagaggtgagaaaaaatttgatcgttgaacaacttttatgaaatgtaccttccaactggactgtagtgcgttgaatcatctgtgttatgcaacctcaaggttgctttaacttcaactttcgtatggatattcccatcaactctaacataggctgatactgcataagcagtaccagcagatactttatctgtaatatcttgttcaagaccttgccagctttcagttctcttcgaaactacagcataattttctcctgagctccctctaataccatcaaggaaaccagaccattgagatgccacatatgcatgacagcagatagggttccacaaatgaaggccttccgaaaaatcataatttgaaatgatgttttctgttccactaaccagtttggatgcagcccgctctgttttctacagaaactctgaagtagttagaaaatggtagcttagagtaacaaatccaatcgaataatacaatgtcaacctttaagcaccactgatagcttgatggggaaaaaaacatgacatgtctcaactacgcatagcaaaaactgtagtagtatgtactggcatgttaagaaaaatatatcatgatcacaattagtcttagtgtatgatttttcctcttctttgctatgactactgagaaatatggtgtggacatattaagacagcattaaatcagacttttagagcatgattcatatatcacaagattgctctgacatgaacataagcaaagagatttaaaagcataccttgtaggagatggtgactgaatctatgagcaagtctacaccaggaggggggccttcaatgtagaataccaaacgtcttggtagagtttttagttcaaatgaaccttccaacttctcccaacagtcttttgatgctgagatcctggtaaaacaacttcaactgataaatccatgatggtgtataatattctataaaatcaccttccagttaaaataccttgcaactgattgatagttcgtagaagaaccatcgccctcaagttttagagtggcctgaattccaacaggctcattgagttcaccatggactctgacatgggcagcaacaatgtactcagtaccaacagtgaccttttctgttatgtcctgctcaagcccttgccaattatgtgtgcgacgagtaagtacggcataatttgaccctgagtgaggccttattccatgatgataacctgatccttcaacagccacaaatccatggcaaccattaggatgccacaaatgtagaccttccgaaaaatcattgtttgacagaatgttctccatgacaactttatcggaagcgccgtgctcctctacttcctgctcaacattgtatgataaataaatttctgcattgctagtccatgtcattgggagaggaactgaaattcatggacagctaacatcctatcacacatgtagattgttagggactcgtggaactataggtctcaaaccatattagtgtgtatcactggatctgtatgttttttagtggtatctagttcatcctttcctacaatgtcaaactctacaactatacatatcttgcattccaaccttgaaatttaactcttaggactatatatcttgcaaacaatcaaaattccaaccatgaaattaaaagataattccatttcttattggtaggatctccaccaccatttttcatcaatcacactgtaaacacgccctgactaaacattccttgcgccctttgcggttggtacgcagtcaatcagcaagggatggcaccaccaagcaaaactatcctggatccttccaggtcagagaactagcaaaactcatttacccttggaagttggaaagaaacaaaggcactagctagtagctacggatgatatatagataccttggactcgagacgcggtggatctggctgcgggagcggggccgccgccgcgcgtccaccccggcgagggcggcacagggaggagaggcacccccagcgcctcctcatctcatctcatctcaaatccggcagcggctgaggaggaggagcaagaacctgccggtgggtggactactgcctaccgggctcgctggcaaccaagaattaaaccccaaggaaatgaacagaaagaaaggcgcgtgagaaagccggtggtttaccttcacctaaccaccgaccaccgaggcccagcttgaggaggaagggaagcatacagagagagacagcagagacggcgctgtccgcagcttggtcggtcggttgcgttgtccacgggggggaaacccgacgtgcgcggagaggggaataggatcagatgccaaggagacgaacgcggcaacgcgaaaccgctggcgacgagggaatcgaagaatctctcctctgcggcataacgccgaacaccccgtgggcacccaagccagtcaaaataggagcgagagagagagagagagagagtctcgcgagtggggtttacctcgcggagaagaccggcggccggcggggagtggcggggtggggaggagaagctgaggcgtcgacgtgtagacgacgtgaaggctgtctgtccgacgccggggaacgcgaaccgatcgaatcggaagcgtcgcgactcgccgaggtgggggaggtgcgtaaattggaccgtggagtgagtggagtggagttgaccatcccttttttgttttccatggacctgacacgtagtactaccacctttccttctttctgagcaaaatgtgttcctgtgcaaagtaccggcaaaaggtacagacctgtacgtgttcatggcgatttggtcggtccggcgagctttaacttttaagcacactctccatcgttgacggatcagaaaatcgattatgtcataacgtatctatcggtatcatagtatactaaattactaattatacttagatcatagtgttataacatatggataaacagttttgctataggttttaccgaaaatcgtcgatgtcacctgacaccggtccttctactgtagattcgcccttgccctccgtcccagaagggacgtcgctttatcaggtagaaaatgtcccaaaaaatttaacgcttaaactctcctgtcatcaaaaatactaatgcaaaaatgtacttgaaataaaacgcataggagtggagttgtctagtatactttcgaatgtttctgctccacgcgaattttcctcccaagcactaccttatcctctcttgttttctcttcttccccatttctcatctatcgtgttcttgttcttttacagtttctatgttaaagatcaaaagctttctcaaggtgagatcaaaaggatgtatagccccagcatgccttccttcttcctctatattgacttgtgttttactaaggtcaggtaaaccccatccatcttcctcttcatgtgctagtttgtttaaatctaccgtcattgtgatatgtggacatggagttgctttacaggttgatgaatggaatggcaagcggctggttgactgcctccttaaggatttgtagggaatagaggggcacccattggcggcaaaagtagcatccaccatgtattttgaattcatgggtctgctggataattgtgccccatgtaatgggagtgtttttgccgctagtgaactcaaaataggtgtatgttttgctgccttattgtcgggacaaatcattcattagttaattgtagacatgaaatattccttgtatgacaggagtggcatgtgtactctttggtttgaaataattaactgtaagtaatagattgggagcaacatggtcattttcacctaaacataatttgcttcaaccatcctaggacgtcaaacatagtggaacagagggagtatattgcaccttatctatacatattatgcaacttaatttcccacagcaacgtgatagggtattcatctacttagaaaagaaaaggagcatgctgcataaatagcggcaagaaaaaagaatcttatataagaaatctagctatcttagtaaaacattttttttctatttataagttagcaagttaaaattggttagaggtgttgttttatgaacttatattaccaaaattgtctggtgtatcacgtgcaaaaaaatatggttttatgcaatttaattataacacgcagtaggagcctcctactattttcccgtaaaaaaataactataacacctgggattttatgtgatccactctgtttcaaggctaatctctaatatgaaactttcacatcttaaattcttctatgaaaacatatttacaagggaattcttgctaaaattttaaaatggaccaatatgttactactccacgcgtttcatattataagttatttgattttttttagtaaaacttctttaagtttgaccaaatttataaaaaatataataacattttcaatacaaaatatacattcataaaaatatattcaatgttaaattcaataaaactaatttggtattgtagacgttgctaattttttctataaatttaatcaaatctaaagaactttgagtaaaagaaaaagtcaaatgacttctaataagaaacttgggagtaacatttaactgtatggcatcaacatataacatattagtgccaatcccatgaactggaccggctaaggctctgtgcaagagttggttccctacccaaacatccctacccaaacagtacgcacgaaatacggaacggtctattaacatatgattaattaagtatttgctattttttttaaaaaatagatcaatatgttttttaagcaactttcatgtagaaactttacgtaaaaaacacaccgtttagcagcttgaaaagctacgtgcggaaagttgggaacaactattgcgaatagagtctaaatcctcttcaatggaacccatcggtgtgtagtggtacggattggagtaaggttgtcgccaatataacttcaacgttggctcattgccactgtttgtcaaatctgtttaatcccggtcacaataagctctctctgaagtgacaaaaaattaaattattcctcattagaatatttttttctaagaatataccactattttgtagaacaattttgataaaagtaccaattactgcatccgctttcataaattcttgacgtttctccattgtacacttctacttatattatactttttaagataaatcttatattgttttaatgattttaaactaaatattttttaaagttttggtagttcaaattataaaagtttaatctcaacagagattagaatcggagggggtacaaaatttgcagccgtagtaacagagattagaaggaaaaataataaaaacaacagtctgtcaagtacacgcctgccttgccggttgcccctcgccggcggcctcgtagccggagcccgtcctctccgccgcgcccgcgtctgccggcttgctggcgagctcgcgggccattgccggagcccgtcgcattgaccgaatcgcggggcaaaaccaccaccatccgcgccattgcttccgagcggcgggaaaggatcgaggatccccttccttctgcatattgcgttgcttgcttgcatcattctccaccgccaccgccgctgctgccccccgcctttttctcttcccttttgccgccgaggcgcggtgcgggccaccgccacgtgatggaatggaagaggagcataccgccgcctcaggtttttgcttcttcccccgcgcgccatcttggtgcggacggcgggagattctctgcgcaccctatcgccgcctgcggaagcaatctgactgggctatgcccatcatgtgttcgacggagtgccgcaacggcaagaaaccttaagacttcgtttttattatatctcccctaggacagaggcggaggaggatcaggattggttatacatcaggccgtaccacgcccttgtattcaaaactttaggtatgttcatcgattcatgcccccaacagccttcattttcctctagtccgtgttcttgttccgttcatgctgccggaatctcacagctcgacaaaccggtgtcccaactgtcctgtttgctggttcttggcacttcaaacttagcgcaaacatgatgtatcatgtatgtatcgatacatagtagctctgggtttagcggaattgtatgtacatgctcatcaaggggatgtttttggttgctagtcagtaatcaccaagtcacacctacaatttttctctctcacttgcattgttgccttaaattgtagccacgccaataagcatcaggagaaccttgcagaagtggagtcgtgtgcaaaattatgacattatttgtggtgcggcccagattaatatttaaataaaaggaagcctcacttacaaagagtaaaaaaatgaaatgtatatctaatcatttattgttgtgcttgtatctgctacctatttttacattcaggttaggggaccttgcagggcaaacagagatcactgcaatgacattggatttcttcttagtgcgcttgaatcttactttccaaacatttgctgcctataattacaagcctataataacttgtctagtcaatagctagcattgtagtaattgggtatcttcatcatttgtcctaaaaaagttacttatcgaaatcttccgtcatcatccacccttttataattaaataagtattctccacgaaaacagtgtgtctcactcttttatgagggctggctatcataatgttaggactaactttactaactttccaattgaagcttagtggtttctccggcaagttgacaagaaaaactgatcatatcaaagatgagcttcaaatctattgaccggttaattaggaggaacagtaagaccaaactttctcggaatattgttgatggtatttatgaccagaaggaagagcaatatgtgcaatccttgagggagttgcttcttgcaaacaaccagcttcccgagaagtttgatgactatcatgtcctactacggtatgcaaatttgtttcctatccagaaactttgtcgtgtacacagttactgcactagagttatccatctttgtaactaaaagaagatattttacacctccattctcttagctctgatgtattctgctttttcattgaggatgagctttatctgattgctttcttcatcatgcagctttctgaaaatgagaggatttaacatagtaaaggcaaaagaaatgtttttaaatatgctaaaatggcgtgaagaatgtgctgttgatgccattgcaaaggtacgatgtgcttagtgttttttatttttctgtacaggtaaaggttgtccaagactgatgcttaaaatattcctgtatccttctactttgttatccatgaaaattgaatcatggaatgccacgatattatgtaatattgttgaaatattaagagtaaatgatttttctatgttacaggattttaaatttgaagagtacgatgctgtaaaaagatgctatcctcatggatttcatggagttgatagatttggcaggccattgtatatcgaaaggattggcttggttgatctcaataagctcatgcaagtatctagcactgatcgatatgtaaagtatcatatatcagaacaagagaaaactttatccttgagatatccagcttgctcccttgtggctaagaagcacataggctctacaacagccatatttgatgtgaaaggattggtacgttattgctacacgaagtactttccacctactattctacattaatacaattgacagaactaccatttcttattctgtaaaactgaggaccaaatatgtcttgaaagcagaattgcaatggttgcactgtaccttggtccttccttaaggccattgctgtacgacttgtaaggttgtatttcaattacacattcatagctggaatagaaattcacattcatggaacaataatatttgcagggaacttccatacatctaatctgtttgtttgaagtgctctcattggcatatgttgaagttatgtttttactgtactaagttcattgtctttactccaaattcagggtatgaataacttttcaaaatctggaagggacctgttcatagagattcaaaagatagacagcaattactatccagaggtttgtatgccatgtctaaacttcaacgtcttatctgtctcttatgatattataagtgaaagttttagacaatatgcatgcaggagttagttcaatatatccagatgttcatggttattatttgcaaaatgtgatattgctttgtaaattactcttccctcttatataacagtataaaattatatgtaggggactccactaatgttctttggttaaaaaaaaaagtaatattgctatatctttcagttcaaacaaataaatgtaaacaaaacacactgataaggttggtcaataacatgtctgatagagcagaaataatacccactatatatgtcctctagcacccgtgtgctctgctacagtgtgaattctagaataagaaatgacaaagttattgcatatgttcaaagccattaatcactcctgtttggctatatggtgtcatgtatcaacgtagtaaggaatttcattggagacatttttgtaccttcactttcatcatatagctactgatctattttcttgcctcacagcagtcagtagtttccactctctatttatgtggtcttgcttctgatacagacattaaatcaattatacataatcaatgctggtgctggatttagagcactgtggaaagtattaaaagcatgcatggaggcaagaactttagcaaagattcaggtactgcatgtctgcatgccctttcttcatgtgctacttattgttggacaaatagattgaatatttttttctcacttatatccttcttgttaggttttagggaccaattatcttagtacaatactagaagcagttgacccaaggtaaaatgcttaaaattttaagcaaaatttgcgtatatcacagattgaatgtttgctcctttctgcagtaatttaccagacttcttagggggaacatgtacttgttctgcaactggaggatgcttgctccaagataaaggaccttggactgaccaggaaatttctcaagcttctaaggtgaggtatggtgcttctttttatagttctttgaatttttttggggcgctgaaactgcaagaagtatatcattttgattcctgaagcatatttttttttcctagggagtgtttggtaaaggtcagaaatctttcgatgagataagtactacagttgcctgcgaaaactttccaggtcaccaggtattaagggttgagatgcccagttcttgttgtcttttgcacgttggctttagcagggtgtgtcctatttgtgtttggtcggcactcactagtatggcactgctatgctttgcagtttttcctttttatggattaaacatttcaggtttattcgattattaatctctaattttatataatatatctattggccaattttgttgtaataaattggcagcctgtctgtgggatttgtgtgctaagtgtccacctaaaataggacagtttagggagaaaaataaaattcatcacttctcattttatctacccatgtcatcttcatttggttctttcttgttttcatttctaaatgccataccgaaagaaaaataaacatattatttttgttaacaggagctttctttccttagttctgtcatgactctgcactatgtctctctcttctccgccattcctgttgtaaaggaacagttatgtattcttgatatttaattgcaggagccttctgtaggaaaattgcatcccatttctggctggaaacgtactcttggcatgttgttgaaggataaccaggtctgatgttttcctttcccttcattgatttttgtttctgtactaatagaattcaatcaatactttgaacgctgcaactgataaaatatcacaagttttttctgctatgatttgactgtgtatgcatttcaacttagtagtttaacggtttaaccagatggtccaactcttccttgggcaaggagaattcgacagttgacgattttttgataaacttctatggaacaggttggcgatacgaatgaaaatattcaacagaataaagtgaatgaacaaatctcagagaagatccaagaacttgaaaattgctctgctcagacccaggaggtgagcaaaggtactctcagcttaaaatattgcaacccacatgatcttcaacagtagctgaatggcaatattgttgttatgttgtatgttcagacccttcacgcactactacagaagcagaatgagcttgcgaaccacattgaacagttgaggaagctcctccggtgagaatctgacatctacttttgttcttttctctaattacagcatatgggatattaaaatgtactaagtatctgctatttttttcaacacagggaggccgcaaatgcagacaacaaagcaaacgtcctaatcttgaagtgaaattgcgtgctttccagcaggaagtgaaacgagaaaatttgaaccagcatcgcatggtagaaatattgcagcatggtagaaaagaaatacagcaatagacacgtcgatagttctcagtaatgattccttaatcgttagtcccttggctggtaatctaacacgaagcaaattaagaaagcaaccgtacaccatgatgatttcaaaacgcaatgcaacttctttgtacacatgctgcgttctgttgtacatttgtaacgcatcttttcagaagggaaaatgttgtatgtaccacatcctttcaaaaggaaaaaatgttgtatgtgttacttatgaaactacttctccatctcctgctaagtcacttaatgagcgcgaaagacctacccattacaacagcatctaacactctgaggatatattagtaaaatcaaaacgaacaagtatagtaatgttgtacaatcaattgaacccccaaacacaacccagccaaaaaaatataggcctatacctgacattggcaagaaaactcagctccgactccccactctctttgtgatgggtcaagctttttcaagtattttttttaattttggggggtttccgtccgcaaaatgtgagctcgagcccaacctgctgcattgtcaagtgatcaagtcggatggggccgagtttgaacaggcctagctacaacaaagataaattgctgttgcaacattcccctaacaagttcgcaacagtaggaaaaataaacgaacaatatcaattatgtaaaaaatttaggaacggaaaggaagtggtggacaacaacgatggtaacaagaagcggcacggtattaacatcaaactagtaggatgagagatgcatgtgttacagttctgtgagcaagtagcatcatggtaggcggagccctaaaaaacaatattgaccattatcataaggcttaatcttttggtgtcacttgctgtaaattaggatgagctaactgtaataggcccgtggtcgttgggattgggagtagagccatgctagccttgtttctagtaggaggaagaggcgatcgattctagatgtaccttaacaatgccatgtttgacccaagcaatagggagtgcagctggagtgggagagagatatatggagcatctaagggaacgtttgattcttttgaacaacttgcttagctaggcaatagcatactagctcacctaggctatagccacaggagcaagctatctagttggttgttttgctaggcttaacgtttgttcgctattacatgggcctcaatgcctgagtcctatgcttgccgttggaggacagccaattatgttctcctccctaggcaaggactttcttgccttaagtgacttctctcacctagcaaagctagaaattttattgctctaccaacatcaaacctggttgagcaaggctagaaataatctagcctcggatccaaacgtaccctggacaaagaaaatgatgggaacgcaaaaacgctaaatgaaacttgtggacaaagaaaatgatgggaacgcaaaaacgcaaaatgaaacttgtggacaaagaaaagaatgggaacgtaaaaacgagtgacagtaatagctaagaggagcccacatgtggaggatctgacgtgcagagatgcatcagacatctgatttgtcgtatttgtggtggattttacttctagctatatatggatatcagcaatgccatgcatcacccatgcaacggacgtaaagtttaagtgatatctgtgtgcataagtaaatatatatgtaagggaaagaaattagatagtagcattaaagtgatactggtttatacggataatataaacaaaaatttggttgagaaaaaaattaatacggatatcgatgtggagcttcgaagaggagagaggcattcgatgtccaagtacatatatgggtaccatataaatcacccatcaatattaaaattccaacataaaagttttgagattgggatatacttagaaaaaaaatacagttttcacaaaaatcaccaaattacccttttaaaagaggggcagcctaaccaggttagggttctctatttacatctcccaagtcccaaccggatcgaaccaaaatcccaaaaccgaagggaaacatagcagccggctaaggtttctcccccctgccgcgccgcgccgcctccctccaacgccatggatgcgcagcgagctctcctcgacgagctcatgggcacaggtacacccacccacccagtctccccctcccgcggaaaccctaaccctagcctgaccgctcccttttctcctctgcgcagcccgcgacctgacggaggaggagaggaaggcgcacaaggaggtgaggtgggacgacccggacgtgtgcgccgccttcatggcccgcttctgcccccacgacctcttcgtcaacaccaagagcaacctcggtataatccccaaccccttttggctcggtttccgtcttctggttggatcgattttgcgtggtttcgtggttcggccggtgtgttgtgttgtgttttggttgcttgatttgttgttcggttttggtgattgcagggccgtgcatgaagatccatgatctgaagcttaaggagaggtaaggcccgattctcgcccccctcagaattatctaggttttggtgctaaacctgcgcccattagtatgggggaaaggtgattattgttatgagaaaaaaaatggtaccataatgtatgcttacacctaaatggtatagataattgatgcttttgcgctataagatgttatttatatcattgcgcgactaggttttgtttagtattgaggaatgaggatttcggccttccgcgtttccgttgagctggtatgttgtactttcagtttccctgcatgtttcctgttgtgatttcttcatgcaccttgctattgagaactaagatgctggattacttgcatcacaccatgtcttgtatgtgaatactgatgccacggcactctacgtagtgtctgaagaagcatccagttccagatgtattacacataagaagctttacatcttaaaagatgtgttctcaataaaaacaacatggcagaaaaaaaatcttgtaattttgggagaaacttgttcagctgatagaaatgcaaggttaaatgcatattgagaagagcaatgtaggaatatacctatacatcttacagcagctaattttgttaactaattcataggtggaacactaatttcttttgggcagagggagtctgtgcatgccgcttctcaacaactttgatgcataggaatggatattctactttttcctgcatataactttgactttcgtactactgtacaaaagagttctttaacaagttacgttatatggacatgttcttgttttaagtttgtgcatgggcttttattcgttaatgtgaccgcatagttcgaattaagtggaaatcaggacgtttagaagtgctatctgtgactgtggaaatcaggatcgcttaattgttgccgctagttccggaccaacctagttttatcttatacgtttttgaagatcctttattaagatatatctgcaggatacacacaataattgtccagaatgagcataatttgtttatggggaatattgttcgtgtaggtcagtgcagggaatattgtttcctatgcagtcacataagcatcacatggcgagggtgaaagggatataccttttctcaatcagacataaacaaattattttggaatgacatcattggtttgcaacatgtactagatgcacccagcctgcttgcgtcgttatgaatattgggatgagggttatcaaagttattttggtcaataacattaaatgtatgctgtattacgcccaatttatgacttcttttaatagaatatgttgaaccaagaacatctttttgactgctggtctgtccctttatatatagggaggactgacttgacatccaaggaactaatctgtaacattataggaaaccagtccacatctctacctctaatttactatcggaacttatctgtttattcctaatctgccttgcctaacctgccaaatgggtcttgcgcattcccataacctattttgaataatcagtccagctcagttgttctgtcgtgtacctatctgatatagggagagcaatttatgcatttaatttttttttctctgggcaagtgcagctttgagagttctcccaggcgtgaaactcacatgcgaaggtttgaggcggaacttgctcaacaatgtgagaaactggtaagttgtagttgcagacttgctttgcaaattccgataactagagtatttaatatcttttttctattgcaggttatagatttggatagaaaaataaggcgtggtcgagaaaggttggctcaagatgttgctgtgccacctcccgtcatagggaaaacatctgagcagctttcaattatagaagaaaaggtcaagaagctgttggagcaaattgaggagcttggtgaagctggtaaagtagatgaagctgaggcacttatgaggaaggtactgtcattaaagatccattttgattgtgtacttctgtcaaatgcttcttcactaactggtgtacctgtctctttatttttggattgcaggttgaacttctaaatgctgagaagacagctttaacgaatcaagcagataataaagtggctatgcttccacaagagaagaagatggaactttgtgaaatatgtggatcattcttagttgcagatgatgttcttgagaggacacaatcccatgtgactgggaaacaacatattggctatggtttggtcagagattttctagctgaacacaaggtgaagtatcatttcaatagaagtactaatgtttatatttgtatgtttactaattggaggctcctctagaagtctccatattagaatatgtgatttttgccgctttttttgtcagaatatgctcctagaaataataaaactattattctttgatattttctgatttgagaaaattctatctgtagcacaaatatttggccactaccaataagtactgcaaaactattccaccttcactgtataccataatgtggcccaattccttccaaaaatgcagcataactggatggaagtggactgggatgatgttgctacttctcgggacggaaattgcggctgatgcatggggttgccagggcaatttcgtcttttgagaagaagcgccgtctgtctctgttgactttgatccaattttgtggtacatttggaaggtgcagttatcttgcggtatttattggtacaagccaaattgttgtg

SEQ ID NO: 9063 - DNA, 1465 bp, Oryza sativa
gattttagcccaattcaatttaaaaatcaattctaaattttgtaggttgtttgtatgatagaaattggatgagattagaatttggaaggaatttgaatagggaattttgaaaggaaattatatttggatataatttccaaaagagatattttctagtttgagtgcaatattttgagagataaaatataaggaaatttatttgatgcactccaatgagagggagagaaaataaatggaggaagatagataggatttttagcctcaaaatatatggcatgggtttcaaaaaatggttgaggctaataggagatttggatgacaaggatataatctattatcttagcacaagaacaattattcacaatgtttgtagtaatattattcttgtgccgagaaggaaatcaagccacaggaattagatcagcagctagatcaaaaggaagaatttggatcaagaatcaaaggatatgtttaagatcaaaggatgggctaacaaataatcccactaaaattggaattactttggtttaggttcaatggcaaaattgggaaggtttcttggaccataatccataaaaatagaaaggggtttttcaaactaaatttgaataaaagagttttagtcgaaagaaggttttaaattaaaaccaaatcaagaaatacctcaatttaaccaaatatatttttaaatgaaaaatacaaaagaaataaaataccagagaaggattttatgcaagttagttttagaaggtccctctaattatattttcctaggtttaggatgctattaaaaatataagactcggcatgatgcacaattagaaaacggttaattttcggtatgttacataatacctctcctgttgctgcttatcatacttcctctgatacttattaataattctagccgaattcatctgaaaacctcgagtttttcctccatcggctgttcggccagctgtatgtaccatattgacaggaaaaggattgccattgaccttcatcggcttcttggaatcatcaaacttgatttttcctccctcaatagctgcctgaatctgctatctgaatattttgcaatcattagtagaatgagacccagagttatgccacttgcaataccttctcttgcccaattcctcagccgatgggattgtgtgaccagcaagaagttgaatctgcttctcccgaagtaacagatcgaaaatcttatcagccttggtgatgtcaaaagtcatacctctcctcttttccagaactatttacccattggcatggtataaccttcttgcttctgacccactcggctgttgctacctcggaatcatcatcatcatcatcggatccatacatgtaaggatagacatgattgatctttttgaagttcttcttggcttctgcaaacctttattcatgtagggttaccttctatgcaagatgtgatagactatcaaactcctgagac

SEQ ID NO: 9064 - DNA, 671 bp, Oryza sativa
ttttggatagaaattccgggcgtgacaggttaatacccccaaacagtgtcctcctggtacttctagagtttcttacgacaacctgtcatggccgtccaaccggggctaaatacggaggagtaccctccccagaaattgtcttaggaatatatactatcgtggaggaatactcgtactgagctgtcaccatcagcggcccacctctactgtcccgcggcatatatgcccaattaatgatatttaataatctaagcaccatgcttacattactacatactattctatacccatgcacccgacatagagcaattgataaatcaaacattaaatccgcaccattacacctctctggtaggctacccacacaatgaatataatgcataaataaagtaagaccggtacttagactaagcaaagtaccaaatatatataaagaagagtatttcattaatttggaaagtattacagaagagattataagagctgctagagccataccgaaaactcttccgaagattccgaggatttccgaacactattctatactacttgtcacgaccggaaataacccaacgggcgttcctgacgtgcgtgcattaatccttggcccaggaggcaaagtacaccgaaagttgatacaattcagagtttaacaagcggaagcgtaaata

SEQ ID NO: 9065 - DNA, 660 bp, Oryza sativa
aatccatataaaggttttaatccgatttaatctttaaaaattcataactaattcatctaggctcggtttaatgtggttcaagttgcaaaaattatataaaataaagatctacatattaaaattgtccataaattgaattaaatttattgaattctttttaaatgggctttaattagatttaatcttgtaaaattcataataaattcatttgaagtcagaatgaggccgttcaagtctcataattcatctcaaattatgatctacatgtttgtttactttttatgtattgtttatttggtttttattagtctttttcttcgttttgcgtgtaagcttgtcgtttccgtcgttgcaaaggttcgtgagtgcgccgtaagtattcaagaagattaattgaagaccgattattgcaaggcaagtcacactgatcctaaacacaatcctttgaacatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatattggttcaactagatattagatataattgcttagccatgcttag
